United States Patent 8,299,318 (NUCLEOTIDE SEQUENCES AND CORRESPONDING POLYPEPTIDES CONFERRING MODULATED PLANT CHARACTERISTICS) - sequence listing, part 7

SEQ ID NO: 17439 - DNA, 672 bp, Panicum virgatum
  misc_feature: Ceres CLONE 1792376-R
gtaccaagctgaatgtcatacatgagctccaatatgtctattctaagagatttacatgatactactatatatattaagctatttttggtacagtcaaggacacagaatgcttgcttggtagagctgacaagttcaggcaatatggctacaatacagtccttatgcaatctgattctgtcaagtatgctcttatgcaacatgtgatttttttttccttctgtggccatttgtggagagtttatctaaatgcctaaagcatggactttacaatccacttaaagcaagatcaaagtattgcagatgcgatatacatcactaacagtgtttcattctcctttgtgatttttgacattcctgttttctgcctttattgatacaaaatttggttacaaaattttgacatctctaacagctgaaggcactgcaagatcccagaacaagacgctcgaaaaacaggatcggcggcagcaaggacacgagggctggaggggaggagcaaccagatggaggtgcatggtcaagcaatccccgttagttcatgaccgcaggctaggcgtccgaacaaacagagttgtaaaggtgtaaagggtagcctagacaatcctgtaattgtgtttgatgggatggcttgtccaaagttaaacgaaagaatcaatattgttgtctcctcgt

SEQ ID NO: 17440 - DNA, 671 bp, Panicum virgatum
  misc_feature: Ceres CLONE 1792385
  misc_feature: Encodes the peptide sequence at SEQ ID NO. 17441
tcctttgtacccctcctcctgctcctcctctgcgctcttcgcgcaccaagacgcagaagaatcccttactactcatgcgtgaccaccgcctcctcgcgccgcatatgaatcacaaatgagtaagggccgcagcacccgctcctcgaagctcatcagcgagaagcttgaggaacaccggatctccaccgccaagcactgccgccgctgcggggagacaatcgacacctagccggattgggtggggctgccggccggactcaagttcgatccatctgaccaggagctgatcgagcacctcgaggcgaaagtgaaggacgaaagctcgagatctcaccctctcatcgactagttcataccctcaatagatggggaggacggtatatgttacacccacccccaaacacttccaggcgtgaccagggatggtctgagcatgcccttcttccaccggacatccgaagcctatacgacgggcacgaggaagaggaggaagatacagacggactgcgacgtccacgaaggcgatacgaggtggcacaagaccggaacgacgcggccggagatggtgaacggccggcagaaggggtgcaagaggattctggtgctgtacaccaacttcagcaagcaccgtcaagcaggagaaaacgaactgggtgatgcaccaataccac

SEQ ID NO: 17441 - protein, 79 aa, Panicum virgatum
  misc_feature: Ceres CLONE 1792385
  misc_feature: The sequence is a functional homolog of SEQ ID NO 1710 in the 10/374,780 US patent application
  misc_feature: The sequence is a functional homolog of SEQ ID NO 1713 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Functional homolog of the protein sequence given in SEQ ID NO 50710
  misc_feature: Useful for making plants with altered carbohydrate content
  misc_feature: The sequence is a functional homolog of SEQ ID NO 562 in the 11/435,388 US patent application
MPFFHRTSEAYTTGTRKRRKIQTDCDVHEGDTRWHKTGTTRPEMVNGRQKGCKRILVLYTNFSKHRQAGENELGDAPIP

SEQ ID NO: 17442 - DNA, 1315 bp, Panicum virgatum
  misc_feature: Ceres CLONE 1792388
  misc_feature: Encodes the peptide sequence at SEQ ID NO. 17443
caggtgggggactcgtctccttccagtagcagtaggcaagttgccactcgagagagggcgggagcacctccgcctcagatccgccgccgactctccgagccccaccagcctcccacccatgcgcccgccggcgatgctccgctgggccgcggtggcgctcgctctcgcggccgcggcgctcctcgccgccgcaccggccgccgccttctacctccccggcgtcgcgcccagcggcttccagaagaaagatgcactcttggtgaaggtgaataagctgacatccacaaagacacaacttccctactcctattactctcttcctttctgcaagccggacacgatagttgacagcgcagagaatcttggagaagttctgcgtggtgatcgcattgagaattccccttatgtgttcgagatgagggagcccaagatgtgccagattatctgcagagcatcaattgatgataaacaagcaaatgagctcaaggaaaagatagaggatgagtatcgggtgaacatgattcttgacaacctcccgctagttgttcctatcgcaaggcaggacagggatgctattgtttatcagggtggatatcatgttggtgtcaagggccaatatgctggtagcaaggatgaaaaggtctttatccacaaccacttgacatttttagttaaataccacaaggatgaaactacmsaactctctagaattgttggatttgaggtcaaaccattcagtattaaccatcagtttgaaggccaatggaatgataaaaacactcgtttgatcacgtgtgatcctcatgccagcaagcttgtgacaaactcagatactcctcaggaggttgaagctggaaaggaaatcatatttacctatgatgttggctttgaggagagtgatgtcaagtgggcttctcgctgggacacctacctgttaatgacagatgatcaaattcactggttttccattgtgaactctctcatgatcgtactcttcttatctgggatggtggccatgattatgctccgcactctgtatagagatatctccaggtacaaccagcttgaaactgaagaagaagcccaagaggagacaggatggaagcttgttcatggagatgtgttccgccctcctgaaaactctgacttactctgtgtctgcgttgggactggtgttcagttctttggtatgctgctagtaaccatgattttcgctgttctgggattcctttcgccatcaaaccgaggcgggctgatgactgctatgctgctcacttgggtcctgatgggattgtttgctggatatgcttcttca

SEQ ID NO: 17443 - protein, 398 aa, Panicum virgatum
  misc_feature: Ceres CLONE 1792388
  misc_feature (60)..(398): Pfam Name: EMP70 Pfam Description: Endomembrane protein 70
  misc_feature (194)..(194): Xaa is any aa, unknown, or other
MRPPAMLRWAAVALALAAAALLAAAPAAAFYLPGVAPSGFQKKDALLVKVNKLTSTKTQLPYSYYSLPFCKPDTIVDSAENLGEVLRGDRIENSPYVFEMREPKMCQIICRASIDDKQANELKEKIEDEYRVNMILDNLPLVVPIARQDRDAIVYQGGYHVGVKGQYAGSKDEKVFIHNHLTFLVKYHKDETTXLSRIVGFEVKPFSINHQFEGQWNDKNTRLITCDPHASKLVTNSDTPQEVEAGKEIIFTYDVGFEESDVKWASRWDTYLLMTDDQIHWFSIVNSLMIVLFLSGMVAMIMLRTLYRDISRYNQLETEEEAQEETGWKLVHGDVFRPPENSDLLCVCVGTGVQFFGMLLVTMIFAVLGFLSPSNRGGLMTAMLLTWVLMGLFAGYAS

SEQ ID NO: 17444 - DNA, 638 bp, Panicum virgatum
  misc_feature: Ceres CLONE 1792388-R
gcttcaccagttctactacatctttggcttccttttcctggtgttcattatcctcatcatcacctgtgcggagattacgatcgtgctgtgctatttccaactgtgcagtgaggactataactggtggtggaggtcctatctcacctcaggatcatctgcaatctacctcttcctgtatgccgggttctacttcttcacaaagctgcagattaccaaactggtgtcaggcatactgtactttggctacatgcttctggcctcgtttgcgttctttgtgctcactggtacaatcgggttctgcgcctgcttctggttcacgagattgatctactcgtctgtgaagattgactaggctggatgacatgagactgcagagagtttgctgtacggttatggtgaagtggcctccatttaccaccctgcgtttttgtgaattcagaaactctgtattttaggtgttattaacagcataaaccatttatttccactgtggttcagatctgatatgatacatctgtcgctatggagttgtgtaaggataggaaactactgtcagcttcatatggggcaatttttccgtactgttatgaactggtgtataaattcaagtcatagctactcgctcataattgcctgct

SEQ ID NO: 17445 - DNA, 663 bp, Panicum virgatum
  misc_feature: Ceres CLONE 1792392-R
  misc_feature: Encodes the peptide sequence at SEQ ID NO. 17446
gtttgcatcattccaatgtttttgatgacttggtaaacgggagggcaccctctgttgagttccatgtcaacgacaacatatattcccttggatactacctagcagatggcatctatcccgattgggctacactagtgaaaaacattcctttgccagttagcaacaagcaaaaggtatttttagagcaacaagagtcatgtcgaaaggatgtggagagagcttttggtgtcctacaggctaagtggaaaatcttgcaccggccagctcgtttatggaatcaacaagtacttaattcaataatgcatgcttgtgtcatacttcacaacatggtagttgaagatgagcgcggggttcatctacctaatgtccacccatcagaatggcctggagtggctgacccaccaattaaccaggctacagaaatcccaggaattgagaaacttattgatgctcaaaacatcattcaggatagagagatggcagctcagcttcaaaatgacctgatggagcacatgtggatgctatatggccaatgatctggtccttttggtcctaataacaggcactaaagtctttctattttgttgctgaattgaacattagtggaactctatccctgctctgtaaatatttcagtgaatgacaagctgttagctgagctct

SEQ ID NO: 17446 - protein, 177 aa, Panicum virgatum
  misc_feature: Ceres CLONE 1792392-R
  misc_feature (8)..(118): Pfam Name: Plant_tran Pfam Description: Plant transposon protein
LHHSNVFDDLVNGRAPSVEFHVNDNIYSLGYYLADGIYPDWATLVKNIPLPVSNKQKVFLEQQESCRKDVERAFGVLQAKWKILHRPARLWNQQVLNSIMHACVILHNMVVEDERGVHLPNVHPSEWPGVADPPINQATEIPGIEKLIDAQNIIQDREMAAQLQNDLMEHMWMLYGQ

SEQ ID NO: 17447 - DNA, 631 bp, Panicum virgatum
  misc_feature: Ceres CLONE 1792392
ataggtcacgcacctaaacactctcgtctccaacaacaaacccaaaagaagtccaggcgacatggatgcccccccccccccaacccccccggccagtttctttcccgcgcgttcgatgaaataggcagcaaaagaagtccaggtgacacgggaaaaaggagccgtccaggcgacacagacgcagaaggagccgccggcgtcaacctcgcacagacgcaaaagaaggagccgccggcgatcagcatcacaaggctcggcgtcgtatcacaggcaatctgatttctaggggattaaatccctcaaccttctgcaatcggcttggattaaatccctcaaccttatgcaatttttccctaaatcgaccttgctttgacctggccgcgccgcctgccgggccgccgcatcctcctccccgctcccgcgttcgtcgcaaggcgccgccgccgcgggtctcctcaagccaccaccgcactggtccccccgcttcgaaccaccgcaccgccgaacccatctcctggcctctcttccaccgaggcgcggcaaattcctgcctcctagtcgtcgtcggcggtgtcgttaacatcgttatcctcgctggtggtgctggacttgcatgggcggcagatccact

SEQ ID NO: 17448 - DNA, 2542 bp, Panicum virgatum
  misc_feature: Ceres CLONE 1792402
  misc_feature: Encodes the peptide sequence at SEQ ID NO. 17449
gcctgcccttgccactcccgtcggcggaaacatcccactcccccccccgggcccccaccatctgcctgcgcgcccaccaccatccccgccgctgctcctcgtctccctgcctccccggccagaccagctacctcgccccttcccggtgttactgccctgttcttcccccgtccgcgcaaccggctgggctcggctacctcgccgcccgctctccgagtacggcttcagctacaaggatctggggcctcggcgcgcgccggccgacgggagagattttgtttgatctgagtgtactagaggacaagaagacatatcaataatcaagctgcaaaaaaatctctgaattgacttcagaactggacatgcttgtcataccagaagcacttgacaactcggagttttagtgcatccgactcttgtactgaactaggatggctgatactccaacttcccacatggtgcacccctttggcaatgtcccaaggcagactccgaagcaattcctgtattctggcaacgctcagcaccactgtgatccatatcagtcagcttcggacacccatgttgtaccgcagcatcattacaccatgaagtctcattcaccggatgctggctctgaagagcatgagacccacaagcagtacacactggactcttctgcagcttctggttgctcgaggcatgattctccctccagtcagagtatccatactgggagtggcagccctctatctcatgaagatagccactccggctccaccaatggcaacggatcacctgtgagcgcttcctgcgtcactgaggaccctactgatctgaagcagaagctaaaggatcttgaggctgtgatgcttgggacagactcagagatagtggatagccttgagatctctgttgcaaaccaactttccttggaaccggagaagtgggtgcacatgatgagcgtgcccaaaggcaacttgaaggagctgctgattgcttgtgctagagcagtggaacataataacagtttcgcaattgatctgatgattccagagctgaggaaaatggtctcagtgtctagtgagccacttgaaaggctgggggcctacatggtggaaggtctggtggccaggctcgcctcctccggaaactcaatctacaaagctctgaagtgcaaagagcccaagagttctgatctcctgtcctacatgcacttcctgtatgaggcctgcccctacttcaagtttggctacatgtcagcaaatggtgcaatcgcagaggctgtcaagggagaagacaggatccatatcattgatttccaaatcgcccaaggggcgcagtggatctctctccttcaggccctggcagccaggcctggtggaccaccattcgtgaggatcaccggcattgatgattcagtctcagcttacgcccgaggcggtggtctggagttggttggaaggagactttcacacattgctggcctctacaaggtgccctttcagttcaatgcagtcgctatctccggcagtgaagtggaagagggacatctcggcatcattcccggttaagccattgctgtcaacttcaccctggaactgcaccacatccccgacgagaccgtgagcacggcgaaccaccgggaccggatcctgaggctggtaaagggcctgtcgcccaaggtgctcacgctggtggagcaggagtccaacaccaacacggcccccttcgcacagcggttcgcggagacactggactactacacagccatcttcgagtccatcgacctggcgctgccgagggaggaccgggagcggatcaacatggagcagcactgcctggcgagggagatcgtgaacctggtggcctgcgagggggaggagcgggtggagcggcatgaggtgttcggcaaatggaaggcgcggctgatgatggccgggttcaggccgtccccactcagtgcgctggtgaatgccaccatcaagacgctgctgcagagctactcgccagactacaagctcgctgagagggacggcgtgctctacctcggctggaagaacaggcccctggtggtctcgtcggcatggcattaatgttgtgagaatgtagacctgacgaagaatgtttattgtgaccttgtacctcacaatcgtttaggtgtgtccggctgaaaactagtataggaagttatggcaatactggatggagtagaatacctataacctaatgttgtaatggtagtcactaccagcctagaactggttgatgaggtgtagtacaagtttgggtatatgttttaagttaatcagttgtgctttgaaaatctttgtgcatgctgatgaatatgacctcagtcagagaggtcatctaccattccactctttcaactaatcatttggaaatcttcattactggccagtggggctgaaaatcaacagaaaatttattcgtttcagtttgtaaaaatccaacatattttgcctacctgaagaaaacatgcctgtgaaatgatatatttcattccatatatcaatatcaaactggcatcgttcatatgcag

SEQ ID NO: 17449 - protein, 373 aa, Panicum virgatum
  misc_feature: Ceres CLONE 1792402
  misc_feature (155)..(370): Pfam Name: GRAS Pfam Description: GRAS family transcription factor
  misc_feature: The sequence is a functional homolog of SEQ ID NO 474 in the 10/666,642 US patent application
  misc_feature: Functional homolog of the protein sequence given in SEQ ID NO 50758
  misc_feature: Useful for making plants with modulated light quality sensitivity
  misc_feature: Functional homolog of the protein sequence given in SEQ ID NO 50759
  misc_feature: Useful for making plants with modulated low light sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MADTPTSHMVHPFGNVPRQTPKQFLYSGNAQHHCDPYQSASDTHVVPQHHYTMKSHSPDAGSEEHETHKQYTLDSSAASGCSRHDSPSSQSIHTGSGSPLSHEDSHSGSTNGNGSPVSASCVTEDPTDLKQKLKDLEAVMLGTDSEIVDSLEISVANQLSLEPEKWVHMMSVPKGNLKELLIACARAVEHNNSFAIDLMIPELRKMVSVSSEPLERLGAYMVEGLVARLASSGNSIYKALKCKEPKSSDLLSYMHFLYEACPYFKFGYMSANGAIAEAVKGEDRIHIIDFQIAQGAQWISLLQALAARPGGPPFVRITGIDDSVSAYARGGGLELVGRRLSHIAGLYKVPFQFNAVAISGSEVEEGHLGIIPG

SEQ ID NO: 17450 - DNA, 1287 bp, Panicum virgatum
  misc_feature: Ceres CLONE 1792406
  misc_feature: Encodes the peptide sequence at SEQ ID NO. 17451
gcgaccaagtactgctagtactacccacaacaagctcctgctcctcctgattcttctgctagtcgtcttcttcttcttcttcttcttcttgatcccgaccgtcttgttgcccccagaccgaaccatgtcgtcgtcgtcgtcgtcgtcttcctctgcatcggacgccgccgcttcgacgccgttcgagaagcccagggccgtggtcaagaagctcctcgccgagtcgcagcccgagggtcagggcgccaccgtccggaggagcatcggcaggcatgagctcaggaacctggaccccttcctcatgctcgacgagttctcagtctccaagcccgccgggttccccgaccacccccacagaggattcgagaccgtcacctacatgctcgagggcgccttcacccaccaggattttgcaggccacaagggcaccatcaggacaggggatgtccagtggatgactgccgggcgtggcatcgtgcactcggagatgccggcgggagacggggtgcagaagggcctgcagctctggatcaacctctcctccaaagacaagatgatcgagccccggtaccaggagctccagagcaaggacatcagccgcgccgacaaggacggcgtggaggtccggatcatcgccggcgaggccttcggcgtgcgctccccggtgtacacgcgcaccccgaccatgtacatggacttcaccatgcggccggggtcggagctccaccagcccatcccggagggctggaacgccttcgtctacatcatcgacggcgagggcgtgttcggccgggagaggtcggcccccgtcggcgcgcaccactgcctcgtgctgggccccggcgacgggctgagcgtgtggaacaagtccggcgcgccgctgcggttcgcgctggtgggcgggcagccgctgggcgagccggtggtgcagcacgggcccttcgtcatgaactcgcgcgccgagatccagcagaccatggaggactactactacggcaagaacggcttcgagagggccacccagtggacctcctcctccgcctgatccacagagaaatcgacacagggggaagaaaaaggaaaacaaaacaattgatgtcctccatcatacttggattggacagagttgaccattagcctatacatactactgtactcttatcttgataactaattttttttctccttattgtcttgtatggtgattgtaataagcagattggagaattcatttacagtctgttctaatataccatcatgatttctttcaatggattaaatttgtcc

SEQ ID NO: 17451 - protein, 347 aa, Panicum virgatum
  misc_feature: Ceres CLONE 1792406
  misc_feature (81)..(177): Pfam Name: Pirin Pfam Description: Pirin
  misc_feature (230)..(335): Pfam Name: Pirin_C Pfam Description: Pirin C-terminal cupin domain
RPSTASTTHNKLLLLLILLLVVFFFFFFFLIPTVLLPPDRTMSSSSSSSSSASDAAASTPFEKPRAVVKKLLAESQPEGQGATVRRSIGRHELRNLDPFLMLDEFSVSKPAGFPDHPHRGFETVTYMLEGAFTHQDFAGHKGTIRTGDVQWMTAGRGIVHSEMPAGDGVQKGLQLWINLSSKDKMIEPRYQELQSKDISRADKDGVEVRIIAGEAFGVRSPVYTRTPTMYMDFTMRPGSELHQPIPEGWNAFVYIIDGEGVFGRERSAPVGAHHCLVLGPGDGLSVWNKSGAPLRFALVGGQPLGEPVVQHGPFVMNSRAEIQQTMEDYYYGKNGFERATQWTSSSA

SEQ ID NO: 17452 - DNA, 740 bp, Panicum virgatum
  misc_feature: Ceres CLONE 1792410
  misc_feature: Encodes the peptide sequence at SEQ ID NO. 17453
atcccattttccctcttctcttcaagtcccacccataaggcttggagggaagaagagagagcttagcagcccagaaccaaagccggcaagcaaaatggcgatctgcagcacgcacaccaccacctccctgcactccccatgcacagtctcaaacacaggcttcaggcagaagcaagtcatcttcttcaccagcaacaggagaagtggcagaaggcatggaggggcaagaacctttcaggtttcatgctccgtcgagaagccagtggtgattggcctggcggcagactcaggatgcgggaagagtaccttcatgcgccgtctcaccagtgtgtttggtggtgctgcagagccacccaagggtggtaacccggactccaacaccctcatcagtgacaccacgacggtgatatgccttgatgactaccattccttggacagaaccgggagaaaggagaagggtgttaccgccctcgacccaagggcgaacaactttgatctcatgtatgagcaggtgaaggcgatcaaagaaggccagacaattgagaagccgatctacaaccatgtcactggcctcctcgacccaccggaggttatcacacccccaaagatttttgtcattgagggcttgcacccaatgtaagctcacattctatgcctatgctccacatgtgctactactctgtctcattctctcatgctatatgggtgtttgttcttttattttctcattgtaatcaggt

SEQ ID NO: 17453 - protein, 181 aa, Panicum virgatum
  misc_feature: Ceres CLONE 1792410
  misc_feature (58)..(181): Pfam Name: PRK Pfam Description: Phosphoribulokinase / Uridine kinase family
  misc_feature: SWISSPROT Homolog: EC 2.7.1.19 Phosphoribulokinase
  misc_feature: Functional homolog of the protein sequence given in SEQ ID NO 50316
  misc_feature: Useful for making plants with altered lignin content
MAICSTHTTTSLHSPCTVSNTGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVITPPKIFVIEGLHPM

SEQ ID NO: 17454 - DNA, 659 bp, Panicum virgatum
  misc_feature: Ceres CLONE 1792410-R
  misc_feature: Encodes the peptide sequence at SEQ ID NO. 17455
ttgatcatgaaagaaggcgtgaagcacttcaaccccagtttacctcttcgatgaaggatcaagtatcaactgggtgccttgcggaagaaagctcacatgctcttaccctggcatcaaatttgcctatggcccagacagttacttcggccacgaggtatcagtgttggagatggatgggcaattcgacagactagatgagctcatctatgtggagagccatctaagcaacctctcaactaaattctacggagaagtgacacagcaaatgctaaagcatgcagatttcccaggaagcaacaacggaacaggtctcttccagaccattgttggactgaagattagagatctctatgagcagatagttgctgagagggctggtgtaccagctgaagcagcgaaagtttaatgatctgcacattcagatttcctacacctcttcaaactcaatgagaatgagaatcctcgaaattcttgtaattagttcggatatatcacgactaggaggtagaaatgtcattgcagtactcaggaaaacatgcaatggaatttctagaaatacctcgccatgggggtgctcttacatctcttcttcacatgttcaaatgtatatcttcttccatgcttttatgcagaaaaaaatacagctgcctgctactatc

SEQ ID NO: 17455 - protein, 78 aa, Panicum virgatum
  misc_feature: Ceres CLONE 1792410-R
  misc_feature: SWISSPROT Homolog: EC 2.7.1.19 Phosphoribulokinase
  misc_feature: Functional homolog of the protein sequence given in SEQ ID NO 50316
  misc_feature: Useful for making plants with altered lignin content
MDGQFDRLDELIYVESHLSNLSTKFYGEVTQQMLKHADFPGSNNGTGLFQTIVGLKIRDLYEQIVAERAGVPAEAAKV

SEQ ID NO: 17456 - DNA, 2183 bp, Panicum virgatum
  misc_feature: Ceres CLONE 1792411
  misc_feature: Encodes the peptide sequence at SEQ ID NO. 17457
aggaagaggggcgggcgcgacgatgagggggccctcgggcgcgcggatgaccgcgcagggcgcggcggaggcggccgtgggcgccgtcgggtgcggctacgacctcacgggggacctccgcctggcgcgcgccaagccggcgggccggctgttggaggtcgacgccgcgccggcgcgggagctgtccctgccgggcggggccgtcgtcgcgggcgtgcccgccgggatcgtcgccgacaagggcgagcgcacgcggttccgctccgacatcctctccttcgctcagatggcggagcaggtgaaccagtcgctgtcgctggcggggaagatcccctcgggcgccttcaacgccatgttcgactaccgcgggtgctggcaccgggacgccgccgccacgcggagcctctgcttcgacggccgcttcgtcgagctctacagcgtcgaggccgtgcgcgcgcagctcgccctgcaggaccgcgtcaagcaggacctgccgcccttctgggatcccccggcgctcgccgagttcatcgacaagtacggcacgcacgtcatcgtcggggtgaagatgggaggcaaggacgtggtgtgcgtcaagcagctcaagggctccagcctgacgcagagcgacgtgcaggcccggctcaagcagctcgccgacgacaagttctcccacgacggcgccggagacgacagattagcagcgcacgggctaaacggaaatttcggccccggatcagctgcctggcagtcgttcagatctcccgtcgtgtcccacaaggatgacgtcgtctgcatccacatcagaagaggcggcgtcgacaacggccagggccacggcagatggctctcgacgatcaccgcctacccggacatcatctcgatatcgttcgtgcccattacttccctgctcaccggcgttcgaggctgcgggttcctgaaccatgcggtgaatctctacctcagatgtaagcgtctctgccgcgttgcactgtcatttttggcggtaagtctgatcggagctcacttgggattcagttcagatgcctgatcggccgtccatttcctgcttgtggattcagacaaaccgccgatagaggagctccagcagttcctggagttccaggtgccgcggcactgggctccggagttcggtgagcttcccctttgcctccagaggaggaagaacagcttgccgtctcttcagttcaccctcatgggccctaagcttcatgtcaatactgccaaggtcgattccggcaaccggccggtgaccggcatccggctgttcttggaaggcaagaagaacgaccggctgggcgtccacctgcagcacctgtcggtgacgccgagcaccatcacggtggtcggcgaggccgcgtcggccgaggacgtggccgtgaacgagcgcgactacatcgagcccgtcaggtcgccgctgctctcgcacgtctgcacggcgccggtgcagtacaacggcgcgcggatcgacgactgcgcggcgatcgtgacccgggcgtggctggaggtgcgcgacacctgctgcctcaagaaggtgctcttcctgcggctcggcttctcgggtgtcgcggccatgaagatacggcggtccgagtgggacgggccctccgtcgtgccccgcaagtccggctcgctgtcgatgaggctcagcgcggcgctgtccggcggcctggcgcaggcgccgccggcccccgcggaggaggagaaggtggaggtgaactccgccatattccccaagggcccgccggtgccgctcccggtccagaagatggcgaggcacgtggacaccaccgaggtgatgagggggcccgacgaccagccggggtactgggtggtcaccggcgggaagctgtgcgttgagggcggcaaggtagcgctcaaggtcaaatactcgctgcttatcgcagtgcaggaggacactgacgtctgaggcttcattgccgttggttgatcgatgcctcggcttctctgtttttgtgtgtggtttgcctagtgttagcgtgcagttcagtcgtccgagtggtgtaaatggtgagagggcggagcatgctgcttacaaatatgttgtagttgtacagaacatacagagtgcctacagaactgggttctgtttgcatgcaaagtattttttttagagtattggacaaataatacggttttgc

SEQ ID NO: 17457 - protein, 342 aa, Panicum virgatum
  misc_feature: Ceres CLONE 1792411
  misc_feature (125)..(315): Pfam Name: MACPF Pfam Description: MAC/Perforin domain
MRGPSGARMTAQGAAEAAVGAVGCGYDLTGDLRLARAKPAGRLLEVDAAPARELSLPGGAVVAGVPAGIVADKGERTRFRSDILSFAQMAEQVNQSLSLAGKIPSGAFNAMFDYRGCWHRDAAATRSLCFDGRFVELYSVEAVRAQLALQDRVKQDLPPFWDPPALAEFIDKYGTHVIVGVKMGGKDVVCVKQLKGSSLTQSDVQARLKQLADDKFSHDGAGDDRLAAHGLNGNFGPGSAAWQSFRSPVVSHKDDVVCIHIRRGGVDNGQGHGRWLSTITAYPDIISISFVPITSLLTGVRGCGFLNHAVNLYLRCKRLCRVALSFLAVSLIGAHLGFSSDA

SEQ ID NO: 17458 - DNA, 1954 bp, Panicum virgatum
  misc_feature: Ceres CLONE 1792413
  misc_feature: Encodes the peptide sequence at SEQ ID NO. 17459
atcatcaacgcatcgcatcgcgtccgcattctccagcctccgcctccctccctccgtcctcgccgcgcaccctctcccccctcgatctcgcgaaccctgctgaggcaggcgggctagatcccggacccccgccatgtccaagccctggggcggcctcggcggcgccggcgcgtgggcgctggacgccgagcgcgccgaggaggaagagcgcgaggccgccgccaacccgccgcccgccccggcctcgagcttcccgagcctccgcgaggccgccgccggcaaatccaagaagaagaacaagggcaccacgctctcgctctccgagttcgccggctacggcccgggcaggcgccaggcgccggcgccggagcccaaggggctcaccccggcggagatgatgatgctgccctcggggcccagggagcggtccgccgaggagctcgaccggccccgcggcctcggcggcggcttccgctcctacggcaccggggaccgcggcggcggcgggttcgacgatgacggccgccgcaggggcgcggatctcgacatgccctcgcgcgccgacgaggatcgcgactggtccatgagcaagaagtcgctcgcgcccgccgactccggcccgcggagccggtacggcggactcgggggcggcggcgcgcccgcgtccgtcggccgcgccgacgacgacggcgactggtcgcgcgggaagaagccgatgccgtcagggccgtcgcgctacccgagcctcagcggcggcggcggcggcggcttccgcgactcgcccgtctcgaccgactcctccgaccgctggtcccgtgccgcgcccgcgcccaccaatggcgagcgggaccggccccgcctagtgctcgatccgcccaagcgcgacgcctccgccacacctacaccaccagctgaggcggggcgcagccggccgagcccattcggggccgcgaggccacgggaagacgtactggccgacaaagggctggactggaagaagatggagactgagatcgatcagaagaagactagccgtcctaccagctcacagtcgagcaggccagagagtgctcactcgtcacgacctgggagccccgggtcacaggtaccagctgtgggtactgaaggcgtgccgagggcacgaccaaaggtgaatccttttggtgatgcaaagcctagggaggtgattctacaggagaaagggaaggattggaggaagattgacctcgagctggagcatcgccgtattgatagaccggaaacaaatgatgagagggagttgaaagaagagatcaatctacttaagttggaactaaatgaaaatgaagccaagatgagtgaagacgatgcaaaaagtttggctgagaagataactcaaatggaaaaacagctggagcttcttacaattgcaatggatgacaagatcagattttcgcaaagacctggctctggagcagggagggttacagcatcttcgccaacaaatcttgcagatgaatcccaaataaaggagtccatggaaaggccaggttcccgcagtggcatggatcaatattcaaaaccaactgaagaaagatgggggtttcaggggagcagagatagaggctcttttggtggcaacagaagttcagacaggtcgtcgggaggacaaagatggtgagccgttgccagccagatttttcacttcgtgtttagatggagcacaaataatttatgttcttgttgctgcttgactcattttgtttggcttggaagaggggagaggatcgtgcacaaaacagattgctttgcactaagttgttaattaccacccttatggtggttcgtctattttgtttttttttctttgtaaattttcttttaccctcttccatgtcaaaacaaatgtgacaacctttcatagactaactattgttcttgcttcctgcatgattatgctgtagcattcttattc

SEQ ID NO: 17459 - protein, 508 aa, Panicum virgatum
  misc_feature: Ceres CLONE 1792413
  misc_feature (1)..(508): Pfam Name: eIF-4B Pfam Description: Plant specific eukaryotic initiation factor 4B
MSKPWGGLGGAGAWALDAERAEEEEREAAANPPPAPASSFPSLREAAAGKSKKKNKGTTLSLSEFAGYGPGRRQAPAPEPKGLTPAEMMMLPSGPRERSAEELDRPRGLGGGFRSYGTGDRGGGGFDDDGRRRGADLDMPSRADEDRDWSMSKKSLAPADSGPRSRYGGLGGGGAPASVGRADDDGDWSRGKKPMPSGPSRYPSLSGGGGGGFRDSPVSTDSSDRWSRAAPAPTNGERDRPRLVLDPPKRDASATPTPPAEAGRSRPSPFGAARPREDVLADKGLDWKKMETEIDQKKTSRPTSSQSSRPESAHSSRPGSPGSQVPAVGTEGVPRARPKVNPFGDAKPREVILQEKGKDWRKIDLELEHRRIDRPETNDERELKEEINLLKLELNENEAKMSEDDAKSLAEKITQMEKQLELLTIAMDDKIRFSQRPGSGAGRVTASSPTNLADESQIKESMERPGSRSGMDQYSKPTEERWGFQGSRDRGSFGGNRSSDRSSGGQRW

SEQ ID NO: 17460 - DNA, 662 bp, Panicum virgatum
  misc_feature: Ceres CLONE 1792415
  misc_feature: Encodes the peptide sequence at SEQ ID NO. 17461
atctcgaaaccccattccccctcccatccccggccgccacacttccccagatctcgtccccacctccggccctccccccccccccgcctcgaccgccgggagtgagaagagatggcgggcaagggcgacgggccggcgatcggcatcgacctcggcaccacatactcgtgcgtcggcgtgtggcagcacgaccgcgtcgagatcatcgccgacgaccaggggaaccgcaccaccccctcgtacgtcgccttcgccgactccgagcgcctcatcggagatgccgccaagaaccaagtcgccatgaaccccatcaacaccgtctttgatgccaagcctctcatcggcaggaggttcactgatgtttctgtccagagtgatatcaagctctggccattcaagatcatttctggacctggtgagaagcccatgattgttgtccagcacaagggtgaggagaaccagtttgccgctgaggagatctcatccatggttctgatcaagatgcgtgagattgctgaagcttaccttggcagcactatcaagaactctgtggtcacagttctcgcctacttcaatgactcccagaggcaggccaccatggatgctggggtgattgctggcctcaacgtgctgcgtatcatcaatgagccgactgctgctgc

SEQ ID NO: 17461 - protein, 183 aa, Panicum virgatum
  misc_feature: Ceres CLONE 1792415
  misc_feature (9)..(183): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGDGPAIGIDLGTTYSCVGVWQHDRVEIIADDQGNRTTPSYVAFADSERLIGDAAKNQVAMNPINTVFDAKPLIGRRFTDVSVQSDIKLWPFKIISGPGEKPMIVVQHKGEENQFAAEEISSMVLIKMREIAEAYLGSTIKNSVVTVLAYFNDSQRQATMDAGVIAGLNVLRIINEPTAA

SEQ ID NO: 17462 - DNA, 2350 bp, Panicum virgatum
  misc_feature: Ceres CLONE 1792421
  misc_feature: Encodes the peptide sequence at SEQ ID NO. 17463
gttttcctccgttcttctcactccccgagaggcaacctccggcggccggttgcttcccacgccgcgaatggcgtcccccgcatccgcctcggcgcggcctctatccctaaccctaaccgtccctttcccccgttattcctcgcgcgtcctccccttgcccttctcccgccgcctcccgagccgctgcgtcgcgctagcgccggcgcggcctggcgccgcgctcctctccagcctcagcgacgcgcgggagcaggatgaggaggaggaagaggagttctacgaggagggggatgagcaacaggaatacgacgaggaggaggaggaacaggaatacgacgaggaggacgaggagctggtggaggtgggctacgtgtccggcgcgcacggggtgcgcggcgacgtcctcgtcacgccacgcaccgacttccctgagctccgcttcgccacgccggggatgcgatggctgagggctcgggctgctgggaagcaacacgtcagggaattcgagcttgttcgaggaaaggcccacacggggaagaagtgttggatcgtcagctttgatggcatcgataatctggatgagttgctactctcctttcaggctaggcaaatagtcggttcagctatactcgtgaaagctggagataggccagaaattgaggctgatgagttctattcacttgatcttgttgaaatgagagttattgtcaaggatacaggcaagcttgtaggaacagttggtcaggttttcaattttggaggtggagatcttctacaggtgatgattggctctgctgaaggtactgttgtcgatccagattcagaaaatcaagattcaacttcatcacgcgagcatgtgtgggttccatttgccgaagatattgtacctgatgttgatatggagcgcagagaaatgtggattacacctccaaagggtttactggagctcaattcacgttctgacaagagatcgaagaaagaaaggcgtgcgatggagtggaaggacaggaagaggcttcagcgtcgtgtaattgctggaaagaaggtgctcgccgaaatggatcagggtcatgttctggaaggcttgctatctggggacaaggttcaaaaggcatcacttgcagagcagattggatgtattgactttcaattgttccgacatgcagtgcattgtgttagcaaacaaattgagagctcttcaaagaatttgctggctaattcagcactgtcaaggaaaaaggtgatcaaaataccatacaagagtttcatcaatcttggagagaaatctgaacatgcattcagtagagaactcaaagaaggtctcgagactcttttgaagtcaaaagcagctattgtacttgttagaaatggctcagattctgatgctaagtttctgagtttgctcagttcttttagtgagttaatgaaggatattgacaatcttgtgtcaccccctttcgttattgtttcccatcctggtcatgtggagtcagttacgaactgcctgataaagaataactattttggtttggatgctcaaaaggtgtgggttctggaagagctggagcttccaattgtcagtatatcctccgaggcaaacagaaaaaaggttctgatgaagtctccctgggagataattaaaaagccagtgggatctgggggtattttcagcttactatcatcaaacaaaattttggactccctcaatgaaatgggtgtacagtatatacagatatgcagctcatccagcaggccagtcattgggcatcctctgctatttggtgctgtcgcttgccgcagtgctgatgttggcatcaagctctccaagaccagtgaactgggaaatgatttcgacttgatcctttccatcgaccagttgaacaagatgtgccgagatgtcactcagctcaggttctccgcctgccctgagcaaaacgcgcatgtcgagcttgtcgatggccagtgggccgttgtcccgccggagacggcaaattcccatcgtctgaacgccgacgttacgagtgtattgaactcctgcgctgttgataaagtgtgcgttatggagattatagagcaataaaatttctacatgtatgtgcgacgctttttctactgttgccttgcacctgctgtatgagtttctaggggagctagtacggaatggaataccagccactgatgacacgcactgccgattcaagattaaaaaatgtgaatggaataatgtataactagtatgttcataagacctttttgtgatttaaatcaatattaggattctgtttcctgtaaatgctgtttgaacagagaaattgatttgataatttatggaacgtgctcctattcccgc

SEQ ID NO: 17463 - protein, 670 aa, Panicum virgatum
  misc_feature: Ceres CLONE 1792421
  misc_feature (98)..(193): Pfam Name: RimM Pfam Description: RimM N-terminal domain
  misc_feature (199)..(292): Pfam Name: PRC Pfam Description: PRC-barrel domain
  misc_feature: SWISSPROT Homolog: EC 2.7.7.23 UDP-N-acetylglucosamine diphosphorylase
MASPASASARPLSLTLTVPFPRYSSRVLPLPFSRRLPSRCVALAPARPGAALLSSLSDAREQDEEEEEEFYEEGDEQQEYDEEEEEQEYDEEDEELVEVGYVSGAHGVRGDVLVTPRTDFPELRFATPGMRWLRARAAGKQHVREFELVRGKAHTGKKCWIVSFDGIDNLDELLLSFQARQIVGSAILVKAGDRPEIEADEFYSLDLVEMRVIVKDTGKLVGTVGQVFNFGGGDLLQVMIGSAEGTVVDPDSENQDSTSSREHVWVPFAEDIVPDVDMERREMWITPPKGLLELNSRSDKRSKKERRAMEWKDRKRLQRRVIAGKKVLAEMDQGHVLEGLLSGDKVQKASLAEQIGCIDFQLFRHAVHCVSKQIESSSKNLLANSALSRKKVIKIPYKSFINLGEKSEHAFSRELKEGLETLLKSKAAIVLVRNGSDSDAKFLSLLSSFSELMKDIDNLVSPPFVIVSHPGHVESVTNCLIKNNYFGLDAQKVWVLEELELPIVSISSEANRKKVLMKSPWEIIKKPVGSGGIFSLLSSNKILDSLNEMGVQYIQICSSSSRPVIGHPLLFGAVACRSADVGIKLSKTSELGNDFDLILSIDQLNKMCRDVTQLRFSACPEQNAHVELVDGQWAVVPPETANSHRLNADVTSVLNSCAVDKVCVMEIIEQ

SEQ ID NO: 17464 - DNA, 1876 bp, Panicum virgatum
  misc_feature: Ceres CLONE 1792423
  misc_feature: Encodes the peptide sequence at SEQ ID NO. 17465
aaaaatccgcccatttcattcctccgtctcgctcgcctcgtcacctctcccgcgcccacccccacaaatctcactcccagttggtggcttggtgcgcgctcgcgtccaaaccaagcaaacccaaaaccctagcctgccgccgccgctgccggcggggctccctctggtcctgtcccggcctaccctatcctcgcagcaaccctaaccctacccgccgctgccgccggagcaggggggcaaaatgccgcgcgagatcatcacgatccaggtggggcaatgcgggaaccagatcgggatggagttctggaagcagctctgcctcgagcacggcatcggcaaggacggcctcctcgaggacttcgccacccagggtggtgacaggaaggatgtcttcttttaccaggctgatgatcagcacttcatacccaggtctcttcttattgacttggagccaagagtgatcaatggaattcagaacagtgagtataggaacctgtacaaccatgagaacatatttgtcgctgagcacggtggtggtgctgggaacaactgggccagtgggtatcatcagggtgaacaagttgttgatgatatcatggacatggttgatagagaagcagatggaagtgatagccttgagggttttgtcctttgtcactctattgctggtggaactggttcaggtatgggttcttatctgttggagacattgaatgatcgatacagtaaaaagcttgtgcagacatatagtgtcttcccaaatcagatggaaacaagtgatgttgtcgtccaaccgtacaactcgctcttgactttgaagcggctgacactgaatgccgactgtgtggttgttcttgacaatacggctcttaataggattgccgtggagcgtcttcatctatcaaatcctacttttgcacagacaaactctttggtctccacagttatgtctgcaagcacaactactttgaggtaccctggatatatgaacaatgacctagttggtcttcttgcctccttgatccccacaccaaggtgtcattttctgatgacaggttacactccattgaccattgaacggcaggttaacatgatacgcaaaacgacggtactagatgttatgagaagacttctgcagacaaagaatataatggtgtcatcatatgctcgaacaaaggaagccagccaggctaaatacatttccatacttaatatcattcaaggagaggtggaccctacacaggtccatgagagtctgcaaaggatacgtgaaaggaaacttgttaacttcatagattgggcccccgcaagcattcaggttgccttgtcaagaaaatccccgtatgttcaaacaacacacagggttagtggtttgatgttagcaaatcatactagtatacgtcacttattcagcaaatgcctgggacaatatgagaagctaaggaaaaagcaagcctttcttgacaactaccggaagtttcctatgtttgcggacaatgatctctctgaattcgatgaatctcgagaaataatagagagtctagttgatgagtacaaggcttgtgaatcaccagattacattaaatggggaatggaggatactggagaggcaaatgtcgcggccgcactggattctaagttagtggtgtaaatatcaaggtcctgctggttacccaaagattccactgtagctgtccggtagttatcagttcgatgctgcctgctcatctagatctaatcggagtgctaccagagcgggtcacgctcttctttgcaatcttgaagttcgcttccttttttttttcttgtgtgtgtgtggctatgtacatgtcgaaacccacttcctctgatctgtgctgttccatggtcttgttct

SEQ ID NO: 17465 - protein, 469 aa, Panicum virgatum
  misc_feature: Ceres CLONE 1792423
  misc_feature (46)..(247): Pfam Name: Tubulin Pfam Description: Tubulin/FtsZ family, GTPase domain
  misc_feature (249)..(395): Pfam Name: Tubulin_C Pfam Description: Tubulin/FtsZ family, C-terminal domain
MPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTIERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDTGEANVAAALDSKLVV

SEQ ID NO: 17466 - DNA, 1792 bp, Panicum virgatum
  misc_feature: Ceres CLONE 1792426
  misc_feature: Encodes the peptide sequence at SEQ ID NO. 17467
agcgcaaacccctcttcctcttcctcttcttcgcctcgactcctcgcgccgtcccccagatctcgaggtcgggcggcgccggcggggggacgggatggggctgatctccgggatggtgatgggggtgctggtcggcgtggccgtcatggccggctagagccgcgtcatgctccgccgcagcaggaagcgcgtcgccaagaccgcggacatcaaggtgctcgggtcgctcggcagggacgacctcaggaagctgtgcggcgacaacttccccgagtggatatccttccctcagtttgagcaggtgaaatggctgaacaagcatttaagcaaactttggccatttgttgcagaagctgcaacagcagtggttaaggagtctgttgaaccactgctagatgattaccggcctccaggaataaaatctctgaagttcagcaaattttctcttggaactgtgtcaccaaaaatagaaggtattcgtattcaaaatcttcagccaggccaaatcataatggatatagatttccgttggggtggcgatccaagcataatcctagctgttgatgctgtagttgcatcactacctattcagctcaaggatcttcaggtctatactgtcatacgtgtcgtgtttcaactgtcagaagagattccttgcatatctgctgttgtcgtggctctccttgctgatccagagccaaaaattcagtacaccctgaaggccgttggaggaagcctaaccgcagttcctggactttctgacatgattgatgatactgtcaactcaattgtttctgatatgctccagtggccacacaggctagttgttccacttggtgttaatgttgatacaagtgacctggagcttaaacctcaaggaagactttctgttactgtggtaaaagcaacttctttgaaaaacaaggagttgattggtaaatcagatccttacgtgagactgtatgtgcgaccaatgtttaaagtcaaaacaaaagtcatagatgacaacctgaatccagaatggaatgaaacatttgagctgattgtcgaagacaaagaaacccaatctgtcattcttgaggtttacgatgaagacaaacttcagcaagacaaaagacttggtgtggctaaactagcattgaacaatcttgaacctgagatcacccgtgaagtcactctgaagctgctgcattcagtagatccacttaaaaatagggataccaaggatagaggcacattgcatcttaaggtcatgtatcatccgtttacaaaagaagagcaatttgaagccctagaggcggaaaagtgggccatagaggagaggaagcgtctgaaggaggctgggataattggtagcacaatggatgctgttggtggcgctgcatcactagttggttctggtattggtgctagcgtcgggcttgttggctctggtattggtgctggcgtcgggcttgtaggcgcagtcggcagtggcctcggtaaagccgggaagttcatgggcaagactgtggcagggcctttcagcatgtcccgcaagaacggcagcagctctgctgcgccccagcctgatcaaccctctgcgtagtctgatgtacagtgaaagacgattcccatttatcacagggttaccgttatatgaaatatctgctggtttattttgttcgttgtaatggagcttttatagtaaagattactgtaaattggatcgctttgagagattgatgtaacaacgccgtcgtattgaaatttaagaaaagtctatgatgtgccagtatgatattaatctgtt

SEQ ID NO: 17467 - protein, 473 aa, Panicum virgatum
  misc_feature: Ceres CLONE 1792426
  misc_feature (240)..(322): Pfam Name: C2 Pfam Description: C2 domain
  misc_feature: SWISSPROT Homolog: EC 3.1.1.4 Phospholipase A(2)
MLRRSRKRVAKTADIKVLGSLGRDDLRKLCGDNFPEWISFPQFEQVKWLNKHLSKLWPFVAEAATAVVKESVEPLLDDYRPPGIKSLKFSKFSLGTVSPKIEGIRIQNLQPGQIIMDIDFRWGGDPSIILAVDAVVASLPIQLKDLQVYTVIRVVFQLSEEIPCISAVVVALLADPEPKIQYTLKAVGGSLTAVPGLSDMIDDTVNSIVSDMLQWPHRLVVPLGVNVDTSDLELKPQGRLSVTVVKATSLKNKELIGKSDPYVRLYVRPMFKVKTKVIDDNLNPEWNETFELIVEDKETQSVILEVYDEDKLQQDKRLGVAKLALNNLEPEITREVTLKLLHSVDPLKNRDTKDRGTLHLKVMYHPFTKEEQFEALEAEKWAIEERKRLKEAGIIGSTMDAVGGAASLVGSGIGASVGLVGSGIGAGVGLVGAVGSGLGKAGKFMGKTVAGPFSMSRKNGSSSAAPQPDQPSA

SEQ ID NO: 17468 - DNA, 715 bp, Panicum virgatum
  misc_feature: Ceres CLONE 1792435
  misc_feature: Encodes the peptide sequence at SEQ ID NO. 17469
agtactcccaactgaagccagatcaaatctggaggagaaagaaaaacgccaagccggcggcgaagttgacgtcgctccccccatcacgtcaagcaaccgaaggttacagatctagctgtcaagatggtgaagatctgctgcatcggtgctggctatgtcggtggcccgaccatggccgtcattgccctcaagtgcccagacattgaggtcgtcgtcgttgacatctccaagccccgcattgaggcctggaacagtgacaccctccccatctacgagcctggtctcgatgatgttgtgaagcagtgcaggggcaagaacctcttcttcagcactgatgttgagaagcacgtcgctgaggctgacatcatctttgtctcggtgaacacccccaccaagacccgtggtcttggagctggcaaggctgccgacctcacctactgggagagtgctgctcgcatgatcgctgatgtctccaagtctgacaagatcgttgttgagaagtccactgtccctgtcaagactgctgaggctattgagaagatcttgacccacaacagcaagggcatcaactaccagatcctctccaacccggagttccttgcagagggcactgctattgaggacctgttcaagcctgacagagtgctcattggtggccaggagacccctgagggcaggaaggctgtccaggccctcaaggatgtgtacgctcact

SEQ ID NO: 17469 - protein, 197 aa, Panicum virgatum
  misc_feature: Ceres CLONE 1792435
  misc_feature (2)..(197): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
MVKICCIGAGYVGGPTMAVIALKCPDIEVVVVDISKPRIEAWNSDTLPIYEPGLDDVVKQCRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGQETPEGRKAVQALKDVYAH

SEQ ID NO: 17470 - DNA, 1791 bp, Panicum virgatum
  misc_feature: Ceres CLONE 1792454
  misc_feature: Encodes the peptide sequence at SEQ ID NO. 17471
actccttttcagtttcgcttgctccagcctccagaagcctcacaactactcgccagcaatccggtccctcccccagaaactgaatctcaagaggagcgtagttgcagcagaaatccggaagttatcgagccaaatttggtattgttccgctcaaattgccttcctttcgctgtaggcaaaattccaattttctcctgtattcttgtgggccatgtctctgtacgacgggctcgccggagtttatccggaagaggagcaagaccgacacgccgtccagatgggtgactcagactacgaggacgatgagccggaccaacctacttgtgaggcgacagaagacacaacccctatggatgtcaagaaagggaaggatatacaagggattccatgggacaggatgaacactacaagagacaggtacaggcaggcaaggttgcagcagtatgccaattttgagaacatacctaattccggaagaaactcggagaaggaatgcacacctgtagagaaaggccaactctactacgagtttcagcacaacacaagatcggtgaaatcaaccattcttcatttccagttgagaaatttagtatgggcaacgacaaagcatgatgtgtatcttatgtcatactattctgtgcttcattggtcagcattgactcgtgagaagcaagaaatcattgatcttcaggggcatgtcgcaccatgtgagaagcaccatggaaatttctctgagggattttatcatactcaagtcagtactttggcagtgaaaaacaacttgcttgttactggtggatttcgtggcgaaataatatgcaagtttttggatcgtcgaggaataagctattgttgtaaatcaacaaatgatgacaatggtataactaattctttggagatattcgagaaacctagtggttctctgcacttcttggcctcaaacaatgattgcggacttagagactttgacattgaaaagtttcaaatctgcaacaacttccgatttgcttggcctgtgaatcatacatcactgagtcctgatggcaaacttgctgtgattgtgggggacaatcctgatggacttctggttgatgctaattcaggaaaaacggttcatgatctccgtggccatttggattactccttcgcatcagcatggaacccagatggccgaacattcgccactggaaaccaagacaagacatgcagggtatgggacatcaggaatctctccaaatcaattgctgtactgggtggcaatattggagccatcaggtcaattcgctacacatccgatggaaagttcttggcgatggcagagcctgcagatttcatccacatctttgatgttgatagtgggtacagcagggagcaggaactggatttctttggtgagatcgcaggcatatcattcagtcctgacactgaatctctctttgtcggggtgcatgatcgcgcatacagcagcctcctccagttcagccgccgacgattctactcgtaccttgacacagccctgtgaagttgctgccggcagggatctgtgagtgagatccagataacaggatgtaggaaatagaaaggggtgtatatgtgtatatgtatgtaggtgttgctctgaagaaagccgaagtgcggcgcatttacttttgcggaacaaggtgtagatattcagctagccatgtttctttgctgaaaaaagctgtagatattcagcgagccatctcttcggagatttgtactgtttctgctgctgtaacgttgttgtatataaggggctacttgatcacc

SEQ ID NO: 17471 - protein, 436 aa, Panicum virgatum
  misc_feature: Ceres CLONE 1792454
  misc_feature (298)..(336): Pfam Name: WD40 Pfam Description: WD domain, G-beta repeat
  misc_feature: SWISSPROT Homolog: EC 2.3.1.48 Histone acetyltransferase
MSLYDGLAGVYPEEEQDRHAVQMGDSDYEDDEPDQPTCEATEDTTPMDVKKGKDIQGIPWDRMNTTRDRYRQARLQQYANFENIPNSGRNSEKECTPVEKGQLYYEFQHNTRSVKSTILHFQLRNLVWATTKHDVYLMSYYSVLHWSALTREKQEIIDLQGHVAPCEKHHGNFSEGFYHTQVSTLAVKNNLLVTGGFRGEIICKFLDRRGISYCCKSTNDDNGITNSLEIFEKPSGSLHFLASNNDCGLRDFDIEKFQICNNFRFAWPVNHTSLSPDGKLAVIVGDNPDGLLVDANSGKTVHDLRGHLDYSFASAWNPDGRTFATGNQDKTCRVWDIRNLSKSIAVLGGNIGAIRSIRYTSDGKFLAMAEPADFIHIFDVDSGYSREQELDFFGEIAGISFSPDTESLFVGVHDRAYSSLLQFSRRRFYSYLDTAL

SEQ ID NO: 17472 - DNA, 1239 bp, Panicum virgatum
  misc_feature: Ceres CLONE 1792472
  misc_feature: Encodes the peptide sequence at SEQ ID NO. 17473
aaaaaaaaaaaaaaatcttcaccacccgcaccacgcctagccgttgcgtagcgcgcctcctcgtcgtcttcctcccccgcactgtgtcgcttggcttgctcgaggtgtgttgcttctgcgcgcactcctccacttgccgagatagcttgctgccggctggcgggcaggaggacgggaggaaggaggagcaggataagcctccgcactgtgcggatagggctcggatcagaggagaggtgtggtggaggagcgtgtgctgacgtcaaggaacagtgcggcgggttgctgattgggagtgggacgccgtcgctttcgatcgaccgggtccccccccccccctggctagcgccagcacgtccggaggcgcctcgtcccgctccttcgccggcacaggatggcgctgctcacggcgccggcggtggccgcgctgctgctgctcttctggtccgcggcgtacggtgacgcccagctgccgtacaaggaccccagcctgcccgtgaaggcccgcgtcaaggacctcctcggccggatgacgctcgccgagaagatcgggcagatgacgcagatcgagcggaaggtcgcgtcgccgcaggtgctcaaggacaacttcatcggcagcctgctcagcggcggcgggagcgtgccgcggctgcaggcgacggcggcggagtgggtgagcatgatcagcgacttccagaaggcgtgcctgtccacgcggctgggcatcccgatgatctacggcatcgacgccgtccacggccacaacaatgtctacggcgcaaccatcttccctcacaatgtcgcgctcggagccaccagggatcctgatctggtgaagaggatcggtgccgcgaccgcgctcgaagtgcgagccaccggcatccagtacgcgttcgcgccatgcattgcggtgtgccgtgatccgagatgggggcggtgctacgagagctacagcgaggaccacaagatcgtgcaggccatgacggagctcatcccgggcctgcagggcgacgttccgcagaacttcaccagcggcatgccctacgttgccggacagaacaaggtggcagcgtgtgccaagcatttcgtcggcgacggcggcacgcacgacggcatcaacgagaacaacaccatcatcgacaagcagggcctgatgagcatccacatgcccgcctacctggactcgctccggaagggcgtctccacggtcatgatctcctactccagctggaatgggat

SEQ ID NO: 17473 - protein, 281 aa, Panicum virgatum
  misc_feature: Ceres CLONE 1792472
  misc_feature (103)..(281): Pfam Name: Glyco_hydro_3 Pfam Description: Glycosyl hydrolase family 3 N terminal domain
  misc_feature: SWISSPROT Homolog: EC 3.2.1.21 Beta-glucosidase
MALLTAPAVAALLLLFWSAAYGDAQLPYKDPSLPVKARVKDLLGRMTLAEKIGQMTQIERKVASPQVLKDNFIGSLLSGGGSVPRLQATAAEWVSMISDFQKACLSTRLGIPMIYGIDAVHGHNNVYGATIFPHNVALGATRDPDLVKRIGAATALEVRATGIQYAFAPCIAVCRDPRWGRCYESYSEDHKIVQAMTELIPGLQGDVPQNFTSGMPYVAGQNKVAACAKHFVGDGGTHDGINENNTIIDKQGLMSIHMPAYLDSLRKGVSTVMISYSSWNG

SEQ ID NO: 17474 - DNA, 656 bp, Panicum virgatum
  misc_feature: Ceres CLONE 1792472-R
  misc_feature: Encodes the peptide sequence at SEQ ID NO. 17475
acctgggctaccagtgcggcgggtggaccatcgagtggcagggcgacacggggcgcatcaccgtcggcaccacgatccttgacgccgtgaaggccgccgtggacccgtcgacgacggtggtgttcgcggagaaccccgacgccgacttcgtcaggaacggcggcttctcgtacgccatcgtggccgtgggcgagcacccgtacacggagacccagggcgacagcatgaacctgacgatcccggacccggggccgagcaccatccagacggtgtgcggcgccgtgcggtgcgcgaccgtgctcatcagcggccgccccgtggtgatccagccgttcctggccgccacggacgcgctcgtcgccgcctggctgccgggaaccgagggccagggcgtcaccgacgtgctgttcggcgactacggcttcaccgggaagctgccgcggacgtggttcaagtcggtggaccagctgcccatgaacgtgggcgacgcgcattacgacccgctcttcccgttcggcttcgggctcaccacaaagggcaatgcgtactagaaggggattggtggtagcctgtagtgataggaaaattgaatttttaaacagtgctcagctcacactgtggagtagcatccactagatgagcggtctcattcttat

SEQ ID NO: 17475 - protein, 182 aa, Panicum virgatum
  misc_feature: Ceres CLONE 1792472-R
  misc_feature (13)..(179): Pfam Name: Glyco_hydro_3_C Pfam Description: Glycosyl hydrolase family 3 C terminal domain
  misc_feature: SWISSPROT Homolog: EC 3.2.1.21 Beta-glucosidase
LGYQCGGWTIEWQGDTGRITVGTTILDAVKAAVDPSTTVVFAENPDADFVRNGGFSYAIVAVGEHPYTETQGDSMNLTIPDPGPSTIQTVCGAVRCATVLISGRPVVIQPFLAATDALVAAWLPGTEGQGVTDVLFGDYGFTGKLPRTWFKSVDQLPMNVGDAHYDPLFPFGFGLTTKGNAY

SEQ ID NO: 17476 - DNA, 529 bp, Panicum virgatum
  misc_feature: Ceres CLONE 1792475
  misc_feature: Encodes the peptide sequence at SEQ ID NO. 17477
acacagtcccggcagcacgcactgccctttagttgtagcaacaaaagaaaatgccgcggcgaactcgagtgctgctcgttctcgccttcgctgccgcgttgctgcttgccagcggcggcgccgctccagaggtcggaggactctcggctgaggcgatgccggccctgcgcgcgagcagcttcgtgctggagggcgaggaggaggtggcgtacccgcggaggagggcgctgtacagcggcgggttcatcgactacggcgctcttaccgcgagcaaggccgcctgctatggcccgtgccccgcccgcgggcagccctacagcagcggctgccaggccatataccagtgccgcggttaagcagcgctgcagtcagtcgatttgtacgtttcttgcgtatgttgaggcgcggttatttgatctaggtgtcagcctcttatgttccttttccatttaatattgttgtgaaaagagttcactactcagtaagaacaattattcatagtttgatttagattaactttttccatagc

SEQ ID NO: 17477 - protein, 101 aa, Panicum virgatum
  misc_feature: Ceres CLONE 1792475
  misc_feature (46)..(101): Pfam Name: RALF Pfam Description: Rapid ALkalinization Factor (RALF)
MPRRTRVLLVLAFAAALLLASGGAAPEVGGLSAEAMPALRASSFVLEGEEEVAYPRRRALYSGGFIDYGALTASKAACYGPCPARGQPYSSGCQAIYQCRG

SEQ ID NO: 17478 - DNA, 572 bp, Panicum virgatum
  misc_feature: Ceres CLONE 1792479
  misc_feature: Encodes the peptide sequence at SEQ ID NO. 17479
atttcccgtcgccgagacagtatcggtcagacccgagctcccagaacgcgagaacacctaggcctggtagtctcgacggagcagacgccagaggaagccgtgccagcgttcatggtcgccgcccggccgccccgggctctccccctcctcctcctgctgctctgcgccgacttctccttccacgtggaagcggcgcacggggcgagtggcggcgcccacgggctcggcgtcaactacggccgggtggtggacgacatcccctagccgcgggggtccgtggagctcctccgcgcggttggcgccgggtacgtcaagatttacgaggcccagccgggcctgctccgcgcgctggagggcacgcgctggcccgtctccatcatggtgcccagcgacatcatcccggacatcggcgcctcgcccgccgccgcggaccgctgggtcctcgacaaactggtcccctactacccggcgagcctggtctagttcctggtcatggggaactgaaatcctctatgagtactccatcgacaactccatgtgggagcgtcttgtcacggcgatggataacatcc

SEQ ID NO: 17479 - protein, 34 aa, Panicum virgatum
  misc_feature: Ceres CLONE 1792479
  misc_feature: Functional homolog of the protein sequence given in SEQ ID NO 50518
  misc_feature: Useful for making plants with altered carbohydrate content
MVPSDIIPDIGASPAAADRWVLDKLVPYYPASLV

SEQ ID NO: 17480 - DNA, 1546 bp, Panicum virgatum
  misc_feature: Ceres CLONE 1792481
  misc_feature: Encodes the peptide sequence at SEQ ID NO. 17481
aaccaccgcgaaactctgcacatcgatcgagcgcacccaaagcacggccatggcgcgccatcttcgccgcctcctgctccttctcctcgccaccgtcgtcgcggcggcggcccccgccctcgccatcttccatttcgacttccgcttcgacaccgacggcccatactctggcggcatgctgtcccggcacgacatgtggcggcggcgcgccgccgagagcagagcccgggacgccgggaactcggccaggctcgccaaggccctcggcaaggacggcgacatcacggcggccgacgtgaccgtcaccccctacacccaccagggccactggctgaccgtcggcgtcggcacgccgccgcagcccagcaaggtgatcctcgacatgggcagcgacctcctgtggacgcagtgcagcctggtgggccccacggcggtgcaggaagagccggtgtacgacccctccaggtcgtcgtccttctccctcctcccctgcggcagcaagcagtgcgaggagggcgccttcaccagcaagaactgcaccgacaagaggtgcgcgtacgagaactactacggcgtcctgacggcgaccggcgtcctcgccaccgagacgttcaccttcggcgcgcaccgcaacgccaccgtcaacctcaccttcggctgcggcaagctcaccaacggcaccatcgccggcgcctccggcatcctgggcctctccccgggccccctgtcgctgctgaagcagctggccatacccaagttctcctactgcctcacccccttcgccgatcacaagacgagcccggtcatgttcggcgccatggccgacctcggcaagtacaagacgacgggcaaggtgcagacggtcccgctgctgaagaaccccgtggaggacatctactactacgtgcccatggtggggatctccctcgggagcaagcggctggacgtgccggccgagagcctggcgctgaagcccgacggcaccggcggcacggccgtggactcggcgaccacgctggcgtacctcgtggagccggccttcacggagctgaagaaggccgtgatggaggggctgaagctgccggtggcgaacaagaccgtcgacgactacccgctgtgcttcgagctgccgcgcggcgggtccatggacggcgtggaggtgccgccgctggtgctgcacttcgacggcggcgccgtgatggtgctgccgcgggacaactacttccaggacccgagccccggggtgatgtgcctggcggtggtccagtcgccgttcaaaggcgcgccgtcggtcatcggcaacgtgcagcagcagaacatgcatgtgctctacgatttgggggaacgcaagttctcctacgcgcccacgcaatgtgacaagctctgaggtgctatgtatgcaaataaatctacaacgatgatgatcttcagatttcagtggcaaaaatataacttttattttttattgtctaatgatgatgaaaccctttttgtaggacagtttgttgtatccaatgtataaaatcaataatgagggttgcctgtt

SEQ ID NO: 17481 - protein, 445 aa, Panicum virgatum
  misc_feature: Ceres CLONE 1792481
  misc_feature (96)..(440): Pfam Name: Asp Pfam Description: Eukaryotic aspartyl protease
  misc_feature: SWISSPROT Homolog: EC 3.4.23.12 Nepenthesin
MARHLRRLLLLLLATVVAAAAPALAIFHFDFRFDTDGPYSGGMLSRHDMWRRRAAESRARDAGNSARLAKALGKDGDITAADVTVTPYTHQGHWLTVGVGTPPQPSKVILDMGSDLLWTQCSLVGPTAVQEEPVYDPSRSSSFSLLPCGSKQCEEGAFTSKNCTDKRCAYENYYGVLTATGVLATETFTFGAHRNATVNLTFGCGKLTNGTIAGASGILGLSPGPLSLLKQLAIPKFSYCLTPFADHKTSPVMFGAMADLGKYKTTGKVQTVPLLKNPVEDIYYYVPMVGISLGSKRLDVPAESLALKPDGTGGTAVDSATTLAYLVEPAFTELKKAVMEGLKLPVANKTVDDYPLCFELPRGGSMDGVEVPPLVLHFDGGAVMVLPRDNYFQDPSPGVMCLAVVQSPFKGAPSVIGNVQQQNMHVLYDLGERKFSYAPTQCDKL

SEQ ID NO: 17482 - DNA, 845 bp, Panicum virgatum
  misc_feature: Ceres CLONE 1792484-R
  misc_feature: Encodes the peptide sequence at SEQ ID NO. 17483
gaaacttgctgtaggaatcagagcacgggccccgtgcgaccgccgacggcgaagccacacccacacgcaacgagcacgagcggcagcggcagcagcaatctccaccactcggctactacggcggcgccggcgatacccgaggcaggcgcgacgccagcggcgtcgtgggcgctgcagcgggaggtgttctcgaagccgacgaacgcgggaggcgcggcccggcggcggcggttcggctggagcctgctggggcggcgcaggccggcggcggcgtcggaggcggaggcggaggcgtcggagtgcgcggtgtgcctggaggagctccgggcgggggacgtgctggtgcacctgccctgcgcgcaccgcttccactggtcctgtggcgtgccctgggtccaggccgcctcgcgctgccccgtctgccgcgccctggtccacctcgcctcctgccctccccccaactgaccgacctgccgcgggatggcttggagtcttctcttcttcggccggacggagcaacgcgggaccgcgccgccgtgcgtggcagacccaagccatggacacgggcggatggcattggcaggcaggctgcgggtgaccgtgcgtgcgcgagatgcctcgtgtcgaggacaccgcagagtgggggtggggatcactggatcagagtcggatgatggtgcacggcgagacggagcactgaatcgatgagcgcatggagcgctgcgatcgcacggggcatcagtttcatggagccatgcgctgattagttttgcacagctgctcacgacgctggttatcccaaatctgtgtagtattcatctaaaaaaaactgtctagttacggtc

SEQ ID NO: 17483 - protein, 154 aa, Panicum virgatum
  misc_feature: Ceres CLONE 1792484-R
  misc_feature (101)..(141): Pfam Name: zf-C3HC4 Pfam Description: Zinc finger, C3HC4 type (RING finger)
ETCCRNQSTGPVRPPTAKPHPHATSTSGSGSSNLHHSATTAAPAIPEAGATPAASWALQREVFSKPTNAGGAARRRRFGWSLLGRRRPAAASEAEAEASECAVCLEELRAGDVLVHLPCAHRFHWSCGVPWVQAASRCPVCRALVHLASCPPPN

SEQ ID NO: 17484 - DNA, 1454 bp, Panicum virgatum
  misc_feature: Ceres CLONE 1792484
agaggtagaggtagaggttggtagttgggccattggcatttggcacgccatcagcatgagctctcctcctccttcctaagttcctcctcctcctcctcctcctccctatagatagaaagctgctgctccccgtccaaaggagatgaggctcatgactggtcgtcggagatggccggcttcgtcctcgtcctcttcctgctccggatggagggcttccacatacaccaatcgctcctagcgcctcctccgaatcccgtgtctcggggtcgtcgagcagtgcatgcgacacccgacacaatcacagggctaggtagctagcaagcatacatagcttgtggggagcgaggtcgttgcaggcggcgtcttgttgtcatcgctcgcatcgcagctgtcacgtttgtggtgcctctttgagttcgacggtggatggtcatcatggccgggatgctccccggcgtggagtgcgcgcggcggcggcggctccggcagggcaggtcgtcgtccggcgcggcggaggcgccgtgcgggacgcggcggccgtccttctgcctgtacgccggcggccacgaccacgcccaccttggctcggcggcggcctccaaggagaggagcagcagcagcgtgtgcaaggagatgatggcgcgcgcgtggacgctggacaccaacgcccgggaagcaaaggagaggctggaccagaagctcagggggcagagagaatcactggtcaagaggtgtgttgctgctgcagttcttgtctgtgcttccttcagagagaatctatgatgtagctcgctgtacggttcttcagagccccagcatttccacttctagttctagctgaggttcagaatccataggtccctcctgcttggtttatcctgagtttgcagtttgcagcaatgatgatttcctagtctatatagaggctgttcggttcaggaaatacgaaagatagattgttaacatccaatcttgagtggtatttccttttgcagcaacgtgcctgctggatacctttgtatgggaatctagttccatgcctagagaactactgtttcagatgcagagtatccattcagggtcctgtttcagcgctgaaattcgagtgcttgctctggtcccatcatctttatactctgcaaacagtctaaggccgtgtttagttcatctcccaagaatttttgggaatggaatcttgctatttaaaagtactaaatgaagtctatttataaaactttttgcatggatgagttgtaaatcgcgagacgaatctaatgagcctatttaatctataattagagattatttactgtagcacgccattatccaatcatggtctaataagcttaaaagattcgtctcgaaattacacccggggttatggaatgagttttcagttatttacatttaagacctctaattaatagtcaaatattcgaaattactgtagtgct

SEQ ID NO: 17485 - DNA, 758 bp, Panicum virgatum
  misc_feature: Ceres CLONE 1792488
  misc_feature: Encodes the peptide sequence at SEQ ID NO. 17486
actacgtgcacccggcacgcccagcgcttgtgaccaacccgcccaccttccagtcctcccagtccaacacctcgcacgcccaggtctcaaccctctccctcgccatcgccatcgccatggcgcgcaagaagatccgggagtacgactccaagcgcctcctcaaggagaacctcaagcgcctcgccggcatcgacctcaccatcctctccgcccagatcacacaatcaacagacttcgcagagcttgtgagccagcagccatggctgtcaaccacaaagttggtcgtgaagcctgatatgctgtttgggaagcgtggcaagagtggcctggtggccctcaaccttgattttgatcaagtcaaggagttcgtcaaggagcgattgggagtcgaggttgagatgggtggctgcaaggctccaattacaaccttcattgttgagccatttgtgccccacgatcaagagtattacttatcgattgtgtcagagaggctgggcagcacaatcagcttctcagagtgtggagggattgagatcgaggagaactgggacaaggttaagatggtttttcttccaactgagaagccaatgacaccagatgcatgtgctcccttgattgctacccttccactggaggcacgcggaaaaattggtgacttcatcgaaggagtgtttgctgtattccaagacctggacttctcatttatggagatgaacccatttaccatggtgaatggagagccatatcctctggacatg

SEQ ID NO: 17486 - protein, 213 aa, Panicum virgatum
  misc_feature: Ceres CLONE 1792488
  misc_feature (5)..(204): Pfam Name: ATP-grasp_2 Pfam Description: ATP-grasp domain
  misc_feature: SWISSPROT Homolog: EC 2.3.3.8 ATP citrate synthase
  misc_feature: Functional homolog of the protein sequence given in SEQ ID NO 50168
  misc_feature: Useful for making plants with modulated root development
MARKKIREYDSKRLLKENLKRLAGIDLTILSAQITQSTDFAELVSQQPWLSTTKLVVKPDMLFGKRGKSGLVALNLDFDQVKEFVKERLGVEVEMGGCKAPITTFIVEPFVPHDQEYYLSIVSERLGSTISFSECGGIEIEENWDKVKMVFLPTEKPMTPDACAPLIATLPLEARGKIGDFIEGVFAVFQDLDFSFMEMNPFTMVNGEPYPLD

SEQ ID NO: 17487 - DNA, 666 bp, Panicum virgatum
  misc_feature: Ceres CLONE 1792488-R
  misc_feature: Encodes the peptide sequence at SEQ ID NO. 17488
ggaggtggtgctagtgtcatatacgctgatacagttggagatttggggtatgcttcagagcttggaaactatgcggagtatagtggtgctcccaatgaggaggaggttctgcattatgctagagttgtacttgattgtgcaactgctgatcccgatggtcgtaagagggcgcttctcattggaggtggcattgctaacttcactgatgtggctgccacattcaatggcatcatccgggccttaagagagaaggaatccaagttgaaggcttcaaggatgcacatttatgttcgccgaggtggcccgaattaccaatctggactggctaaaatgcgtaagcttggtgcagatctcggcattccaattgaggtgtatgggccagaagcgacaatgacaggaatctgcaaacaagcaattgaatgcatcatggctgcagcataattggagtgtagttctgggtagtttgggatctgcagacacgcaattgaatgtgtcatagactcggccataaatgaggggtggagagtagttgcagtagttcacacccacacaggggttgttccctttctgtttcagatatgttgtagcgtggagttgtttgacgatatctttctagatcattcctgcaaagagttgtgatgcaataaatccgaggtctagtttcgt

SEQ ID NO: 17488 - protein, 146 aa, Panicum virgatum
  misc_feature: Ceres CLONE 1792488-R
  misc_feature: SWISSPROT Homolog: EC 2.3.3.8 ATP citrate synthase
  misc_feature: Functional homolog of the protein sequence given in SEQ ID NO 50168
  misc_feature: Useful for making plants with modulated root development
GGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQSGLAKMRKLGADLGIPIEVYGPEATMTGICKQAIECIMAAA

SEQ ID NO: 17489 - DNA, 2681 bp, Panicum virgatum
  misc_feature: Ceres CLONE 1792491
  misc_feature: Encodes the peptide sequence at SEQ ID NO. 17490
gatcctcgatcgcattgtctgtcctcgcctgccaaacatttgggtagagggccgcaaattaaaagcaggcgcgcagcttcatgatcagcagaggctagcttctcaggttccaatttcttgattcatctcgcatcgcagccatggatcccgagttcggagtaggcacggcgccccgaaagagggagtcatggcggacgacgctgctgctggcgtaccagagcctcggggtggtgtacggcgacctcagcatctcgccactctacgtgtacaagagcaccttcgccgaggacatcaagcactcggacaccaacgaggagatcttcggcgccctctccttcgtcttctggacgctcaccctcatccccctcatcaagtacgtcaccgtcgtcctgcgcgccgacgacaacggcgaaggaggcactttcgcgctctactccctcatctgccgccacgccaatgttagcctcctccccaaccgccaggtcgccgacgaggagctctccacctacaagctcgagtacccgcccgaggtcgcccagaggtcacgcgtcaaggactggctggagaagcacaagaagctgcacaccgcgctgctcgtcatggtcatgatcggaacatgcatgatcatcggggacggcgtcctcacgccggcgatctcggtgttctcggctgtttcagggctcgagctctccttgtccaaagatcaacatgaatacgcgatcattcccataacctgtgccatattagtattcctgttcgctctgcagcattatggcacccaccgtgtaggattcctcttcgcgccgatcgttctgtcctggctgctctgcatgagcgctatcggcttgtacaacatcatccactggaaccctcatgtttaccgggcgctcaatccctcctacatgatcacattcctgaagaagaccaggaagtctggctggatgtcgctgggaggaattttgctatgcatgacaggatcggaagcaatgtttgcggatcttggccacttctcctacagcgcaatccaacttgctttcacttctttagtgtacccttcactgatattgggatacatgggtcaagctgcctatttgtccaaacaccataaccttgacgcaagctaccagattggattctacatcgcagttcccgagagtgtaaggtggcctgtgctagtgctggcgatattggcatcggttgtaggaagccaagcaatcatcagtggaaccttctccatcatcaaccagagccagtccctgagttgcttccccagggtgaaagttgtgcacacgtctgacaagattcatggccagatatacatccctgaggtcaactggatgctaatgatcctctgcattgcggtcaccgttggtttccgtaatacgaagcacatggggaatgcgtccggcttggccgtgatcacggtgatgctggtgacgacgtgcctcatgtccgtggtgatcatgctatgctggcaccggtcgcctctgctagccctggcattcttcctcttgttcggttcggtcgaggcgctctacttctcggcatcactgatcaagttcctggaaggtgcgtgggtgccgatcctcctctccctgatcctgctcgccgtcatgttcgtgtggcaccacgtgacgatcaggaaatacgagtacgacatgcacaacaaggtgaccctagagtggctcctcgctctcggcgacaagctgggcatggtccgcgtcccgggcatcggcctcgtctacaccgacctcacctccggcgtgccggccaacttctcccgcttcgtgaccaacctcccggcgttccaccgggtgctcgtcttcgtctgcgtcaagtccgtgccggtgccgcacgtgctccccgccgagcgctacctcgtcggccgcgtgggccccccggggcactgctcctaccggtgcatcgtgcggtacggctaccgcgacgtgcaccaggacgtggactcgttcgagacggagctcgtcgagagcctcgccacgttcatcaagctcgacgcgctgttccggtgcagcgacgccggcagggaggcgcgggacagcagctgcggctacgaaaacgagcgcgagaacgcgctcacagtcatcgggagcaacccactgcggcgccacctgcagctggggtacgacgagtcccacgacggcgtgtcgtcggcccacgagacgggcgtggacgggatcgagctcgcggcggcggcgccggcgatcaagaagcaggtgaggttcgcggcgaccccctgcaggagccccggcgtggacgagcgcgtgctggaggagctgcacgagctgtgcgaggcgcgggaggccggcacggcgttcatcctggggcactcgcacgtgcagaccaagcccgggtcgtcgctgctcaagaagctggccgtcggcgtcgggtacaacttcctgcggcggaactgccgcggcccggatgtggcgctgcgcgtgccgccggcgtcgctgctcgaggtcggcatagtctacgtgctgtgaggaacgtgacggcgatccatccgcgattgcgatctgtgcgtccggctttcagcgcgtctctctgccattgtattgtattgtgcacatctcgacttgctgatgtgaattgtagcgccatgcgatgccatgacatttttttctcgaatacgcaagagagttgcgcatctttgtagtatt

SEQ ID NO: 17490 - protein, 787 aa, Panicum virgatum
  misc_feature: Ceres CLONE 1792491
  misc_feature (22)..(787): Pfam Name: K_trans Pfam Description: K+ potassium transporter
  misc_feature: Functional homolog of the protein sequence given in SEQ ID NO 50430
  misc_feature: Useful for making plants with modulated biomass
MDPEFGVGTAPRKRESWRTTLLLAYQSLGVVYGDLSISPLYVYKSTFAEDIKHSDTNEEIFGALSFVFWTLTLIPLIKYVTVVLRADDNGEGGTFALYSLICRHANVSLLPNRQVADEELSTYKLEYPPEVAQRSRVKDWLEKHKKLHTALLVMVMIGTCMIIGDGVLTPAISVFSAVSGLELSLSKDQHEYAIIPITCAILVFLFALQHYGTHRVGFLFAPIVLSWLLCMSAIGLYNIIHWNPHVYRALNPSYMITFLKKTRKSGWMSLGGILLCMTGSEAMFADLGHFSYSAIQLAFTSLVYPSLILGYMGQAAYLSKHHNLDASYQIGFYIAVPESVRWPVLVLAILASVVGSQAIISGTFSIINQSQSLSCFPRVKVVHTSDKIHGQIYIPEVNWMLMILCIAVTVGFRNTKHMGNASGLAVITVMLVTTCLMSVVIMLCWHRSPLLALAFFLLFGSVEALYFSASLIKFLEGAWVPILLSLILLAVMFVWHHVTIRKYEYDMHNKVTLEWLLALGDKLGMVRVPGIGLVYTDLTSGVPANFSRFVTNLPAFHRVLVFVCVKSVPVPHVLPAERYLVGRVGPPGHCSYRCIVRYGYRDVHQDVDSFETELVESLATFIKLDALFRCSDAGREARDSSCGYENERENALTVIGSNPLRRHLQLGYDESHDGVSSAHETGVDGIELAAAAPAIKKQVRFAATPCRSPGVDERVLEELHELCEAREAGTAFILGHSHVQTKPGSSLLKKLAVGVGYNFLRRNCRGPDVALRVPPASLLEVGIVYVL

SEQ ID NO: 17491 - DNA, 1192 bp, Panicum virgatum
  misc_feature: Ceres CLONE 1792503
  misc_feature: Encodes the peptide sequence at SEQ ID NO. 17492
actcgcgcggcgccaccatggcctcctccgtcgcggcggctctccgcgccctcgccgccagcacctccgcctccctcgcgaagcccagcgccaccccgtcccccttcctcgtcctcctcgccccgaccccgccccgccgcccgctcggcctccgctccgcccgccgcctgccgctcgccccgctcgccgcctccgactccttcgagtcctccgtcggcgtcgactacgcggagccggcccccgccgagtccgagcgggagggggaggaagaggaggaggaggcgttcgcgtcgggggatgaggaggaggacgctgccgccgaggcgtccgcctccgccgaggaggccgcggacgaggaggaggtcggggagtacgtcgagccgcccgaggaggccaaggtctacgtcggcaacctgccctacgacgtcgacagcgagcgcctcgcgcagctcttcgagcaggctggtgtcgtcgaggtctcagaggtcatttacaacagagaaacagatcggagccgtggatttgggtttgtcactatgagtactgtcgaggaggctgagaaggctgtggagatgttccatcgctatgatgtcaatggaaggcttcttactgtaaataaagcagctcctagaggttctcgtgtggaaagacctcccagacaatttggcggtccttccttcaggatttatgtgggcaacctgccatggcaagtggatgactctagattggtgcagttgttcagcgagcatggtaaagtggttgatgccagagttgtctatgaccgagaatctgggcgttcgcggggatttggttttgtaactatggcaacacaggaggaattggatgatgctattgctgcccttgatggacagagtttggatggccgtgccctgcgggtgaatgttgcggaggagcgaccgcggcgaggtttctagtgaggatgtgtctgggtggacagcagacttgttccataggagcatcatagcgtggtctgatactggtttagaccctccattctcttttcttgtgttctgggctccctatcatcctgtcttattgtgaagaggaagtgttctctgctatttcattaactgttggttgtgttcatgagttcatgtattgtaggctactgttatggtgcacctagctcaatttgtcgttgcaattcaaaattttgtctgacatctgttcg

SEQ ID NO: 17492 - protein, 305 aa, Panicum virgatum
  misc_feature: Ceres CLONE 1792503
  misc_feature (223)..(294): Pfam Name: RRM_1 Pfam Description: RNA recognition motif. (a.k.a. RRM, RBD, or RNP domain)
  misc_feature (128)..(199): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASSVAAALRALAASTSASLAKPSATPSPFLVLLAPTPPRRPLGLRSARRLPLAPLAASDSFESSVGVDYAEPAPAESEREGEEEEEEAFASGDEEEDAAAEASASAEEAADEEEVGEYVEPPEEAKVYVGNLPYDVDSERLAQLFEQAGVVEVSEVIYNRETDRSRGFGFVTMSTVEEAEKAVEMFHRYDVNGRLLTVNKAAPRGSRVERPPRQFGGPSFRIYVGNLPWQVDDSRLVQLFSEHGKVVDARVVYDRESGRSRGFGFVTMATQEELDDAIAALDGQSLDGRALRVNVAEERPRRGF

SEQ ID NO: 17493 - DNA, 1906 bp, Panicum virgatum
  misc_feature: Ceres CLONE 1792521
  misc_feature: Encodes the peptide sequence at SEQ ID NO. 17494
aagaagcgtgagcacttacttatcgtctcctcctttcctcccccgcaaccccgatcgaatcgctcgaaccatccccaggtttgcgcgtcgatctaggtttgcgagaggatccaatttgatccccctcccgtttgagcttgtgatcctcgacggagttcttcgttagcctttttcccccgatttttttcgctcatttgttcgagcttttcaagagcagaataggcagtttcgaattccgatgcacccaggtctcaagatccaattgtgaggactttcccaagctctccgcgtcgatctgcacaagaagatgggtaacgcgggtagcaacggtggaggcgccgcccctggtcatcgccgtcggagctccggccacggccacggccaccaccaccaggcgcctcctcctcccccgccgcaggagactgcgcccaaccgctacgtgttcgcggcggccacgccgtacccgccccagtaccctaaccccaacccgccgcagtactacccgcagtacgggaactactacccgccgcccccgccgtccgtgccggtgcctctcccggcgccgtacgaccaccaccacaggccgcccaccgccgccggcggggagttccctcccccgcctccggcccacccccaccactaccctggttgggctgggcggtatccctcctacggaccgcatctgcctatgccgacgccctacgtcgagcaccagaaggccgtcactatccgcaatgatgtcaacctcaagaaggagacgcttcggattgagcctgatgaagagtgccctggccgcttcctcgtctccttcacctttgacgccacggtcgccggcagcatgactgtttacttctttgcaaaggaagagctcaactgcaatttagcagcagtgaaagaagaccttattaagccagttactgttagcttcaaaaagggtcttggtcaaaaattcaggcaaccttcagggacaggaatcgacttttcagtgtttaaggaatctgatttattaaagcagagggacatggatgtatatccacttgctgttaaagctgaaacagcatcagttgatcaaccattggaaggggaagaccaaaagacgaaaactcctaactcacagatcacacaggctgtgtttgagaagaaagaaaatggggagtatcaagtacgagttgtttgtcagatcctatgggtcaatgggactaggtatgaactgcaggaaatatatggaatagggaactccatggaaggtgatgctgatgcaaatgatccagggaaagaatgtgtcatttgcctctcagagccaagggatactactgttctcccttgtaggcatatgtgcatgtgcagtgagtgcgccaaggtcctacggtaccaaaccacccggtgccccatctgcaggcagccagttgagcgtctccttgagatcaaagtcaacaacaaaactgaagatcagcaacagacgccccaatcaccgccgctgccaccgccaaccccgcagcaggaagaggtgtacccatgattttaaaaaaaatatcagcgctcaaacactatatgggtctagtttgcagcctccgggctttccctgaatgttgctcttcccatttgagcaacgggggaatgtaatcgatactttacctttagcatatgtaagcttctggcatcgcatggctaggcccggtctccactgtatctggactctggaggtgggagaccgagatggtgccatgaagggtatgtgtaccatatacatcgtgcatgcgtgtgccgtggctacctgaagaagtgtagggaggactcatgccagatcggcttccccgtcagggaaagaaagggaagcgagggcggactctgaatttgtacaaaatgactgtatttcaccttgatgccaagtcttctttctagtgtt

SEQ ID NO: 17494 - protein, 276 aa, Panicum virgatum
  misc_feature: Ceres CLONE 1792521
  misc_feature (198)..(236): Pfam Name: zf-C3HC4 Pfam Description: Zinc finger, C3HC4 type (RING finger)
  misc_feature: Functional homolog of the protein sequence given in SEQ ID NO 50762
  misc_feature: Useful for biocontainment applications
  misc_feature: Functional homolog of the protein sequence given in SEQ ID NO 50763
  misc_feature: Useful for making plants with altered alkaloid content
  misc_feature: Useful for making plants with altered terpenoid content
  misc_feature: Functional homolog of the protein sequence given in SEQ ID NO 50764
  misc_feature: Useful for making plants with modulated nitrogen use efficiency
MPTPYVEHQKAVTIRNDVNLKKETLRIEPDEECPGRFLVSFTFDATVAGSMTVYFFAKEELNCNLAAVKEDLIKPVTVSFKKGLGQKFRQPSGTGIDFSVFKESDLLKQRDMDVYPLAVKAETASVDQPLEGEDQKTKTPNSQITQAVFEKKENGEYQVRVVCQILWVNGTRYELQEIYGIGNSMEGDADANDPGKECVICLSEPRDTTVLPCRHMCMCSECAKVLRYQTTRCPICRQPVERLLEIKVNNKTEDQQQTPQSPPLPPPTPQQEEVYP

SEQ ID NO: 17495 - DNA, 1528 bp, Panicum virgatum
  misc_feature: Ceres CLONE 1792525
  misc_feature: Encodes the peptide sequence at SEQ ID NO. 17496
atccgaggccgtcccgcaccgcactaccagccacctcccgcgccgcgccgccgccgccgtctcgcacgcgcggcagaggacgcgcgcgatcccctcccgcccaccaccagatcgcgccatggcctccacggccttcgccgccgccaagttcctcccggcccacctcgactcctccccgcgcatcgcgccacaccgcgccggccccaccgcgaatctctccttcgccccgctttcctcctctccctcctccgcggcgtcgctcctccgcctccgatccccgtcgccgtccggcccgggaggcaggctgcccccgcccccgcgctcgtacggcggcggcggatctggcgacgccgcggactccggcggcggcgacggccgccgcgggggcatcctcggcgtcttcctggccggctgggccgcccgcgtcgccgcggacccgcagttcccgttcaaggtgctcatggaggagctcgtcggcgtcaccgcctgcgtgctcggcgacatggcctcccgccccaacttcggcctcaacgagctcgacttcgtcttctccacccttgtcgtcggatccatcctcaacttcgtcctcatgtacctcctcgcgcccaccgccggcgtcgccgccgccgcctcgtccaccgcctccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgcgatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtcgcgccggcgccagtgttcaaggtgtccgtcgttgctctccgctgcgtgaacaacgtgcttggtggcatgtccttcgtgttgcttgccaggttgactggatcgcaaagatcagataaaccagcgacggctgcagaagagaaggaacggttgatagctgtgggcaatgccgccgcagatgccatcagtgaagcaaaggacgcagagggtaagtaaaggggatgggtagaggagggtgcaagtggatgcatgcatgctctgcgcctgagcttcgtttgcggcttcttggaataggccaagaaacctgtagatgataagtgggttggaataaggagtgaggctcaaaacattttcttcaatctgtttgcagtgatgacatgcttagttgatcttagaataaaagcagctgagcctgccaccaccacgccagcggcatggagcagaggaagggcggtgcgcgcgtgccccgggcggtgtccgtcctggcgggcctgctggagcgcgccgccgagcgcggcgacgccgctcccgcgtcgtcagcggcggcggcgttccggggccgggccctgccggcgatccccgtgcggcggt

SEQ ID NO: 17496 - protein, 344 aa, Panicum virgatum
  misc_feature: Ceres CLONE 1792525
  misc_feature: Functional homolog of the protein sequence given in SEQ ID NO 50526
  misc_feature: Useful for making plants with modulated biomass
MASTAFAAAKFLPAHLDSSPRIAPHRAGPTANLSFAPLSSSPSSAASLLRLRSPSPSGPGGRLPPPPRSYGGGGSGDAADSGGGDGRRGGILGVFLAGWAARVAADPQFPFKVLMEELVGVTACVLGDMASRPNFGLNELDFVFSTLVVGSILNFVLMYLLAPTAGVAAAASSTASALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSVVALRCVNNVLGGMSFVLLARLTGSQRSDKPATAAEEKERLIAVGNAAADAISEAKDAEGK

SEQ ID NO: 17497 - DNA, 278 bp, Panicum virgatum
  misc_feature: Ceres CLONE 1792525-R
gccgtggagatgatcgcccgatgacgacacgattctttcagttaatttgatttgttggttcctgtgtcctaggaggccttccctccagtttaggtttattttaagaaattgaactgcaaaatgtctggggggattttcgtaaaattggtagattgcgggggttatttggtaaatttggggtcgacggagtaccggtcgattactgaaaagttcaaggggtttttcataaaattgatggacttcataattattttaataaagtccagggttttttttcc

SEQ ID NO: 17498 - DNA, 3204 bp, Panicum virgatum
  misc_feature: Ceres CLONE 1792543
  misc_feature: Encodes the peptide sequence at SEQ ID NO. 17499
aacagccctacctctgctggctgtgcaggtgcggcagctgtattcgccgcaacctcctccttccttcccatccctccgcctccggctcacggattccttcacctcgcggaattctcctcgcctccaccaccgcctcggcctcccgcgaaccccctctgcgctagaagcttcctgggacgcggtccgaggcccggatccttggccccgaggcgggggcgcggtttgcgcgggggttcggagccggcgcgggagctgctctgattcgccgggggtgccgcggggaatgctctacctcaagctgccggcgggggatctagggttccgtccagggccggcgcggcggggatccggcggtggcggggcctgaggtggcgcgagcgggcgatccggccggggccggccatggctgcggcgacggcggcggccgcggtggagcaggaggccgaggccacatgcctgcagagcttcgagctctacgagagcgagtcgagactttatattctcggaactaactctgacaaaacactttggagattactcaagattgatagatcagagccatcagaacttgtgatagatgagtgttctactgtatatagtgacagtgaacatcatgacttgttgaaaggtcttgatgaagaacacaggtcaactggcggagtaaaatttgttacaaagttttacggcgtaattggtttcatcaagttccttgggccatattacatgctaattattaccgagcagaaaagaattggggagatctttgctcatccagtgtaccaggtgactaggactgcaatggttgaattagcaaattcaaagacaagatcaacctttcaaagctccaaggatgagaacagatacaagaagatcttgagcacacttgatcttaggaaggatttcttcttcagttattcataccacatcatgagaagtcttcagaagaacttgagtgacccacatcaggaaggatggaccttatatgagacaatgtttgtctggaacgagtttctaactcgtcggatccgtaactgtctcagaaatactttgtggaccgttgcactggtccatggtttctttaagcaggataaattctcaatatctgggaaggatatcatgctcacactcattgctagacgctcgaggcattatgctggaaccagatatttgaaaaggggggtgaatgagaagggcagagtagcaaatgacgttgaaactgagcaaattgtatatgaagctgtgcctggacctagtgaagtaagttctgttgtacagaaccggggttcaatcccactattctggtcacaggagacatcaaaattgaatcttaaacctaatataatattgcatgagatggacgatgattatgaagctaccaagcttcattttgaaaatcttagaacaagatatggaaaccctatcattatcttaaacttgattaagacacgtgagaggcgagagtctatacttcgccgtgaatttgataaggcaatcaagataataaataagagcttatcagaggaggatcatctgaggttcttacattgggatctccataaaaattctcaaggcaaacctacaaatgtgcttgatgttctgctgaaagtggcatttcgggctctgagtttaaccgagtttttttattgccaagttgcaccaagttcagagactgctgcacactggtccactctgttgagtggtcttgaaccatatttatgtgatgacaacagcaatagtgacaacacagagtgttatgatattgttggtgatatatctcaagaggatatctctggcagctctgattcctctggtaacgcaactgcagaagacaaagttgagaatagtgaactgcgaccactaaaaccaccaaaattccaaaaaggtgtcttgcggacaaactgtattgattgtttggatcgaacaaatgtcgctcagtatgcgtatggtttagctgctcttggacatcagctgcatgcgcttggtgctatagaatctccagagctagctttagaggctcccttggcccatcacttgatgcacttttatgagaggatgggtgacacacttgctgtacagtatagcggttcagctgctcacaacaagatattttctgcaaagagaggtcacttgaagctttttattcagtcacaagagttcttcaggacactacaacgacactacagcaacacctgtatagatgctaacaaacaggctgccataaacttatttttgggatacttccagccgcagcaggggaaacctgcactgtgggagctagaatcatcttccggggagcataacaatgaactttttgatgaccacacaagtacattgaaaagaataagatcagatggcagtattcttcatgaaagcggtgcttctatatctggctcgggtcattgctataatgaaccgttgactgcatcacagcctgatgttcagagtgggttacaagttccaaatttgaaatctcattcaattcatgaaaatgaagtttcatcaggctatgaaagtggggtatcacacctaaggtatactcccacagcctctgatatacttcatgtcccaagagctgatcctgacaatgattctggtgattcaaacttcctggatcttgaatggctctccacctcaggcaactcaagtgatgaaaggtctgttgcaactagcacgccagatgcgaacctatcgactgaaaatgtaattagtggcataactcctgaaatcatggaaaaccaagttgctgaaattcaggctcagaagttaccggacgattttgtgcagtgggttaatcacggggacactttttggtattaagattacgatgatgctgtctcatgtattcctggctacttggaagatccagcttctcttcctgggtagtcagtgaacggatccaagtaagagactaggagttgagaataagatggatggtacagcagttcagacatttcccctgtgatttatgcccttatcatcccagagtcctttagggaagtataacgtctgtttatttgttcacatctttttttttttactatgggcgagtaggtagatattttttctttttaaagaaaatagagataggtgtggtaattattattcatctggaattgtattattattcatgggacttgctattttcatgtgtaaatatatatgcttgaggtgtctatagtggaggtggagagcaaaccaccgctt

SEQ ID NO: 17499 - protein, 804 aa, Panicum virgatum
  misc_feature: Ceres CLONE 1792543
  misc_feature (93)..(396): Pfam Name: Syja_N Pfam Description: SacI homology domain
  misc_feature: SWISSPROT Homolog: EC 3.1.3.36 Phosphoinositide 5-phosphatase
MAAATAAAAVEQEAEATCLQSFELYESESRLYILGTNSDKTLWRLLKIDRSEPSELVIDECSTVYSDSEHHDLLKGLDEEHRSTGGVKFVTKFYGVIGFIKFLGPYYMLIITEQKRIGEIFAHPVYQVTRTAMVELANSKTRSTFQSSKDENRYKKILSTLDLRKDFFFSYSYHIMRSLQKNLSDPHQEGWTLYETMFVWNEFLTRRIRNCLRNTLWTVALVHGFFKQDKFSISGKDIMLTLIARRSRHYAGTRYLKRGVNEKGRVANDVETEQIVYEAVPGPSEVSSVVQNRGSIPLFWSQETSKLNLKPNIILHEMDDDYEATKLHFENLRTRYGNPIIILNLIKTRERRESILRREFDKAIKIINKSLSEEDHLRFLHWDLHKNSQGKPTNVLDVLLKVAFRALSLTEFFYCQVAPSSETAAHWSTLLSGLEPYLCDDNSNSDNTECYDIVGDISQEDISGSSDSSGNATAEDKVENSELRPLKPPKFQKGVLRTNCIDCLDRTNVAQYAYGLAALGHQLHALGAIESPELALEAPLAHHLMHFYERMGDTLAVQYSGSAAHNKIFSAKRGHLKLFIQSQEFFRTLQRHYSNTCIDANKQAAINLFLGYFQPQQGKPALWELESSSGEHNNELFDDHTSTLKRIRSDGSILHESGASISGSGHCYNEPLTASQPDVQSGLQVPNLKSHSIHENEVSSGYESGVSHLRYTPTASDILHVPRADPDNDSGDSNFLDLEWLSTSGNSSDERSVATSTPDANLSTENVISGITPEIMENQVAEIQAQKLPDDFVQWVNHGDTFWY

SEQ ID NO: 17500 - DNA, 2707 bp, Panicum virgatum
  misc_feature: Ceres CLONE 1792549
  misc_feature: Encodes the peptide sequence at SEQ ID NO. 17501
atcactcaatctacaaccattacgcatttctcatccccactctatcctacaagtgccgagttactcaatccgaataaattctcccgcatatctcccttccaaaaaaacaaagttctctcgagattttggatgcttttccctggaagacatttattcttccaaggcaaaatttcccaccaaaagctaatcgcgtctcccaggtagaggtagcgcatggccacccgtaaagattaggcgtcctaataattggcagcggaccgggcaatccatcgccattgccgcccctcgcgcagtcgcatcctccgtctcgccgcctgggggctgcacaattcgtcttcccgcacatatataaagcttctcgccctcctgagctcccacgccgagttctctcttcagaaagagagagaaagtgagagttccagcgaagcagccagccagccagccacgccttccttcttcctctcgcggattccgagctccagaccctccttcgtgggtggcgaagcggcgcaacggcggcggcggcgacagcgtgatcgccttcccggaagcgggaagcttgagttgagcggcggcgcgacgtacggccgccgatggggccaatggagccgcgctaccgttcccccgccggcgcccctgaggatacaactaagcgaaggacctctaaaagcaaaagcttcagagatgttgaaaattttgaagttcttgtccttgaaaagaactgtggttgcaagttcaaatctttgaagatcatgatcatagctatcatttctgcaacagttcttacccttataaccccaaccttgtatgagcaccaattgcagtcagcctcccggtatgtggatgtcggttggatgtgggacaaaacaagttctgacccgcgatatgcatcctctgttgatgttcagtgggatgatgtatatagagcattgagaaatctaaaaagtggtaatccagatctcaaagttggactcttgaattttaatagcactgagtatggctcttggacacagttgttgccggacagccatgtttccattataatacttgagaatgcccaggacatcattacttggcagacactgtatcctgaatggatcgatgaggaggaagaaacggagataccctcctgtccatctctcccagagcccaatgttcgaaaaggtgtacgctttgatgtcattgccgtgaagctgccttgtacccgtgttgcgggttggtcaagagacgttgcacggctccatttgcagctctcagcagcaaaattggctgtggcctcttcgaagcgcaatcacaaggtccatgtgctttttgtaagtgactgcttcccaattccgaatctcttcccgtgcaagaaccttgtgagacatgaaggcaatgcttggttatatagtcctgactcgaaagcattaagggaaaagctccggcttccagtcggatcttgtgagcttgctgttcctctcaaagcaaaatcgagacttttctcagtagatcgacgaagagaagcatatgcaacaatactgcattcagcaagtgagtatgtctgcggtgctatctcagcagctcaaagcattcgccaagcaggatcgactagggatctggtcatccttgttgacgagaccataagtgatcaccaccggagaggattggaatctgcagggtggaaggtcagaataatccaaagaatcaggaacccgaaagctgcgcgtgatgcttacaacgagtggaactacagcaagttcaggttgtggcagctgaccgactacgacaagatcatcttcatcgacgctgacctcctcatcctaaggaatgttgacttcctgttcgccatgccagagatcactgcgactagcaacaacgcaacgctcttcaactccggcgtcatgatcatagagccttccaactgcacgttccagctgctgatggaccacatcaacgagatcacgtcgtacaacggcggggaccaaggttacctgaacgagattttcacatggtggcaccgcatccccaagcacatgaacttcctgaagcacttctgggagggcgacagcgaggagatgaaggcgaagaagactcagctgttcggcgccgatcccccggtcctctacgttctccactacctcggcctgaagccatggctgtgcttcagggactatgactgcaactggaacaacccctcgatgcgcgaattcgctagtgatgtcgcgcacgcccggtggtggaaggtgcacgacaagatgccccgggagctccagtcctactgcctcctgaggtcacggcagaaggccgggctggagtgggaccggaggcaggctgagaaggccaactctgaagacggccattggcgccgcaacatcaccgactccaggctgaagacctgctttgagaagttctgcttctgggagagcatgctgtggcactggggcgagaacagtaacaggacgaagagcagccccgcgacggtgacgacgacggcgagcttggcgagctcatgatctgtagatatacaaacaacttcccatatggcaaccatatatacatgcatagctttagtttgtataggtaccaatgcttcttaggtctctgctatacaaaacacacccctccctgttgctgtcatggctgcagctcgatgtcagctgccggcctgcctcgatggctaacgattcttttgggttggctgagataataagttacttttacatgc

SEQ ID NO: 17501 - protein, 633 aa, Panicum virgatum
  misc_feature: Ceres CLONE 1792549
  misc_feature (307)..(519): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Functional homolog of the protein sequence given in SEQ ID NO 50565
  misc_feature: Useful for making plants with altered carbohydrate content
  misc_feature: Functional homolog of the protein sequence given in SEQ ID NO 50765
  misc_feature: Useful for making plants with altered cell wall content and/or composition
MGPMEPRYRSPAGAPEDTTKRRTSKSKSFRDVENFEVLVLEKNCGCKFKSLKIMIIAIISATVLTLITPTLYEHQLQSASRYVDVGWMWDKTSSDPRYASSVDVQWDDVYRALRNLKSGNPDLKVGLLNFNSTEYGSWTQLLPDSHVSIIILENAQDIITWQTLYPEWIDEEEETEIPSCPSLPEPNVRKGVRFDVIAVKLPCTRVAGWSRDVARLHLQLSAAKLAVASSKRNHKVHVLFVSDCFPIPNLFPCKNLVRHEGNAWLYSPDSKALREKLRLPVGSCELAVPLKAKSRLFSVDRRREAYATILHSASEYVCGAISAAQSIRQAGSTRDLVILVDETISDHHRRGLESAGWKVRIIQRIRNPKAARDAYNEWNYSKFRLWQLTDYDKIIFIDADLLILRNVDFLFAMPEITATSNNATLFNSGVMIIEPSNCTFQLLMDHINEITSYNGGDQGYLNEIFTWWHRIPKHMNFLKHFWEGDSEEMKAKKTQLFGADPPVLYVLHYLGLKPWLCFRDYDCNWNNPSMREFASDVAHARWWKVHDKMPRELQSYCLLRSRQKAGLEWDRRQAEKANSEDGHWRRNITDSRLKTCFEKFCFWESMLWHWGENSNRTKSSPATVTTTASLASS

SEQ ID NO: 17502 - DNA, 1474 bp, Panicum virgatum
  misc_feature: Ceres CLONE 1792554
  misc_feature: Encodes the peptide sequence at SEQ ID NO. 17503
gaatcgatggcgtaggcccagagcgatctagttttgctgcatctctctctctctgtctgtatcagagcctccgtctctcatctcctctccgcctccgcctccgcctccaccccaccccaccccacacctccgcccgacccccgccgccgcaggcaggaaggaaggatggaggcccctggctccccctacgcctcctcgccggaatccgccccgaagcgcgccccacgctcccctccgcagcagcagcagccgccctccgaggaaggagatgacaaggacaagccaacacatttgaggttcctggtgtctaatactgcagcaggatgtattattggcaagggtggatcaaccatcaatgactttcagtcccagtctggggctcgtattcagttatcacgtagccatgagttcttccctggtacaaatgaccgaatcatcatggtttctggaatgtttgatgaagtaatgaaggccatggagctaattcttgagaaacttttggctgagggtgaagagttcaatgaagctgaagctagacctaaagttagacttgtagttcctaacagctcttgtggtgggataattggtaaaggtggatcaacaataaagtcttttattgaagaatcgcacgctggaatcaaaatttcgccacaggataacaactatgctggtttgcatgacaggcttgttactgtcacaggaacttttgataaccagatgaatgcaatagatttgatattgaagaagttatgtgaggatgttcattaccctcctaatttgagttccccatttccatatgcaggtcttactttccctagctaccctggtgttcctgttggttatatgattccacaggtgccatataataatgctgtgaactatggacctaatgggtatggaggaaggtaccagaacagcaagcccagcacaccgatgagatcgcctgctaatattgatgcccaagaatctatcaccattggtgtagctgatgaacacataggtgctgttgtaggtcgtgctggaaggaatataacagaaatcattcaggctagtggtgctaggatcaagatatcagataggggtgacttcatgtctgggacaactgacaggaaagtgacaattactggaacatcagaagctatccgcaccgcggagtccatgatcatgcagagggtgtcagccagttcggagaggtgatgggcccctcttgaagacgggaggacatccatgagttgtgtggagagccttctcagtgcgcatgtttgatgcaaactggggagaggatgtgggaattgttttttttttcttttcttttttgggttcctagcaaaggtcgagaagaatcaagttattattgtttgttgcgtccgaccgatggtttttattatgttagcataaactggtagtagaagataattaggtgcgccgtttggattggtatcggaatagagcgagtttatatttgttggggtcc

SEQ ID NO: 17503 - protein, 343 aa, Panicum virgatum
  misc_feature: Ceres CLONE 1792554
  misc_feature (42)..(107): Pfam Name: KH_1 Pfam Description: KH domain
  misc_feature (126)..(191): Pfam Name: KH_1 Pfam Description: KH domain
  misc_feature (268)..(333): Pfam Name: KH_1 Pfam Description: KH domain
MEAPGSPYASSPESAPKRAPRSPPQQQQPPSEEGDDKDKPTHLRFLVSNTAAGCIIGKGGSTINDFQSQSGARIQLSRSHEFFPGTNDRIIMVSGMFDEVMKAMELILEKLLAEGEEFNEAEARPKVRLVVPNSSCGGIIGKGGSTIKSFIEESHAGIKISPQDNNYAGLHDRLVTVTGTFDNQMNAIDLILKKLCEDVHYPPNLSSPFPYAGLTFPSYPGVPVGYMIPQVPYNNAVNYGPNGYGGRYQNSKPSTPMRSPANIDAQESITIGVADEHIGAVVGRAGRNITEIIQASGARIKISDRGDFMSGTTDRKVTITGTSEAIRTAESMIMQRVSASSER

SEQ ID NO: 17504 - DNA, 2309 bp, Panicum virgatum
  misc_feature: Ceres CLONE 1792557
  misc_feature: Encodes the peptide sequence at SEQ ID NO. 17505
ggcaaactatcctcccattcctcctctccctccaggcgccgaaaccgggggaggcccaaaggatgagcaccgattgaggatcgccgagccgacccatggagcagctccgccaggtgggcgaggccctcggcggcgtccacgcgctcatggccttcgccgacgacctccggatcaacccgcgccagtgccgcctcctcgccgacgcctgcgcgctcgccttcgccgccgtcgccgccgaggtgcgcgcccacctccgcttccacgagcgcctggccaagtggaagccgctggaaggcccgctgcgggagctccaccgcgccgtccacgacgccgagggctacgtccgccactgcctcgagccgcgcgacagctggtgggcgcgcgccgccgcgctcacgcacggcgccgactgcgtcgagcagcacctgcacagcctgctctggagcgtcgccgtggtgatcgaggccgtcgaggccgtctcggaggtgaccgccgggtcggaccctgacgagctcgcccggcggcggctgctgttggccaaggactacgacagggacatgctcgagcccaggctgttccggcagaggctcggcgggcggtacctggccacgcgcgagctcgctgccaggatggacgcggcgtggaaggaggacaggtggcacctgtcccagctcctcgaggaacggaagagcccggcgtcaccggagccgttgacgcggaacgagcaccggctcgccgacctcctgacctcgccgcgggggaaggtgcacccggcgtccctgctcctgcacggagacttccacgtgcggaggcgcctcgtgggcaacctcaaggaggtgcagtggatgggggagaccttcgcggtgaagcacttggtcggtgccgacgccgacgccgtgggcgccgaggtcgcgctgctcaccttggtggcgcacccgaacgtggcgcactgccggtactgcttccacgacgaggacaagagggagttcttcctcctcatggatgagctcatgaccaaggacctggcctcccacgtcaaggaggtgaacagcgccaagcgtcggataccgctcccgctcgtggtcgtcgtcgacgccatgctgcagatcgcgcgcggcatggagtacctccactccaagaagatctaccacggggacctcaacccgtccaacgtgctcgtcaaggcgcggcacgccgacgcgcacctgcacgtcaaggtcgccgggttcgggccatccacggtgaccgcggccagccccaggccgagcccgagggcgctggccaatgcaaatgccaataacgccgccgccaatccctgcatctggtacgcgccggaggtgctggagcaggaggcggccaagtgcagcgagaaggcggacgtgtacagcttcgccatgatctgcttcgagctcctgacaggcaagatcccgttcgaggacaaccacctgcagggcgagcacatgagcaagaacatccgcgccggtgagcggccgctgttcccgttccaggcgcccaagtacctgaccaacctcaccaggcggtgctggcacggcgactcggcgcagcggccggcgttcgcgtccatctgccgcgtcctccgctacgtgaagcggttcctggtcctgaacccggtggacccgcaggggcagcccgacgcgccgccgcccgtgccgccggtggactacctggacatcgaggcgaacctgctgaagaggttcccggcgtggcaggccgggaacgcggcgccgcgcgtctccgacgttccgttccagatgttcgcatacagggtcgtggagaaggagaggaccagggcggcgatcatgcacatcggcagggacaaggcctccgactccagcagtgacggcgactcgctgtgcggggacgagaacggcagcagcctcggcgcggtgctgtcggacacggaggcggtttccatgtcgagccgcagcacggcgcggtctctgtcggaccggagcagcagcagggcgtcgccgaggaaggtggatcgcaaggtcaactccaggctagcagggccgccgcagaagtccaagtcgatgggtgtggttaggcagccgcaggtcaggcgaacgcagaggatcaagtccgacggtaatctgaattctgccgtggtaccgtccagcaggcggcgcgttcccggttccggcgggggtcacgcttcggactccgaactagcataagcaatgagaatgcatgatgagcgctgtaatatttcgatgacatttttttctaatagacagaagttttttgccaacatgtttgaataaaagatcaacactaacgtttactgc

SEQ ID NO: 17505 - protein, 700 aa, Panicum virgatum
  misc_feature: Ceres CLONE 1792557
  misc_feature (235)..(501): Pfam Name: Pkinase Pfam Description: Protein kinase domain
  misc_feature: SWISSPROT Homolog: EC 2.7.11.1 Non-specific serine/threonine protein kinase
MEQLRQVGEALGGVHALMAFADDLRINPRQCRLLADACALAFAAVAAEVRAHLRFHERLAKWKPLEGPLRELHRAVHDAEGYVRHCLEPRDSWWARAAALTHGADCVEQHLHSLLWSVAVVIEAVEAVSEVTAGSDPDELARRRLLLAKDYDRDMLEPRLFRQRLGGRYLATRELAARMDAAWKEDRWHLSQLLEERKSPASPEPLTRNEHRLADLLTSPRGKVHPASLLLHGDFHVRRRLVGNLKEVQWMGETFAVKHLVGADADAVGAEVALLTLVAHPNVAHCRYCFHDEDKREFFLLMDELMTKDLASHVKEVNSAKRRIPLPLVVVVDAMLQIARGMEYLHSKKIYHGDLNPSNVLVKARHADAHLHVKVAGFGPSTVTAASPRPSPRALANANANNAAANPCIWYAPEVLEQEAAKCSEKADVYSFAMICFELLTGKIPFEDNHLQGEHMSKNIRAGERPLFPFQAPKYLTNLTRRCWHGDSAQRPAFASICRVLRYVKRFLVLNPVDPQGQPDAPPPVPPVDYLDIEANLLKRFPAWQAGNAAPRVSDVPFQMFAYRVVEKERTRAAIMHIGRDKASDSSSDGDSLCGDENGSSLGAVLSDTEAVSMSSRSTARSLSDRSSSRASPRKVDRKVNSRLAGPPQKSKSMGVVRQPQVRRTQRIKSDGNLNSAVVPSSRRRVPGSGGGHASDSELA

SEQ ID NO: 17506 - DNA, 2157 bp, Panicum virgatum
  misc_feature: Ceres CLONE 1792561
  misc_feature: Encodes the peptide sequence at SEQ ID NO. 17507
aatacaaaatccggaggaactcgcaggaggccaagagcagatccgcttcctcatcgcgatcgccccttccttcctttcccgacttgtagcggaagccatggcgtcgtcggcgctaatctgcgacacggagcagtggaaggcccttcaggcgcatgtcggcgcaattcagaagacgcacctgcgggacctgatggtcgacgccgaccgctgcaaggccatgacggctgagtttgaagggatttttctggattactcgaggcagcaggcgacaggtgaaaccattgagaagctgctcaaattggcagaggctgcgaagctcaaggagaagattgagaagatgtttaaaggtgaaaagataaataccacagagaacaggtcagtgcttcatgtagctctaagggctccaagagatgcagtcataaacagtgatggggtaaatgtggtccctgaggtttagagtgttaaagataaaatcaagcagttttcagagacttttagaagtggatcatgggttggggcaactggaaaagcattgacaaatgttgtgtcagttggaataggtggtagctttcttgggcctctatttgtgcatactgcactccaaactgatccagaagcagcagaatgtgcaaaaggccggcagctgagattccttgcaaatgttgatccagttgacgttgcacgaagcattaaagatttagatcctgaaactactcttgttgtggttgtatcgaagaccttcacaactgctgaaacaatgttaaatgctcgaacactaaaggagtggatcatctcttcccttgggccacaggctgtttcaaaacatatgattgctgtcagtactaatcttaagcttgtgaaggagtttggaattgacccaaacaatgcttttgccttctgggactgggttggcggacgctatagtgtttgcagtgctgttggtgttctgccgttatctcttcagtatggctttccaattgtccagaaatttttggagggcgcttcgagcattgacaaccatttccactcatcttcatttgagaaaaatatacctgtactccttggtttgctgaacgtgtggaatgtttcatttcttggttacccagctagagcaatattaccatattcccaggcgcttgagaaactggcaccacatatacagcagcttagtatggagagtaatggaaaaggtgtctccattgatggtgttccacttcccttggagactggtgaaattgattttggtaaacctggaaccaatggccaacacagtttctatcaattaatccatcagggaagggtcatcccttgtgattttattggcgttgtaaaaagtcagcagcctgtttacttgaaaggggaaactgtgagtaatcatgatgaactgatgtccaatttctttgcccagcctgatgcacttgcttatggaaagactcctgaacaattgcacagtgagaaagttccagaacatcttatccctcataagacttttaagggcaatcggccatcgctaagtttgctgctgcctacactatccgcatatgagattggacagcttttatccatttatgagcaccggattgcagtccagggtttcgtatggggaatcaactcgtttgatcaatggggagtggagctagggaagtcactagcttctcaagtgaggaaacagctgcatggatcccggatggaagggaagcctgtggagggctttaaccacagtacttcaagtttgctagctagatatctcgccgtccagccacccaccccttatgacagtaccgtgctgccgaaggtgtagcttgagatgttccacattctaattgctaagttcttacttggcaaggttcagtgcaagtctttgttccttttgggggttgtcagtctcagccggtttggcagtgctgtaattttgtggttttgtgtactcctacgtggagaagaagagaaactggcagatattatggggtaaataaatttacctggtgcagcatgaggaaaccgaagaatgcgttttttcgagttttggggcgctgtaccataaagccgtggaattaacgggtgtaaactcagttgcagttacaataccatacatgtgtcttctgtttccacttggacagtattatgattctgctgccgtggcttatgtgcttttac

SEQ ID NO: 17507 - protein, 119 aa, Panicum virgatum
  misc_feature: Ceres CLONE 1792561
  misc_feature: SWISSPROT Homolog: EC 5.3.1.9 Glucose-6-phosphate isomerase
  misc_feature: Functional homolog of the protein sequence given in SEQ ID NO 50766
  misc_feature: Useful for making plants with altered cell wall content and/or composition
MASSALICDTEQWKALQAHVGAIQKTHLRDLMVDADRCKAMTAEFEGIFLDYSRQQATGETIEKLLKLAEAAKLKEKIEKMFKGEKINTTENRSVLHVALRAPRDAVINSDGVNVVPEV

SEQ ID NO: 17508 - DNA, 754 bp, Panicum virgatum
  misc_feature: Ceres CLONE 1792576
  misc_feature: Encodes the peptide sequence at SEQ ID NO. 17509
aggcaggagcgcgcatccggcccctgcccttcttccccactttcctctcctctccccccagaataataaaatttcctgccccggggctccctccctcccaaggaaacctacccaatccattcgtccggcggccgatccatctgcccgtccagggagaggaaggaataatcagtcactcagtcagttagccagtcaatcagaggagagccggaatccagcaggagcgcgccgcgggttgatcccttgcgtctccggccctgccgcgcgggcgcggcgacgtctctgctgttctttgcgtcgcggaggacgaatccgtgaggagggagtgtgtgtgaggaagaggaaggtggaggagggaacccctcttggagattggcatcttcctcgttgggttgcgctgcgttgcacggcaagacggcggccttgaagatgcgggtgctggaggacgacctcttcccctccacccccggcaaggtcaagatcgagagggcgggcaacatgaaccggcagctgcaccgctgcttcacgtccaccagcaccatgttcctgtgggcgctcttcctcgtcgccatgaccgcgtcctacctcagcttccagtccttcgtcgacacctcctccaagtacttcgccgcctcctggggcgggttgcactgggagcggcagatccgcgcgtccgccgcgccgaggaggccgccggggtcggcggacggggcggggatgtcggtgctggtgaacggcgcggccggggttcgtt

SEQ ID NO: 17509 - protein, 108 aa, Panicum virgatum
  misc_feature: Ceres CLONE 1792576
  misc_feature: SWISSPROT Homolog: EC 5.1.3.6 UDP-glucuronate 4-epimerase
  misc_feature: Functional homolog of the protein sequence given in SEQ ID NO 50767
  misc_feature: Useful for making plants with altered carbohydrate content
  misc_feature: Functional homolog of the protein sequence given in SEQ ID NO 50768
  misc_feature: Useful for making plants with altered cell wall content and/or composition
MRVLEDDLFPSTPGKVKIERAGNMNRQLHRCFTSTSTMFLWALFLVAMTASYLSFQSFVDTSSKYFAASWGGLHWERQIRASAAPRRPPGSADGAGMSVLVNGAAGVR

SEQ ID NO: 17510 - DNA, 1213 bp, Panicum virgatum
  misc_feature: Ceres CLONE 1792589
  misc_feature: Encodes the peptide sequence at SEQ ID NO. 17511
acccaatatacagtttagacacaacccagctcctctccggcaacgagtgcgcgctccagctgccctgagatttatgtcttgcaggtaacatgatcgaacctatgggtgccaggaggcttgtgaagtccgccatgattgcggtactggctctgatgctgttttataggcctcgatgcgtccatagcgcgacggtcccccagaacagcacggacatgctggcactgatcgatttcaggcaagcgatccccggagatcccagaggattcttcaattcctggaacagcagtgtcgactactgcaagtggaacggcgttacatgcagcaaaacgcacccagggcgcgtcagggagctcaaccttacaggccagagcttggaaggtacacgggcgtcgagtgtcgacggggagctgccgtggaggtgctgtggccgatggaccgtgcggtggacggcggtgaagggcagccgggaccggagctcggaccgggcggcagctgtggcgtccactcctggatcgagggcgcaagcggcgacggaaggcgggtttcttggtttgcgccacaaaaccaaggaggcggacggcggttgaagacgccaggtcgtggaggcacgggcgtcggtctcgggactaacggaggcgacgggcgtcgacggcgtctagggcctcgctgcgggcgaggaggtgacgggcgtcgggcggcgtctagggccgtcagaaggccgaggcgggaacggcgtctagggccacggcgtggaggcgggaatcttcccgcgcgtggagttttggcggttttatcaaaaccggccacctacccgggtttcgcggacccccaaaaaccgcgaaccggatcttcatccacacggcggcatcgcggagaagacttcgactcgaagaaagaacctcggccgtcggatgagtccaatgtatcttttccggttttgcccctacgggctttatagtgtctagttaagtctaggggtattttagtctttagtctagagagttagaggggataaaatagagagaggagggcagccaacagtatccatccatttgttcccatcgcccccttggcccctcctctattctggttttccccttcttcctccttcacctagggttaggattttggtgatggatctttgagacctggtactacaaatcgatgggaaaggaggccttctcctcctcttgccctctgggcggttgatttg

SEQ ID NO: 17511 - protein, 161 aa, Panicum virgatum
  misc_feature: Ceres CLONE 1792589
  misc_feature (34)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MGARRLVKSAMIAVLALMLFYRPRCVHSATVPQNSTDMLALIDFRQAIPGDPRGFFNSWNSSVDYCKWNGVTCSKTHPGRVRELNLTGQSLEGTRASSVDGELPWRCCGRWTVRWTAVKGSRDRSSDRAAAVASTPGSRAQAATEGGFLGLRHKTKEADGG

SEQ ID NO: 17512 - DNA, 769 bp, Panicum virgatum
  misc_feature: Ceres CLONE 1792591
  misc_feature: Encodes the peptide sequence at SEQ ID NO. 17513
tgctctctcagaggtgggttagcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggtggcggcggcggctacggcggcggtcgtcagggcagccatgccgtcccacaagaccttccggatcaagaagaagctggccaagaagcagcgccagaaccgccccatcccctactggatccgcatgcgcaccgacaacaccatcaggtacaacgcgaagcgcaggcactggcgccgcaccaagctcggattctgagcgggggaagagatgccgggcaccgatgcttggggaaactgggatttacgagccggcctcgggacgcttccatgtttccgcatgctaggggagctcttgtttagattttgcttgtgttaatttgatgttatcagttgttcctgtagcgtactgagaataccatgctttgctgatggttgaagaacaccctttataaatttgcagaagctatcttggtctgccatgtgtc

SEQ ID NO: 17513 - protein, 188 aa, Panicum virgatum
  misc_feature: Ceres CLONE 1792591
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
MAAADVEYRCFVGGLAWATDNASLQQAFASYGDVLDSKVITDRETGRSRGFGFVTFSSEQSMLDAIEAMNGKDLDGRNITVNQAQSRGGGGGGGYGGGRQGSHAVPQDLPDQEEAGQEAAPEPPHPLLDPHAHRQHHQVQREAQALAPHQARILSGGRDAGHRCLGKLGFTSRPRDASMFPHARGALV

SEQ ID NO: 17514 - DNA, 1980 bp, Panicum virgatum
  misc_feature: Ceres CLONE 1792629
  misc_feature: Encodes the peptide sequence at SEQ ID NO. 17515
accactgttccgcgtcgcctccacttgcaatccgccgggagctcagggcttccgatcagcgaactgcagaaatccccgctgtgtgatgatcgatcgggtatggcgcttaaggccacggctcaggccgctgcggaggcggccatagcggccatcggctgcggctacgatgtcgcggcggacatccggctcaagtactgcaaggggaagctgaacggtgccgcacacctcgttgacttcggccgcgatgaggttcaggacatggtgctccccggtgggctgaaggtgccgggcgtccccaagtccatcaagtgcgacatgggtgagccgaagccgatgcggctctgctccgatttcctctcgtttcagcagatgtcagagaacttcaaccgggagttatctttgattgggagcattccgtccggcatgctcaatagtatgtttgaattttctggctgctggcagagagatgcagctaataccaagtcacttgcttttgatggtttcttcatttcactatacaccattgcacttccaccctcacgtatcctactgcttgatcatgttactaaggcagttccttcaacctgggatcctcttgcattggcaaggttcattcaaaagtttggaactcacatagttgttggtgtaaaaattgggggaacagatattatttatctgaaggaacagcattcctccagcttgcaaccagctgtggttcagcaacgaatgaaggagatgtcagacaggagatttctggatgcaagtggtcagtctgacattaccaacaaggatgcatctgggaaagataagaatgttgtgagagtgcgacgactaagatttgcagaatcaagtccatcaagttcttactcttcgaaagaggatattgtgtttctggttaaaaggagaggtggaaatgaatgggacaaagagatgcctcatagcgagtggataaaaactgttcaagcabaacctgatgttatctcaatgtcctttctacctgttacttcattgttgaatggagtacctggcgtgggctttgtcagccatgcaattaatctgtacctacgctataagcctccaattgaagaactacaccaatttcttgagtttcagctaccaagggtttgggcgccgcagcacagtgatactctcctactccctgatcraaggagtagtgcatctttgaccataaatttcattggtccgaagctctgtgtctgcattgaaatggttgatgtgggtgaaagacctgtcactggactacggttatatctcgagggaaggaaatgcaacaagttggctatacatcttcaacatctaagttcccttccacaaaccatccaactcgtggatgatccttacaaccacagaactcctaaaccacatgaccccatgtacttcgaatcatttgggtcatggaagggtttctcttatgtctgcacagcaccagtggagtcagatgacgacacctcaattgttactggggcacagttacttgtgagcagccatggattcaggaaagtactttcccttcacctccatttctcaaaagtctgcaatgctgtaatcgtgaagaaccctgtgtgggatggatcaccaaatctggcctggaattctagtcttgtaaccacaaaagactcctcaggatccaagaaacgtgccgatcatgtgaacatcgactcagctgtgtaccctgtcggtccacctgtgcctgtgcaggcaccaaaacttctcaagtttgtggacacagcagagattttccgtggaccacaagacatgccgggctactgggtggtctctggtgcaaaactgcaacaagagagaggcaagatatcgctatgtgtgaagtattcactcttgacgaccatggtacctaaaaccgagtatccacctgttgaacaaaattgatacttggaccaagaatcaaagagagactgatgtgcatttactcatgcgacgcatgacaatgtttcagcgtgc

SEQ ID NO: 17515 - protein, 602 aa, Panicum virgatum
  misc_feature: Ceres CLONE 1792629
  misc_feature (127)..(323): Pfam Name: MACPF Pfam Description: MAC/Perforin domain
  misc_feature (290)..(290): Xaa is any aa, unknown, or other
  misc_feature (356)..(356): Xaa is any aa, unknown, or other
MALKATAQAAAEAAIAAIGCGYDVAADIRLKYCKGKLNGAAHLVDFGRDEVQDMVLPGGLKVPGVPKSIKCDMGEPKPMRLCSDFLSFQQMSENFNRELSLIGSIPSGMLNSMFEFSGCWQRDAANTKSLAFDGFFISLYTIALPPSRILLLDHVTKAVPSTWDPLALARFIQKFGTHIVVGVKIGGTDIIYLKEQHSSSLQPAVVQQRMKEMSDRRFLDASGQSDITNKDASGKDKNVVRVRRLRFAESSPSSSYSSKEDIVFLVKRRGGNEWDKEMPHSEWIKTVQAXPDVISMSFLPVTSLLNGVPGVGFVSHAINLYLRYKPPIEELHQFLEFQLPRVWAPQHSDTLLLPDXRSSASLTINFIGPKLCVCIEMVDVGERPVTGLRLYLEGRKCNKLAIHLQHLSSLPQTIQLVDDPYNHRTPKPHDPMYFESFGSWKGFSYVCTAPVESDDDTSIVTGAQLLVSSHGFRKVLSLHLHFSKVCNAVIVKNPVWDGSPNLAWNSSLVTTKDSSGSKKRADHVNIDSAVYPVGPPVPVQAPKLLKFVDTAEIFRGPQDMPGYWVVSGAKLQQERGKISLCVKYSLLTTMVPKTEYPPVEQN

SEQ ID NO: 17516 - DNA, 2231 bp, Panicum virgatum
  misc_feature: Ceres CLONE 1792631
  misc_feature: Encodes the peptide sequence at SEQ ID NO. 17517
atttttttacacaaaatcggctaaatttcctatttccggctcttgaaaccgccccctaattcctcctctcgtcaaatcctcctcgccgtgcggcagttcctctcgccggcgaaccaccgagagccctttccccccgacggcgagtcgtcgaatcgccccgctcggagcggcagccgccctccgccgcccgccggagaaggagaacgggagccgcgggcctctggcagtaccgccgaagaacggcaggcaggcggcaagtcgcgcgccccgcgccgcgtcgattggcattggatttgccgatccattgcttccgtttgttgagttctggaagcgaaccgatccgatgagattcttcaaggggagcaaggtggaggtgttgcaggaggcagaggtgccttttggttcttggaggcccggtgagatcgtctcggggaacgggcacacctacttggtgcaatacgatgaaagccctgttgactctggcgtggctgttgaaagggtgccaagaaggttgatgagacctagcccacctgcggatgatccagtatgctgggttgtgggtagtattcttgaggcctttgatagctactcgtggaaggttgcagaggtagtgagagtgcttggcaagaagcagtatcttgtccgtctccttgggtcctccctggagttgatggcacaggcatcagatcttcgattgaggaagctttgggtagatgacaaatggattgtgactcagaagtattccgcaaaatgcttggatggttcattcagaggtcgattgaaagatggaaatttaggctgcaactttggaatggacagccatattcaacttgaaaacaagaatgcctttgagggtgctacatctagaggcataaagagaaaatcgtctgctatgacaacacatcctcaatgtagtgaaatcacaaagagattgcagacgccgcaaagagatggaaggcactcgaagctggttgatagaggttccctccgtttggctgaaaagggccgaggttggaggcttgtaaagcatccttccataggttcatgtcgatggaggagtctgccacatggtttgcagtgcgataaatgtggcaacatttccatcaaacttccattggtcaagcaggatcagaattgcggttccaaattaatgatggttgctggatggaaaaggtcaatttggattggttttatgatccaaagacaaaagggtaatctgtctgttggtgatttttgagagaatgagcatgttccctctttggtaagtgctaccggaactcttttattttaacacctttttgaggacgcaatactactcctttcaggtaattacacaaccaacagtcttgcaatttttatgcacattatggtaaacagtgctcaaattttcagtaagttaaattgcaattgatacatactcttcagcaaaagtagcagttattgatgtcagcagtgtttttggtcgcttgaataaagttcacagattcattctgttgaagctaagaagtctttatttcaagacatgttacagtatgcagattgccagattgtttaagttaaaagtcatagaaatggtaaaatgtggactagggctagaacatgttacttcaacttcgaccaacagacttgggctatactaccattagggggtattcacttaagaaatcatgcatcaggataagatatcgttccatgaatggatcatcatttagttgaagcctttgccagataatggaatagtaatatcccatatatgcttgaaatatttggagatccacattgaagatctttcttagcaaccaccttcacaataactttgcattacacaatatgcttgttctgtgtgagtaacaggttttgtgttgaacactaggcggtttttaaatactatttatggcataaaattgtcttgtactccatgcacgaaatgttgtattggactcttgaaatgcattgcagggcacaactcaatacttataactaaaaattgatgcatactctctcttttagatcattgcttctgcgatctcctaagggtcaattgcagacagatgctatgtaaggatacggtataatggtgtagtgccaattttttaacaagattttaaccgattatcacatcgttattgcaaaggacaatcctgaacaattttctgctttgatgagcttttcaatgcgcaatgtgtttttttttctcgaacacgcagatctgcgtatcattgcaataatag

SEQ ID NO: 17517 - protein, 297 aa, Panicum virgatum
  misc_feature: Ceres CLONE 1792631
  misc_feature (3)..(66): Pfam Name: Agenet Pfam Description: Agenet domain
MRFFKGSKVEVLQEAEVPFGSWRPGEIVSGNGHTYLVQYDESPVDSGVAVERVPRRLMRPSPPADDPVCWVVGSILEAFDSYSWKVAEVVRVLGKKQYLVRLLGSSLELMAQASDLRLRKLWVDDKWIVTQKYSAKCLDGSFRGRLKDGNLGCNFGMDSHIQLENKNAFEGATSRGIKRKSSAMTTHPQCSEITKRLQTPQRDGRHSKLVDRGSLRLAEKGRGWRLVKHPSIGSCRWRSLPHGLQCDKCGNISIKLPLVKQDQNCGSKLMMVAGWKRSIWIGFMIQRQKGNLSVGDF

SEQ ID NO: 17518 - DNA, 2377 bp, Panicum virgatum
  misc_feature: Ceres CLONE 1792642
  misc_feature: Encodes the peptide sequence at SEQ ID NO. 17519
gacagaaaccaagggctcgtccagtgtccggcaccagcgcagtgcgcagacacgcgatagggttttgggtggggtgaggacgggccggcggcaattcggggactccgacgaagacccgccgcacaacgccgacgaaggcgcctggcgcgacgccagggaaggcagcctgccgcccgctggccgcgccgtcgcctctccgctccccacctgcaactgtaccacggcctgcggcgccaggtgggccactcaacattcgccgccgcctcccatctccaacatccgcctgccatggagcacctccggtggcgcccctcggtgaacgagcgcgaattcattgagaccgccctccagtccgacctccgcgtcgacggccgccactccttcgacttccgcaaactcaggatcagcttcggcagggaggacggctcgtcggaggtgcagctcggggagacgcacgtgctgggctacgtgaccgcgcagctggtccagccctacagggacaggccgaacgaggggacgctggccatattcaccgagttctcgcccatggccgacccagccttcgagcctgggcgtccaggggaatcagcaattgagcttggccgagtcatcgaccgtggcctcagggagagccgggctgtggacatggagtccctgtgtgttgttgctgggaagcatgtctggtccgtgcgggttgaccttcacatcttggacaacggagggaatctcattgatgcagctaacattgctgcattggccgctttgtctactttccggaggccggaatgcacagttggtggggacgatggtcaacaagttatagtgcatgatcctgaggtcagggatccactccctcttacaattcatcatatgcccattgctgtaacctttgcatattttggtgaaggtaacatcgtggttattgatcccacatacaaggaagaagcagtaatgggagggaggatgactgctacgattaactcaaatggtgatatttgtgccatccagaaagctggtggggagggtgtcatgtcaagtgttgtcatgcagtgtttaagaattgcttctgttaaggctgctgatataacaagcaaaataaagaaagcagtagactcatacaccactgagaaagctttaaagaaagtaaagcgtttaccagccatgatgcctcaaaaaattaatgtaattgatgtaactatggaggacaaagttgatggtgaattggagacgcaaactgtgaagacacccagtgaagttcaggagataagcaaaggtgatgaagaccatcgaaatctaaaagggaattcacccttgactggggacagaattgctaaacagaaacaaacatcaacattcagtggtggtccatcaaattggtagcgattagcctgatgttttgttcccaagttctagatgtttagcaaatatttgcttgacacaagttttgccgactagtcctgatttttgccatgtagggacccatattctaaaggagtttcattaagctccctcagaattttgcagttgccgggtactgttaattttgtttgcatgttatgagttctcttcttgcttgctatctgccaataccatctctctgtgatgtgcttgcaatcattctttggttggcattttagtgcacattgattatcaaaatatcatatttatggcaagtccctctccactgttagctttctagacatgttttggtaccatttattctagggctgataaatattatatatccatgctttcagtgtgctgggtcctttaaattatgatatgtacaaatcagcttctgccagtccaaagacttcagtttacagtcattttgatttgacatacttaatctgctgtagccttccttgaggaatcatttttattgccttgccaagattgattctctcttatgagttcagatgcagtttcttatgattgtttcctgctcaacatgcagatccagcaactacaggtaaggccagaagccatgaggaggcacaaccaatgttaactgagtcatctaatgctgaggtgaaaatcatcacatcaagctctggggctgttggagagtctgaagaggcccaggaaattgggtcgccaaagagcctaaaagatgctatcaaaccaaaacacaaaagaaagaagaacaaaaagtgacaggagttagattaattgcaagcctgtaatttcatggctaaggtaaatcaacgatagcctacaactcctattcaaattcacagaagcggcatacatgggttacaaattctgtgtttttagttgttactgatgcaggaggtgactgcaggcaaattttgtacaagctgtacaattcaattgtattctaggaatggtcaagttttcaggcaactttgcaacg

SEQ ID NO: 17519 - protein, 363 aa, Panicum virgatum
  misc_feature: Ceres CLONE 1792642
  misc_feature (33)..(165): Pfam Name: RNase_PH Pfam Description: 3' exoribonuclease family, domain 1
  misc_feature (194)..(262): Pfam Name: RNase_PH_C Pfam Description: 3' exoribonuclease family, domain 2
  misc_feature: SWISSPROT Homolog: EC 2.7.7.56 tRNA nucleotidyltransferase
MEHLRWRPSVNEREFIETALQSDLRVDGRHSFDFRKLRISFGREDGSSEVQLGETHVLGYVTAQLVQPYRDRPNEGTLAIFTEFSPMADPAFEPGRPGESAIELGRVIDRGLRESRAVDMESLCVVAGKHVWSVRVDLHILDNGGNLIDAANIAALAALSTFRRPECTVGGDDGQQVIVHDPEVRDPLPLTIHHMPIAVTFAYFGEGNIVVIDPTYKEEAVMGGRMTATINSNGDICAIQKAGGEGVMSSVVMQCLRIASVKAADITSKIKKAVDSYTTEKALKKVKRLPAMMPQKINVIDVTMEDKVDGELETQTVKTPSEVQEISKGDEDHRNLKGNSPLTGDRIAKQKQTSTFSGGPSNW

SEQ ID NO: 17520 - DNA, 1842 bp, Panicum virgatum
  misc_feature: Ceres CLONE 1792643
  misc_feature: Encodes the peptide sequence at SEQ ID NO. 17521
acacacgcacgcttattataccacaccgactcaggcgatccactccgcgagtcagcacagctccttccccccccgcgtcgtgaactggcagctagcacagccaacccgcgagcggatcaccagagatggccacggcggcctacctctccttctcggcgccgccgtcgtcgtgcaccggccggcagcggcggcggcaggcgacgcgggcgtcgccgtcggcgacggaccgaccgcgcgaggtggtgtcgccgaagcggcggctgccactgcggaaggtaccgggcgactacggcccgccggtggtgggcgcgctccgggaccggctcgagtacttctacgggcccggcgggcgcgacggcttcttcaccgcccgcgtccgcgcgcacggctccaccgtggtgcggctcaacatgccgccagggcccttcgtggcgcgcgacccgcgcgtggtggcgctgctcgacgccgcctccttcccggtgctcttcgacacctcgctggtcgacaagacggacctcttcaccggcaccttcatgccctccaccgacctcaccggcggctaccgcgtgctctcctacgtcgacccctccgagcccaaccacgggccgctcaagacgctcctcttctacctcctctcgcaccgccaccagcacgtgatccccaagttccgcgaggtgtacggcgacctgttcggcctcatggagaaggagctcgccagggccggcaaggccgacttcgggcactacaacgacgccgccgccttctccttcctctgccaggcgctgctggggcgcgaccccgccgagtccgcgctccagggcgacgggcccaagctgatcaccaagtgggtgctgttccagctcagcccgctgctcaacctcggcctgcccaagctcgtcgaggactccctgctccactcgttccgcctcccgccggcgctggtcaagaaggactacgaccgcctcgccgacttcttccgcgacgcggccaggggcgtcgtcgacgagggcgagcgcctcggcgtcccgcgggaggaggcggtgcacaacatcctgttcgccatgtgcttcaactccttcggcggcatgaagatcctgttcccgtcgctcgtcaagtagctgggccgcgcccgcgcgcggacgcacgggcggctggcgacggaggtgcgcgacgccgtgcgcgcgcacggcggcgaggtcaccatgaaggcgctgtcggagatgccgctggtgaagtcggcggtgtacgaggcgctgcggatcgagccccccgtggcgatgcagtacggccgcgccaagcgggacatggtggtggagagccacgactacgggttcgaggtgcgggagggggagatgctcttcggctaccagcccatggccaccaaggacccgcgcgtcttcgcgcggccagaggagtacgtgcccgacaggttcctcggcgaggacggcgcgcgcctgctccgccacgtcgtctggtcaaacgggcccgagacggcgtcgcccacgctgcaggacaagcagtgcgccggcaaggacttcgtcgtcctcatcgcgcgcctcctcgtcgccgagctcttcctccggtacgactccttcgacgtccaggtcggcgcctccgcgctggggtcgtcggtgaccatcacctcgctcaagaaagccaccttctgagctcccgctcggaccgaccgccgtcaaagtcgccggagccggcgacgggcaatgttttacagtagagaagaatatactgcgctgtcctctctgtctgtctctctctctctcaatatattttttttcctagtcttgtgctcctgaatgttcaaaaaaaaagaagtattgtgctccg

SEQ ID NO: 17521 - protein, 330 aa, Panicum virgatum
  misc_feature: Ceres CLONE 1792643
  misc_feature: SWISSPROT Homolog: EC 4.2.1.92 Hydroperoxide dehydratase
  misc_feature: Functional homolog of the protein sequence given in SEQ ID NO 50769
  misc_feature: Useful for biocontainment applications
  misc_feature: Useful for making plants with modulated nitrogen use efficiency
MATAAYLSFSAPPSSCTGRQRRRQATRASPSATDRPREVVSPKRRLPLRKVPGDYGPPVVGALRDRLEYFYGPGGRDGFFTARVRAHGSTVVRLNMPPGPFVARDPRVVALLDAASFPVLFDTSLVDKTDLFTGTFMPSTDLTGGYRVLSYVDPSEPNHGPLKTLLFYLLSHRHQHVIPKFREVYGDLFGLMEKELARAGKADFGHYNDAAAFSFLCQALLGRDPAESALQGDGPKLITKWVLFQLSPLLNLGLPKLVEDSLLHSFRLPPALVKKDYDRLADFFRDAARGVVDEGERLGVPREEAVHNILFAMCFNSFGGMKILFPSLVK

SEQ ID NO: 17522 - DNA, 709 bp, Panicum virgatum
  misc_feature: Ceres CLONE 1792650
  misc_feature: Encodes the peptide sequence at SEQ ID NO. 17523
aggaggcgccgagctagcaccaccaccaccagcagcagcacaaggttggttgaaccaatcgcctgttgcacaaggtcaccaacccgattgacaggccagttcatccgagagcgagctcggtcgccggagagatgggttccgtggacgagtcggtggcgccaccaccacggcgaacccgttctacaccccgcacgagatccaccggcaggcggaggcggcgggcgccaggctcatcgtcaccgaggcctgcgccgtggagaaggtgcgcgagttcgcggccgcgaggggcatccccgtggtcaccgtggacgggcgcttcgacgggtgcgccgagttcgccgaggtcatcgcggcggaggagctggaggccgacgccgacatccagcccgacgacgtcgtcgcgctgccctactcctccggcaccaccggcctccccaagggcgtcatgctcacgcaccgcagcctcatcaccagcgtcgcgcagcaggtcgacggcgagaacccgaacctgcacttccgcacgaacgacgtgctgctgtgcctgctgccgctgttccacatctactcgctcaactcggtgctgctggcggggctccgcgccggctgcgccatcgtgatcatgcgcaagttcgacctgggcgcgctcgtggacctggtgcgcgcgcacggcgtcaccatcgcgcccttcgtgccgcccatcgtggtggag

SEQ ID NO: 17523 - protein, 87 aa, Panicum virgatum
  misc_feature: Ceres CLONE 1792650
  misc_feature: SWISSPROT Homolog: EC 6.2.1.12 4-coumarate--CoA ligase
  misc_feature: Functional homolog of the protein sequence given in SEQ ID NO 50770
  misc_feature: Useful for making plants with altered carbohydrate content
  misc_feature: Functional homolog of the protein sequence given in SEQ ID NO 50771
  misc_feature: Useful for making plants with altered cell wall content and/or composition
  misc_feature: Functional homolog of the protein sequence given in SEQ ID NO 50496
  misc_feature: Useful for making plants with altered lignin content
MLTHRSLITSVAQQVDGENPNLHFRTNDVLLCLLPLFHIYSLNSVLLAGLRAGCAIVIMRKFDLGALVDLVRAHGVTIAPFVPPIVV

SEQ ID NO: 17524 - DNA, 681 bp, Panicum virgatum
  misc_feature: Ceres CLONE 1792650-R
  misc_feature: Encodes the peptide sequence at SEQ ID NO. 17525
aaggacggctggctgcacaccggggacatcggctacgttgacgacgacgacgagatcttcatcgtcgacaggctcaaggagatcatcaagtacaaggggttccaggtgccgcctgcggagcttgaggccctcctcatcacgcacccggagatcaaggacgctgctgtcgtatcaatgaaggatgatctcgccggtgaaatcccggtcgccttcatcgtgcggacagaagggtctcaactcaccgaggatgagatcaagcaatttgttgccaaggaggtggttttctacaagaagatccacaaggtcttcttcaccgactccatccccaagaatccttcaggcaagatcctaaggaaggacttgagagccaggctcgccgccggtgtccactgaggccgcagtgtttcagtcggccacactgttgagaaaaggccatgcaataggtggtaccattgttcatgaaatggcagcagaaggggcacctaatcttgtggaaacatatatgttgccgaaagaggttttagtttgtttgttggttggccctgtgtggtgtaatgttcataaatgatatatatagatgcatctagctatattgtttttgaccaaacgaacaaggctgattacggcaatacagtaatgtataccatgtttaaatggtatggattcatcttaaagttacgc

SEQ ID NO: 17525 - protein, 130 aa, Panicum virgatum
  misc_feature: Ceres CLONE 1792650-R
  misc_feature: SWISSPROT Homolog: EC 6.2.1.12 4-coumarate--CoA ligase
  misc_feature: Functional homolog of the protein sequence given in SEQ ID NO 50770
  misc_feature: Useful for making plants with altered carbohydrate content
  misc_feature: Functional homolog of the protein sequence given in SEQ ID NO 50497
  misc_feature: Useful for making plants with altered cell wall content and/or composition
  misc_feature: Functional homolog of the protein sequence given in SEQ ID NO 50496
  misc_feature: Useful for making plants with altered lignin content
KDGWLHTGDIGYVDDDDEIFIVDRLKEIIKYKGFQVPPAELEALLITHPEIKDAAVVSMKDDLAGEIPVAFIVRTEGSQLTEDEIKQFVAKEVVFYKKIHKVFFTDSIPKNPSGKILRKDLRARLAAGVH

SEQ ID NO: 17526 - DNA, 701 bp, Panicum virgatum
  misc_feature: Ceres CLONE 1792660
  misc_feature: Encodes the peptide sequence at SEQ ID NO. 17527
aacgctcacagcaccgcacacacagaaaaccaccagcagcgcctcggttttacggctctgcccctccctcgccccgcgcgctcgaagaagccatgaagctggaggtgatgcccaagcagagggtcctggaggcggagcagagggaggaggccatggagatgagcggcctggagctgtggaagcacgagaagccccccaggatttgccccatgccgtcgctgatcccgccgccggcggcgtgcgattgcgacgaggcggcgctcgtgccgccgctcaacttcgccatggtcgacgacggcatcttccgctccggcttcccggagacctccaacttccggttcctcaagtcgctcaacctccgctccatcgtgtacctgtgcccggagccgtacccggagacgaacacggagttcctcgaggagaacgggatcaagctccaccagttcggaatcgaggggcgcaaggaaccattcgtcgaaatccccgatgacaaaattcgggaggcgctgaaagttgtcctagacccaagaaaccaacccctgcttattcactgcaagagaggcaagcaccgaactggctgcgtggtcgggtgcttgaggaagctgcagaagtggtgcttgtcttccgtcttcgacgagtaccaccgcttcgccgctgcgaaagcgaggatcactgaccagagattcatagagctgttcgac

SEQ ID NO: 17527 - protein, 202 aa, Panicum virgatum
  misc_feature: Ceres CLONE 1792660
  misc_feature (57)..(202): Pfam Name: Y_phosphatase2 Pfam Description: Tyrosine phosphatase family
  misc_feature: SWISSPROT Homolog: EC 3.1.3.48 Protein-tyrosine-phosphatase
MKLEVMPKQRVLEAEQREEAMEMSGLELWKHEKPPRICPMPSLIPPPAACDCDEAALVPPLNFAMVDDGIFRSGFPETSNFRFLKSLNLRSIVYLCPEPYPETNTEFLEENGIKLHQFGIEGRKEPFVEIPDDKIREALKVVLDPRNQPLLIHCKRGKHRTGCVVGCLRKLQKWCLSSVFDEYHRFAAAKARITDQRFIELF

SEQ ID NO: 17528 - DNA, 1053 bp, Panicum virgatum
  misc_feature: Ceres CLONE 1792661
  misc_feature: Encodes the peptide sequence at SEQ ID NO. 17529
gggatttcacgccactcgcttcctccccccgcatctcacgtgcccaccgcctgctcgatgcaattccccactcgcccaccaacctccccgtgcccgatgtccaccacggcggccaccgccaccgccgtggcgtccccctccacctccacatcgtcaactcccctcctcccccgccgcggccccctccctcccgcctccacgcccgcccgctgccgcctcctccccacgccgccgccgcggtggcgcgcgcgcctcgacctcgcgcgccgggtggccgtcggcagcgacgtgtcctcgtaccctgacgtggccgccgaggaggccgccgccgcgcgcaaggtcgggaagcgcgtgcgcgtcacggcgcccgtccgcgtccaccacgtcgccagggcgccggggctagacctgcgcggcatggagggcgtcgtcaagcagtacgtcggcgtgtggaagggcaagcgcgtcacggccaatctccccttcaaggtggagttcgagctcaagcctgacggtcaggacaagccggtccggttcatcgcccacctccgcgagcaagagttcgagatcgtcggagacgagtagagctcttggttacagaataacgcgctctctgcggcggccgtggcatctgtatactatcgtttctgtgcgagaggaggaggatgtcgagggtgtgaggagattgcagctttgcaagtaagttgccgtttgtttacttgtttgcggtgtgcttctccctctcctccctacagcatcgaatttttcagatgtgacaattattcgaatgcttgtactctatatgatcaaaagtaattaaactgatgaatctgttaccgactgtatcgagcattttgttctattgattgttaggacaaaatgttactactagcctactaggagtgagcgatactgtgatatatgattgaaagtactcctagaggctagtaggctagtagttaaatctgtttgatgatggaatgaacttgatcttggcccaacgtggcctatgtgttccaagtaaaataaagaagccaacataccttctgatag

SEQ ID NO: 17529 - protein, 162 aa, Panicum virgatum
  misc_feature: Ceres CLONE 1792661
  misc_feature (82)..(155): Pfam Name: FeThRed_A Pfam Description: Ferredoxin thioredoxin reductase variable alpha chain
MSTTAATATAVASPSTSTSSTPLLPRRGPLPPASTPARCRLLPTPPPRWRARLDLARRVAVGSDVSSYPDVAAEEAAAARKVGKRVRVTAPVRVHHVARAPGLDLRGMEGVVKQYVGVWKGKRVTANLPFKVEFELKPDGQDKPVRFIAHLREQEFEIVGDE

SEQ ID NO: 17530 - DNA, 672 bp, Panicum virgatum
  misc_feature: Ceres CLONE 1792668-R
  misc_feature: Encodes the peptide sequence at SEQ ID NO. 17531
ggctgagtgtgtcactggcgggtcctgatggtcgtctcttgggtggtggagttgcaggacttctcatagcagcttcaccaattcagatagtattgggaagcttcagttctgaaggcaaaaaggcgccaaaacagcatgctccttcagaccctgcatcagcaccactgaaggtcgccccgaccacctctatgcgacccaacagccccccttcaagaggcacattgagtgaatcatctggtgggcctggaagtccaccaccacagcatcaaggcatggctgctagcaacactaatcaaccaccaatcatgtccagcatgccctggaaatgagctctgcatccttgaccaaattcaggcaggctcaggtctacgattggtgaactgccttccaggagggagtagcaatttgcgcttcaatagtgctcgttctctgacaagcttatatgtagtgcaattcggagcttgagtagtgagagtactgtagccagaagtttgtagctctattgtaggttttcaccctgaattcatgtgctaggtagctgtctgttgtcatctagagatgatgtactgagcttgtgatccttggcagtgttatcaaatgtttatttagtcctatattcaatcaaatgttattaagtcctatgttcttccaattcaaattgatttgggctag

SEQ ID NO: 17531 - protein, 108 aa, Panicum virgatum
  misc_feature: Ceres CLONE 1792668-R
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
LSVSLAGPDGRLLGGGVAGLLIAASPIQIVLGSFSSEGKKAPKQHAPSDPASAPLKVAPTTSMRPNSPPSRGTLSESSGGPGSPPPQHQGMAASNTNQPPIMSSMPWK

SEQ ID NO: 17532 - DNA, 730 bp, Panicum virgatum
  misc_feature: Ceres CLONE 1792668
gtgctaggttagctgaaatctccctaatctgttcatctccctgggtggtgctagtgtgaccctgtgatgtcttctcctacctcatgagcttccagtctggaactgtggttcacaatccgtagtcctgacctcagttgagcgctcgtgagctcgcgccgctgattaaagattgcagctatcagttctagtccaagaaacgagtgcttctccgccatggaggtgaggtccgagcaagggctgatggcgggcagggatctgtttggcatgcccaagagcccgccagcgccgccggcgtccgcagccatgcagagcgtgcgcatggcgcacaccgcagacggcacccctgtcttcgccccggtaacctcggcagcgccgccgtcttatcagccgcaggttgcggtccacgggcctagcatgtccactgcggcggtcactggaggcaatggcgccatggcgtcaccgggcataagtgagccagtggccaagaagaagcgcgggcggccaaggaagtatggacccgatgggtccatgtcgctggcattggtgcctgcatcgtcggctacagggtcgtcggcgatggggcagggttcttccgggcctttctcactggtggggccaaatccggcgaactctgtgccaggggtgtcgccgtacggaatgaagaagcggggccgacccaagggttctaccaacagccgcgcatggatgctcttgggtcatcaagagttgg

SEQ ID NO: 17533 - DNA, 1584 bp, Panicum virgatum
  misc_feature: Ceres CLONE 1792672
  misc_feature: Encodes the peptide sequence at SEQ ID NO. 17534
tgagcacgtgtataaatgtattactttctctggacatgcatgggtggatggatgggttgtaacttggaacggttaatttgttacttggatggagttaattacttgggaacaaaaaacccaatccatccaaacccatttccctccctccctccaatcccgccccccttccttcccagtttccactgcctcctcccccgccgccgccggtgatccccgtcgccgcggaccaccagccatgtcttgctcccacctctccaccgcctggtcctcctcggcgctggccagcagcgcctcctccacccggcggcgctcctccgccccgcgctccggcggcagcggcttcgtggtgcggtgctccctccgcgagctccgcaaccgcatcgactcggtccgcaacacgcagaagatcaccgaggccatgaagctcgtggccgccgccaaggtccggcgcgcgcaggaggccgtcgtctcgtcccgccccttctcggaggccctggtcgaggtgctctacaacatgaaccaggagatccagacggaggacatcgacctgccgctgacccgcacccgccccgtgaagaaggtcgccctggtggtcctcaccggcgagcgcggcctctgcggcagcttcaacaacaacgtgctgaagaaggcggacacccgcatcgaggagctcaagcagctggggctcgagtacaccgtcatcagcgtggggaagaagggcaacgcctacttcacgcgccgcccctacatcccgctggagcgggagctggaggtgaacggcgtgcccacggtgaaggactcgcaggccatctgcgacctggtctactccctcttcgtgtcggaggaggtggacaaggtggagctgctctactccaagttcgtgtccctggtgcgctccgaccccatcatccagacgctgctgcccatgtcccccaagggcgagatctgcgacgtcaacggcgtctgcgtggacgtcaccgaggacgagctcttccgcctcaccaccaaggaggggaagctcaccgtcgagcgcgagaaggtgaagatcgagacgcagcccttctcccccgtcgtgcagttcgagcaggaccccgtgcagatcctcgacgcgctgctcccgctctatctcaacagccagatcctccgcgccctgcaggagtcgctcgccagcgagctcgccgcccggatgagcgccatgagcagcgccaccgacaatgccatcgagctccgcaagaacctctccatcgcttacaaccgccagcgccaggcaaagatcaccggggagatcctcgagatcgtcgccggtgccgacgccctcgccggctgagctgaagccgtcctcctcgctctccttaacactgagccaagctgagccggtggtggcgtacgttcttcgtgtggtgctcctgctatatatagttctttttctcacttttcttgctgttcagtctgtctgtaattcctgatagcacaaacacgagggagtaatgtgttccatgctcgtcgtgatgccatgccgcgcgagatacacaagaatttaaattcagagatgccaaatgtataatccgagtaactttatcttgc

SEQ ID NO: 17534 - protein, 363 aa, Panicum virgatum
  misc_feature: Ceres CLONE 1792672
  misc_feature (40)..(361): Pfam Name: ATP-synt Pfam Description: ATP synthase
  misc_feature: SWISSPROT Homolog: EC 3.6.3.14 H(+)-transporting two-sector ATPase
MSCSHLSTAWSSSALASSASSTRRRSSAPRSGGSGFVVRCSLRELRNRIDSVRNTQKITEAMKLVAAAKVRRAQEAVVSSRPFSEALVEVLYNMNQEIQTEDIDLPLTRTRPVKKVALVVLTGERGLCGSFNNNVLKKADTRIEELKQLGLEYTVISVGKKGNAYFTRRPYIPLERELEVNGVPTVKDSQAICDLVYSLFVSEEVDKVELLYSKFVSLVRSDPIIQTLLPMSPKGEICDVNGVCVDVTEDELFRLTTKEGKLTVEREKVKIETQPFSPVVQFEQDPVQILDALLPLYLNSQILRALQESLASELAARMSAMSSATDNAIELRKNLSIAYNRQRQAKITGEILEIVAGADALAG

SEQ ID NO: 17535 - DNA, 1355 bp, Panicum virgatum
  misc_feature: Ceres CLONE 1792682
  misc_feature: Encodes the peptide sequence at SEQ ID NO. 17536
cttgccttatctccccgagccattaccagcggcggctggaaccgggggagccccgtcgccggccacgccccaccgcccgcgcgcgtcgggcggcatcccatcgtcgctgggtacgcggtgtcggagcccgccgcccccgcttgcggcgcccggagcgcccgcagcgcaccgccgacgccggccggcgatttccccgcgccgcgccctagactcgcagatccgccgacgtcccaggaagcagaacttatggggaaggaacaaattgtagctgttcttcaaataggtggagaattcaccaccgatgcagatggacacatgtcttattctggtggagaggcacacgcaatgcttgtccaaagtgactggacttttagtacatttaagcaagagatatcatcgacacttaacaacctgaaacttgatcagttcgcattcaagtatttccttccaaagaatgataaaaccttgatttctatttccaatgacaaggacctacgccgcatggttgaattccatgcagagtcagaaacaacatacatttatgttatgaagaaagctgacaacaggtcaaagagcattgttcctgtctcggatgctgctacagatgcctttgctgttgtcccaacaactcaggatgggtctaaaagacaaaaggtttgtgcaagttggaagaatgtgataactggagttggccaagtgtttgaaggtcctaaggatttccgtgatgccttacataagtatgccatcgcgcatagattccattacagatttatcaagaatgattcatctcgtgtgactgctgcatgtactggtgaagattgcccatggcgaatacatgcttctaagtcccctgcaaagaaagaattcatgatcaagaaaatatctgaaagccacacctgtgaatcagaaacagtaaaaagtcatcggttggcttctcaacgatgggttgctagtgtcataaaagaaaaattgcgtgatagtccaaactacagaccaagagatattgcaaatgatcttcaacgtgagtatggactatgcctgaactattcacaggcttggcgtggtagatcaattgctcaaaaagaactttatagctcacatgaagaggcatgcagtcagctaccttggttttgtgaaaggattgtagagaccaaccctggaagtgtggcaactgtagtggctttggaagattcaaagttccgattcttcgttgcattccatgcgtcactctatggttttcagcatgggtgcaggccactcctttttcttgatgcaattactgcaaagccaaataagcattggaagctactggctgctacatcggttgatggtgaaggtgatgtgttcccagttgc

SEQ ID NO: 17536 - protein, 369 aa, Panicum virgatum
  misc_feature: Ceres CLONE 1792682
  misc_feature (103)..(278): Pfam Name: MuDR Pfam Description: MuDR family transposase
  misc_feature (19)..(103): Pfam Name: PB1 Pfam Description: PB1 domain
MGKEQIVAVLQIGGEFTTDADGHMSYSGGEAHAMLVQSDWTFSTFKQEISSTLNNLKLDQFAFKYFLPKNDKTLISISNDKDLRRMVEFHAESETTYIYVMKKADNRSKSIVPVSDAATDAFAVVPTTQDGSKRQKVCASWKNVITGVGQVFEGPKDFRDALHKYAIAHRFHYRFIKNDSSRVTAACTGEDCPWRIHASKSPAKKEFMIKKISESHTCESETVKSHRLASQRWVASVIKEKLRDSPNYRPRDIANDLQREYGLCLNYSQAWRGRSIAQKELYSSHEEACSQLPWFCERIVETNPGSVATVVALEDSKFRFFVAFHASLYGFQHGCRPLLFLDAITAKPNKHWKLLAATSVDGEGDVFPV

SEQ ID NO: 17537 - DNA, 644 bp, Panicum virgatum
  misc_feature: Ceres CLONE 1792682-R
taaacaaattggaatgcacctgccgaaagtggtatgtttctgggttgccatgcatgcatgcaatcgcagtatttgagcgcaccggacaatatccatatgactactgcctgaagtacttcacaacggaattctaccgcttgacctactccttgtcaataaaccccataccagatgttgttgtgcctactacattaactgatccagctcagagcccagcagcatacccatgtccaattcgaacccgtcgccgtgttggccggcccaaagagaagccagctgatcctcgcattgcaattaagagggcagtgcgctgcagcaggtgtaagggttatggccacaataaggcaacttgcaaggttccgatcagcatgtagtcttggttcagctatgcaatgtacattaaggcagagttgatggcattattctctgcaatgctagtgtttctgcttcttttgatagactctgatatatgctctacagctctggtgttgatttttaagctccgaattgctttttattttgtccattgcgtaggctaactgtactcagtttgtgaagtaaacattgtagccaacactggggaaagccttggagggtatgtgttgtactgcaacccagctatacagtctgctcattctctttcc

SEQ ID NO: 17538 - DNA, 1031 bp, Panicum virgatum
  misc_feature: Ceres CLONE 1792688
  misc_feature: Encodes the peptide sequence at SEQ ID NO. 17539
gctgccccgcaggtcgcagtccgcctcggcctcttcgtcctcccccagtcgcagcagccgtcgccgtcgccgctgctcggccccgcgccggatcgagggagggaaggggagcgccgcggaccgggaggaggcgggatgagtctcttcgggctcggacggaaccagaggacattccgccccaagaagagcgctccgtcaggcagcaagggtgcacagctccgaaagcacatagatgccactctcggcagtgggaaccttagggaagctgtgaggctgcctcctggagaggacattaatgaatggcttgctgtgaatactgtggatttctttaaccaggttaatctgctgtatggtacgctcacggaattctgcacacctgagagctgcccaacaatgactgctggcccaaagtatgagtacagatgggctgatggtgtacagataaagaaacccatagaggtatcagcaccaaaatatgtggagtatctaatggattggattgaaggccaacttgacgatgaatccatatttcctcaaaaacttggcacaccgttcccgccaaacttcaaggaagtagtgaagacaatattcaagcgcctgtttcgtgtttatgcccacatatatcactctcactttcagaagattgtcagcctcaaggaggaggctcatcttaacacctgcttcaagcacttcattctgttcacaaatgagtttggcctggttgacaaaaaggagttggctccactccaggagctcatcgaatccatcatcgttccttactgagaggaatgctcggacggtgctaaaaacggatctggagctctcgatgctgatggctgagatattagtctgtttgtgacaatacttcactggcatagagcttgttgttccagttattaggcatataaaaagaaaggagacttgacattgctaatgctgtatttgcttgtacccgtgttttctccctgattcctatattggccatgtaagtgtgcctgtaagaaaagattgtatcagctgcgtgaggtgct

SEQ ID NO: 17539 - protein, 215 aa, Panicum virgatum
  misc_feature: Ceres CLONE 1792688
  misc_feature (29)..(205): Pfam Name: Mob1_phocein Pfam Description: Mob1/phocein family
MSLFGLGRNQRTFRPKKSAPSGSKGAQLRKHIDATLGSGNLREAVRLPPGEDINEWLAVNTVDFFNQVNLLYGTLTEFCTPESCPTMTAGPKYEYRWADGVQIKKPIEVSAPKYVEYLMDWIEGQLDDESIFPQKLGTPFPPNFKEVVKTIFKRLFRVYAHIYHSHFQKIVSLKEEAHLNTCFKHFILFTNEFGLVDKKELAPLQELIESIIVPY

SEQ ID NO: 17540 - DNA, 2162 bp, Panicum virgatum
  misc_feature: Ceres CLONE 1792693
  misc_feature: Encodes the peptide sequence at SEQ ID NO. 17541
aggtgaagagagtgctccactgcacagaaagcctgtccctgccgttcgcttgtgcctacagagtgcgagagagatggatgagcggtttgccgtgaccgcagcgaccggggcattggggccggtccaggtgaagctcgctgctttgctgggtgatgagtacaagcttcaggagagaacccggcgaggcatcgagtccatcaaatccgagctcgagacagttcaccatctcctggggaagctatgggggagggaggatcttgatgtggcatgcaaggatcggatggcggaggccagggagctgtcctacgacatggaggacggcattgaccgcttcactctcggtttggcgcctggtgagggcggcttcatccagcgggagacaacggatgacggccctttgaaggaattcatggaaaagttcaaaggtgtatcaaagtggtgcgacgaaattcagaagattggcgacaccatcatctgcaaccgtagcaagctgaccaccgatcctcgagctctcttcctccacaaggatgtatcggagctcgtgggcatggaacgaaaaaaggagaagctcatcaaattgctgcaagagcacgaaatggtatgtattgttggatctgcagggatgggcaaaacaactcttgcagatctggtgtatcagacaataggagatcaattccaatgccgggctttcgtgtccgtgcacccaagtcctaacatgatggagattatgggtgctatcctcagccaagtaacagatgttggaacgtctgctggcagtggcaccgaatccgcagccgaacacaatatcatcaccgacatatcaagttccctctctgaaaagagtggcactgaacctgaagcccagcaaaatgatgtcatcaaaggcatatcaaatttcctctctgacaagaggtacatggtcataatcgatgatatttggcactgggaagaatgggaagtcatccgaaaggccctccccaagaataatctgcgctgtaaattaatcatgacgacccgggtcaggagtatagctgagaaatgtgaaactgaacaaggtgcaggtgtgtacacacagtattttggtcgtgcggacgccgcaaggctatcagatatgagactgagcaaatctgtcgagggaaccaacgcgaaggggctgtccactaagattgtggatatgtgtcgctggccgccattttatttttgtccgctagcagtaatctgtttgtcgtcagcatgggcagagagccaccatgtgcaaggtggtgatggggaatacgagtatgatacatgggcaagccacgtgctgtatgatggatttctgatcactccatccttgaaaccactggtccagagtctatgccttggtttcgacgatcttcccgttcagctgaggacttgcttgctatactgtaccatatatcctccggagtatatgttttataagggatgcttggtgagaagatggattgccgaaggatttgtttcgcaagttgaagtagcaaattcttaccttgaggagctcgtctccagtaacctgctgcagcattacagtgggaagtacacagttcaccccatcatgcgagccttcctcgtgtgcaaagcaaagcaagataattttattgcttattacgaggggcccggtaactcctcgcatgccaaacagcagattcgtcgtctttatgtcaccacgggtcgctatccaccaggtgaggatgtgctgtctcatactcgctcccttgttgtttgtggtcaccaatgccagctggatttcaaggcgttcaaaaagctgcgagtgctacaaatagtacatggaagcagcagtcatctacagaatggtcatctggtggatatatgtgggctgatctgtctcaagtatgtggagcttcttggctgcgatcaaatcacagagctccctcgggagattgggagactgcagaatctggagaccctgcgcgtggcaggtacacatattagtaatctgccaacggaaatcaagaaccttgagcgcttggagactctggatataagctggacacgggtgagagagttgcctaaggaaatcagaaagctgcagcatttgaggactctgtacatgagaggtacaaatgtcagagagctaccctgggaagttcaaaactcgataataaatgtgtttgttggtg

SEQ ID NO: 17541 - protein, 696 aa, Panicum virgatum
  misc_feature: Ceres CLONE 1792693
  misc_feature (139)..(475): Pfam Name: NB-ARC Pfam Description: NB-ARC domain
  misc_feature: SWISSPROT Homolog: EC 3.1.13.4 Poly(A)-specific ribonuclease
MDERFAVTAATGALGPVQVKLAALLGDEYKLQERTRRGIESIKSELETVHHLLGKLWGREDLDVACKDRMAEARELSYDMEDGIDRFTLGLAPGEGGFIQRETTDDGPLKEFMEKFKGVSKWCDEIQKIGDTIICNRSKLTTDPRALFLHKDVSELVGMERKKEKLIKLLQEHEMVCIVGSAGMGKTTLADLVYQTIGDQFQCRAFVSVHPSPNMMEIMGAILSQVTDVGTSAGSGTESAAEHNIITDISSSLSEKSGTEPEAQQNDVIKGISNFLSDKRYMVIIDDIWHWEEWEVIRKALPKNNLRCKLIMTTRVRSIAEKCETEQGAGVYTQYFGRADAARLSDMRLSKSVEGTNAKGLSTKIVDMCRWPPFYFCPLAVICLSSAWAESHHVQGGDGEYEYDTWASHVLYDGFLITPSLKPLVQSLCLGFDDLPVQLRTCLLYCTIYPPEYMFYKGCLVRRWIAEGFVSQVEVANSYLEELVSSNLLQHYSGKYTVHPIMRAFLVCKAKQDNFIAYYEGPGNSSHAKQQIRRLYVTTGRYPPGEDVLSHTRSLVVCGHQCQLDFKAFKKLRVLQIVHGSSSHLQNGHLVDICGLICLKYVELLGCDQITELPREIGRLQNLETLRVAGTHISNLPTEIKNLERLETLDISWTRVRELPKEIRKLQHLRTLYMRGTNVRELPWEVQNSIINVFVG

SEQ ID NO: 17542 - DNA, 2709 bp, Panicum virgatum
  misc_feature: Ceres CLONE 1792694
  misc_feature: Encodes the peptide sequence at SEQ ID NO. 17543
aaatcagagtgctagcttgcccaattctccaatccgagcgtccgtgaggtctcatcctatccccagttcgaccctagcgcgcctgttttttgttctagggtttgctgttttggtccggggatctagggtttgcctgcggatttcgccgtgaattttgggggtccagttgttttgcccggtcccgggtgatccctgcttgcgccccatggctgcggcgcggcacgcgagctacaggagccatgatggggcgagggggcgggagctcgacttggagcgctccaggaggagcaaggagtatcgtcatcgccacccgagccacgaccgcgactcggaccaccgccgcgacggcggccgcagcgggggccgcgacggcgggcaccgtcgccaccgctcgccgtatccgccaccgaggagctggccttcaagaagggagaatgatagggagcctggcgaggtctcaagcggcagcgcctcggattctggtgggcgcccattgaaggctggggtaccgagggaggatggttttctgggagtttgcaaggacggcagtgcgttaccactaagtacgaagaggaagcactcacctgtagtcctggatgcccatgtctcaaagttgcaggccatagatgatgtgaggagcgggggagtggtagacaccgcagcagtggagttccctttgccttcaccacctcctttatcagatgatagttctgtggccacgtttggtgggtgctcaagcccaacaaagcatttggatgtttcaatggttctgcatgagcccgaattttctcatgaacatgagaagaatggggttatggtgggggaagaggagtgcccaacaacgagaaacatctttacttcaagatgggcagaagctgatgacgaggaagaagtgattgtgcccaaaaagaagaaaagtgtctctcctactaacttgtctgaacatagatctacacagaaagttacaatcccagagcttggagaagtgctgcgggttcaaacatcaagagaaagctcctcaagttcatctaactccatgggtagtgaaaactggaatatcaaggtagacgggggtgactgcatgtatgttaaggaggatgtcattgattcttctgttggttactcggtggatactcattttgagagtgatgcacgcaggtctagaacacctgaggctgtatgtccaccacgtaggtgctttaacatgcttcagggctgtaggaatattgatgagtttgagaggctcaacacaatcaatgagggtacatatggagttgtttttagggtgaaggacaagaaaactggtgagattgttgcattgaagaaggtcaagatggatagggaacgggaaggttttccattgacctctcttagggaaataaatatcctcttgtcctttgaccacccttctattgtggatgtcaaggaaatagttgttggtggacatgatgatgatactttcatggtgatggagtacatggagcatgacctgaagggtgtcatggagacgatgaagcaaccatatacccaaagtgaggtcaaatgtttgatgcttcagctgctagaaggcgtgaagtatcttcatgacaattgggtcctgcacagggatctcaagacatcgaatctcctcttgaataaccgtggtgagttgaaaatatgtgattttggactctctcgtcagtatggcagcccgctaaaaccttacactcaaccagttgtgactttgtggtatagggctccggagctgcttttaggagcaaaagagtattctactgctattgatatgtggtcattgggttgcataatggcagaactcttatcaaaagagccactcttcgcagggaaaaatgagatagatcaacttcataaaatatttagaatacttggcacacccaatgaggagcggtggtgtggttattcaaaattgcccggtgccaaatgcaaatttgtaaagcaaccgtacaataggttaagggacaagtttccagctgtatccttcactggagggttgaccttgtcagaagctggatttgacctgctaaataggttgttgacatatgaccctgagaagcgcatatctgcagatgatgccttgaaccatgagtggttccgtgaggttcctttgcccaaaacaaaggatttcatgccaacttttcctgctctgaatgaacaagacaggaggatcaagaaatacatgaagagccctgatccactggtggagcaacagatgaaagaacaagggagctcaggagatcgtggtctttttggttgatctgaaaccagatttgggcttgctgcagtaatccagtttccagtgtgaataattgtgagtacacgtgccaaggtgaggtgtcccgatggacatgaaagtacctgtccacttagtttgcggtgacaactgattctgttccatagcaggcacatgatcagaagggaataaaatatttcattgtggtccattgagctagtattcaaatgtcaggcttaagtctcttgtcagaactcaggtcacattctaatccaccatcattttaaggtgtagattcagttcactttcaatttcatctgaaggttgggccgattgggtacaccggtttcacctctgaaacttctttgtgtaaaatatcatatatcgttgccttgtaatcagtaatcaatgagatattaatgacatcctattcaagtagttcatctttctttggtctttcc

SEQ ID NO: 17543 - protein, 688 aa, Panicum virgatum
  misc_feature: Ceres CLONE 1792694
  misc_feature (344)..(635): Pfam Name: Pkinase Pfam Description: Protein kinase domain
  misc_feature: SWISSPROT Homolog: EC 2.7.11.22 Cyclin-dependent kinase
MAAARHASYRSHDGARGRELDLERSRRSKEYRHRHPSHDRDSDHRRDGGRSGGRDGGHRRHRSPYPPPRSWPSRRENDREPGEVSSGSASDSGGRPLKAGVPREDGFLGVCKDGSALPLSTKRKHSPVVLDAHVSKLQAIDDVRSGGVVDTAAVEFPLPSPPPLSDDSSVATFGGCSSPTKHLDVSMVLHEPEFSHEHEKNGVMVGEEECPTTRNIFTSRWAEADDEEEVIVPKKKKSVSPTNLSEHRSTQKVTIPELGEVLRVQTSRESSSSSSNSMGSENWNIKVDGGDCMYVKEDVIDSSVGYSVDTHFESDARRSRTPEAVCPPRRCFNMLQGCRNIDEFERLNTINEGTYGVVFRVKDKKTGEIVALKKVKMDREREGFPLTSLREINILLSFDHPSIVDVKEIVVGGHDDDTFMVMEYMEHDLKGVMETMKQPYTQSEVKCLMLQLLEGVKYLHDNWVLHRDLKTSNLLLNNRGELKICDFGLSRQYGSPLKPYTQPVVTLWYRAPELLLGAKEYSTAIDMWSLGCIMAELLSKEPLFAGKNEIDQLHKIFRILGTPNEERWCGYSKLPGAKCKFVKQPYNRLRDKFPAVSFTGGLTLSEAGFDLLNRLLTYDPEKRISADDALNHEWFREVPLPKTKDFMPTFPALNEQDRRIKKYMKSPDPLVEQQMKEQGSSGDRGLFG

SEQ ID NO: 17544 - DNA, 1827 bp, Panicum virgatum
  misc_feature: Ceres CLONE 1792707
  misc_feature: Encodes the peptide sequence at SEQ ID NO. 17545
acggacacacccacccttcgtcactcgactcgagcacctactttccgtctctcatcccttttcatgattacctcacctcacccaaaaggttccggtgacatggcggacaaagcatcttgttcttgcatgcaattcaacaattattcttgtacccataaaattggattgaattaaaatgtggcattacattcttcgtcttgtttgggtgctggatgtgtctaaatctgcaggcggccgctcgacatcgactacttacacagcacgagcagcagcaagaggacgccggggaaggagaaagtggccacgccggagtccccggcgccgactgccgcggcggccaactacttgaagaaaggcgacgacaatgctgctgtcgcggcggccgccgccgccgccacgggaggcagcaactacaagctgttcagcgagctggaggccatctacaagccagggagcagcggcgcccagacgggctccggctccggcctcaccggcgacgacaatgccatcctggacccggcaatggctgccgacctcccgggcgtggcggccccggacgcgccgcaggtcaacacatcggagacgtcggccggggaggaggcggcggcggtggtgcagccgccggcgccggcgccggcggacgcggcgcggcgcaagcgcaagcggcggcggcaggagcagctgagcgcgtcggcgtccttcttcgagcggctggtgcagcggctgatggagcaccaggagagcctccaccggcagttcctggacgccatggagcggcgcgagcgggagcgcgccgcgcgcgaggaggcgtggcggcggcaggaggccgacaagctggcccgcgaggcgagcgcgcgcgcgcaggaccgcgccagcgccgcggcgcgcgaggcggccatcatcgcctacctggagaagatctcgggcgagtccatcgcgctcccgccgccagccgcggcgtctggcgacgacacgagccagcaggacgcggcggccggcaaggagctggtgccctacgacggcggcggcggcgtggggtcgtcgtcgccgcacctgatgagctcgtcgcgctggcccaagcacgaggtggaggcgctgatccgggtgcggacggggctggaggggcggttccaggagccggggctcaagggcccgctgtgggaggaggtgagcgcgcgcatggcggcggcggggtacggccgcagcgccaagaggtgcaaggagaagtgggagaacatcaacaagtacttccgcaaggccaaggagagcggcaagaagcggccggcgcacgccaagacgtgcccctacttcgacgagctcgaccgcctctactcgcgcaacaatgccagcaacgccggcggcggcgccggcgacgaggccaaggcgagctcggagctgctggacgcggtggtaaggtaccccgacgcgcacggcggcccgccggggttcatgttggacagtggggagcatcagaacgaggcctccggaggcagagaggtgggcgcggccggcgaagaggaggacggcggcattgccaaggggagggccgccgacgatcaggatcaggatcaggatcaggatcaggacgacgaggtggagagccatggcggccatgatgatgacgatgagtagctataggatatagctagctagctgagctggatccatggatctctctaacatgcatggagtcagtagctgcgggcacgccatgcatctccttgttaatttgcttattgatctgtttctttctttctttatttcttgttaattagctgttgttactagctacttatacattagcactactgctactactactactcc

SEQ ID NO: 17545 - protein, 369 aa, Panicum virgatum
  misc_feature: Ceres CLONE 1792707
  misc_feature: The sequence is a functional homolog of SEQ ID NO 966 in the 11/479,226 US patent application
MAADLPGVAAPDAPQVNTSETSAGEEAAAVVQPPAPAPADAARRKRKRRRQEQLSASASFFERLVQRLMEHQESLHRQFLDAMERRERERAAREEAWRRQEADKLAREASARAQDRASAAAREAAIIAYLEKISGESIALPPPAAASGDDTSQQDAAAGKELVPYDGGGGVGSSSPHLMSSSRWPKHEVEALIRVRTGLEGRFQEPGLKGPLWEEVSARMAAAGYGRSAKRCKEKWENINKYFRKAKESGKKRPAHAKTCPYFDELDRLYSRNNASNAGGGAGDEAKASSELLDAVVRYPDAHGGPPGFMLDSGEHQNEASGGREVGAAGEEEDGGIAKGRAADDQDQDQDQDQDDEVESHGGHDDDDE

SEQ ID NO: 17546 - DNA, 1698 bp, Panicum virgatum
  misc_feature: Ceres CLONE 1792708
  misc_feature: Encodes the peptide sequence at SEQ ID NO. 17547
acgagcgagcgtttggaggacgggcgggaagcctgcagtgcgcggcgcagaaaccctagctcctcgcccgcttcttctctccaggtgctctcctgcctcgcagatcccgtgggcgtgatgagggtgaaggtgatatcgcgctccacccaagagttcacgcgcgaccgcaggcaggatctgcagaaagtattccgcaactatgatccagcacttcgtagtcaagagaaagccgttgagtacactcgggcacttaatgctgcaaagttagagaagatatttgctaagccatttattggagctatggatgggcatattgatgcagtatcgtgcatggccaagaacccgaatcatttgaaagcaatattttctggttcaatggatggagatattcgcctttgggacattgctgcgaggaagacagtttgccagttccctggacaccaaggtgccgtaagaggtctaacaacatctacggatggtgatcttcttgtatcatgcggcgtggactgcactgttcgactatggaaagttccaatgcttaaaatggtggacactagtgatcatactggagatacttcccagccatcagcagtctatacctggaagcatgcattctggggtgctgaccaccagtgggatggtaatctttttgctactgttggtgctcaagttgatatatgggatcctaacaggtcggagccaataaataactttgaatggggtaaagatacagttctttctgtgcgctttgatcctggagactgtaatattttgattacatcagccagtgatcggagtctaacactttatgacctacgcatgtcatctccagctagaaagctaataatgaagacaaggtgcaattcagtatgctggaaccctagggagcctatgaacttcactgctgcaaatgaagacacaaactgctactcctttgatgctagaaggctagatgaagccaaaattgttcacaaaggccatgtttcagcagtgatggatattgactactcaccaactgggcgggaatttgttactggttcctatgatagaacagtaaggatttttaattatcttggtgatcatagcagagagatttaccacaccaagaggatgcaaagggtattttgtgtgaagtacacctacgacgggacatatctagtctctggcagtgatgatacaaatcttcggctatggaaatccaaagcttcggaacaacttggagttcttcttccacgggagcgcaaaaagcaagaatacctggatgctgtgaaggagcggtataagcacctcccagaagtgaagcggattgtgcggcatagacacctgccgaagccaatctacaaggcggcgaacctgcggcgcacgatgattgaagccgagaaccggaaagaggagaggaggcgaaagcacagcgctccagggagcatgcccgtgcagcccttcaggaagcgaaggatcatcaatgaagttgagtaggctgtttctgctggcctccaaacgtctagtagttgtcgtggagattgctgtggtgtatgttgagaatgcgtccgatgagagttgggaccgctagctgaaattttgcactgttgtttacgtatatgcatggtgtatccagattgtttttgaattccaaaaactttctcctatagatgagagcgagcagtttttaccactgtaataaagaaggaattcgcgatt

SEQ ID NO: 17547 - protein, 452 aa, Panicum virgatum
  misc_feature: Ceres CLONE 1792708
  misc_feature (361)..(448): Pfam Name: Sof1 Pfam Description: Sof1-like domain
  misc_feature (99)..(137): Pfam Name: WD40 Pfam Description: WD domain, G-beta repeat
  misc_feature (279)..(317): Pfam Name: WD40 Pfam Description: WD domain, G-beta repeat
  misc_feature (56)..(95): Pfam Name: WD40 Pfam Description: WD domain, G-beta repeat
  misc_feature (193)..(232): Pfam Name: WD40 Pfam Description: WD domain, G-beta repeat
  misc_feature: SWISSPROT Homolog: EC 2.3.1.48 Histone acetyltransferase
MRVKVISRSTQEFTRDRRQDLQKVFRNYDPALRSQEKAVEYTRALNAAKLEKIFAKPFIGAMDGHIDAVSCMAKNPNHLKAIFSGSMDGDIRLWDIAARKTVCQFPGHQGAVRGLTTSTDGDLLVSCGVDCTVRLWKVPMLKMVDTSDHTGDTSQPSAVYTWKHAFWGADHQWDGNLFATVGAQVDIWDPNRSEPINNFEWGKDTVLSVRFDPGDCNILITSASDRSLTLYDLRMSSPARKLIMKTRCNSVCWNPREPMNFTAANEDTNCYSFDARRLDEAKIVHKGHVSAVMDIDYSPTGREFVTGSYDRTVRIFNYLGDHSREIYHTKRMQRVFCVKYTYDGTYLVSGSDDTNLRLWKSKASEQLGVLLPRERKKQEYLDAVKERYKHLPEVKRIVRHRHLPKPIYKAANLRRTMIEAENRKEERRRKHSAPGSMPVQPFRKRRIINEVE

SEQ ID NO: 17548 - DNA, 2468 bp, Panicum virgatum
  misc_feature: Ceres CLONE 1792714
  misc_feature: Encodes the peptide sequence at SEQ ID NO. 17549
gtctcgcgggggctcgtggcaagcacagccagcagcggtaggggtggagggagctcggcgtccgctgctgtttcggcaaagccagccagcacccgcccccgccctcggagctcgagctgccggtccccagggccgccgccgctgccgccatggagcagcagcacggcgcgccgccgccgggcgcgcacgagatcgagaagacgccctccggccccgccgcgccggacatggagtcggagcccgcggcggcgcgcgcggcggagcgcgtcccgccgtggcgcgagcagatcaccgcgcgcggcatggtggccgcgctgctcgtgggcttcgtcttcacggtcatacagatgaagatcagcctcagcacggggctcaaccccacgatgaacgtctccgccgcgctgctcgccttcctcgcgctccgcggctggacgcgcgccctcggccgcctcggcattgcctgccgccccttcacccgccaggagaacaccgtcgtccagacatgcgtcgtcgcctgctacaccatcgcatacggcggtgggtttgggtccttcttgttgagcctgaacaagaggacgtacgagcagtccggcgggtccagcacgccgggcaacgcgccggcgagctacaaggagcccgccatcggctggatgatgggattcctcctttccgtctgcttcgtcgggctcctcaccttgcttccaatcagaaaggtgctcgtgatcgattacaaactaacttatccaagtgggactgctactgcggttctcataaacgggttccacacacctcaaggagacaagaatgcaaaaaagcaggtccgtggattcctcaaatacttcgggatcagcttcctttggagcttcttccaatggttctacaccgccggggacgcctgcggattcgttcagttccctacttttgggctcaaagcttggaagcaaacgtttttcttcgactttagtccgacgtatgttggcgctggcatgatttgctcgcaccttgtaaacctctcattgctctttggcgcgatcctatcctggggcatgatgtggccactcatcagcaagcagaagggcaactggtactctgccaaggcgtctgagagtagcatgatgagcatctacggttacaaggccttcctctgcattgctctgctggtcggagacgggctgtacaacttcgtcaaagtcatggtaatctctgtcaagaacatacgcgagagatcacatcgcaagagcctgaacagagtggcggacgcggacaccatggcgctggacgacctgcagcgcgacgaggtgttcaacaaggacaacatcccgacctggctggcctacacggggtacgccgtgctcggcgtcatcgcggtgatcatcatcccggtcatgttccggcaggtgaggtggtactacgtggtcgtggcctacctgctggcgccggtgctggggttctgcaacgcctatggcacgggcctgacggacatgaacatggggtacaactacggcaagatcgcgctcttcatcctggcggcgtgggcgggcagggacaacggcgtggtggccggcctggtggtgtgcggcgtggtgaagcagctcgtgctcatctccgccgacctgatgcacgacttcaagacgggccacctgacgctgacctcgccgcggtcgatgctggtcgggcaggccgtgggcacgctgatggggtgcatcctggcgccgcccaccttcatgctcttctacagggcgttcgacgtggggaacccggacgggtactggaaagccccctacgcgctcatctaccgcaacatggccatcctcggggtggagggcttctcggcgctgcccaggcactgcctgcagctgtgcgcaggattcttcgcgttcgcggtggcggcgaacctggcgcggaacctgctgccgcggcggctcgcgcggctcgtgccgctgccgatggccatggccgtgccgttcctcgtgggggccagcttcgccatcgacatgtgcgtggggagcctcgtggtgttcgtgtggcacaggctcgacagcaagaaggccgggctgctggtcccggccgtcgcgtccgggctcatctgcggcgacgggatctggacgttcccgtcgtcgctgctcgcgctggccaagatcaagccgcccatctgcatgaagttcacgccgggaagctagaaacgatatagacatcagtataaccaagggcaatgcgcccaatagccaatactacatacatacagatagagaggtattttcaaggaaggaagacctcgatctttttgggggaaattccagataaattcccaaaagaatccggcgtgctcttctgtacatatgagccggatcgtgcaccgtgtaaaattcatctaagatggaaattcgaaggacgacaggaagaaccccggtgttttcaaactttcaaataaatagcacactaatcggagacatgatctccacgttttc

SEQ ID NO: 17549 - protein, 676 aa, Panicum virgatum
  misc_feature: Ceres CLONE 1792714
  misc_feature (46)..(660): Pfam Name: OPT Pfam Description: OPT oligopeptide transporter protein
  misc_feature: The sequence is a functional homolog of SEQ ID NO 214 in the 10/412,699 US patent application
  misc_feature: The sequence is a functional homolog of SEQ ID NO 774 in the 10/412,699 US patent application
MEQQHGAPPPGAHEIEKTPSGPAAPDMESEPAAARAAERVPPWREQITARGMVAALLVGFVFTVIQMKISLSTGLNPTMNVSAALLAFLALRGWTRALGRLGIACRPFTRQENTVVQTCVVACYTIAYGGGFGSFLLSLNKRTYEQSGGSSTPGNAPASYKEPAIGWMMGFLLSVCFVGLLTLLPIRKVLVIDYKLTYPSGTATAVLINGFHTPQGDKNAKKQVRGFLKYFGISFLWSFFQWFYTAGDACGFVQFPTFGLKAWKQTFFFDFSPTYVGAGMICSHLVNLSLLFGAILSWGMMWPLISKQKGNWYSAKASESSMMSIYGYKAFLCIALLVGDGLYNFVKVMVISVKNIRERSHRKSLNRVADADTMALDDLQRDEVFNKDNIPTWLAYTGYAVLGVIAVIIIPVMFRQVRWYYVVVAYLLAPVLGFCNAYGTGLTDMNMGYNYGKIALFILAAWAGRDNGVVAGLVVCGVVKQLVLISADLMHDFKTGHLTLTSPRSMLVGQAVGTLMGCILAPPTFMLFYRAFDVGNPDGYWKAPYALIYRNMAILGVEGFSALPRHCLQLCAGFFAFAVAANLARNLLPRRLARLVPLPMAMAVPFLVGASFAIDMCVGSLVVFVWHRLDSKKAGLLVPAVASGLICGDGIWTFPSSLLALAKIKPPICMKFTPGS

SEQ ID NO: 17550 - DNA, 1348 bp, Panicum virgatum
  misc_feature: Ceres CLONE 1792717
  misc_feature: Encodes the peptide sequence at SEQ ID NO. 17551
atcacagaacctctcctccctctctctcccccaagcccccaaggcttgaagctctccagctagactgtcctgcttcggcgctactgtgcacagccatcgacagcacacagcagagtctatcctgtgggcactgagcagcagcagcagcaatggagaggcctgcgcaggcgcccaggcagctgccgccggggttccggttccaccccaccgacgaggagctggtggtgcagtacctccgccggaaggttctggctcgcccgctgccggccgccgtcatccctgtcgtccacgacgtcgccaggctagatccatgggacctccctggagcgagcgaaggggaggggtacttcttcagcctgcggcgagcgccggcgaccggccgcggcggccgcaggaggagagccggcagcgggtactggaagaccacggggaaggagacgcctgtgttcctgcactacggtggcaggcggcagctgctcgtgggcgtcaagacggcgctcgccttccatcgcagtgagccgtcgtcatcgtcgtcgcggacaggttgggtcatgcacgagtaccggctcgccgtgcctggcgacttggccatggcggagcagaggaagaatgcaaatcatggccgtgttgctgagccgggggagtgggtcgtgtgccgggtctctctgaagaacaggccaagaagcaggccaaaccgggatggcgacgggaaaactcctggaaaccgcacctccatcgcacaaggcgcggcgccgctgcagcaccgggaaggtgacggacggcagccgccgtcgctgttgatgtcgccacagccgtcgtcgtcaagctgtgtcaccggtgttaccgacatttcagaccaagacgaagtcagcagcatcagtgtcagagatgctccagcagactctcaaagagaggcctaggcgtgacgaacttgaagtttttgtttcctccctccgttgccagtacttatcctggtaccatacagtgatgggttaagcatcaggcaatcaggtccaaggcaaagtccagcccaagaacgatctcgagatatcaaacagttgtgtgccatctgtatcggttgtaacttgtaagattcggtaacctgaactaatcaggagcagtagttgcaacggttcagatgctggctgaagttcctacagcaattatacaggcgctgcaacggcccactggtgtgtaagattgcagctgactaggtgaattcctcgcacgttgctgctggaattcgatgaatatgttataaatgaagcaaattttttagaaaaaatgtacaactgaaactctcatacaaattacattacaaagtaataaaaaaagctcatataaaagc

SEQ ID NO: 17551 - protein, 256 aa, Panicum virgatum
  misc_feature: Ceres CLONE 1792717
  misc_feature (11)..(141): Pfam Name: NAM Pfam Description: No apical meristem (NAM) protein
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Functional homolog of the protein sequence given in SEQ ID NO 50328
  misc_feature: Useful for making plants with modulated nitrogen use efficiency
MERPAQAPRQLPPGFRFHPTDEELVVQYLRRKVLARPLPAAVIPVVHDVARLDPWDLPGASEGEGYFFSLRRAPATGRGGRRRRAGSGYWKTTGKETPVFLHYGGRRQLLVGVKTALAFHRSEPSSSSSRTGWVMHEYRLAVPGDLAMAEQRKNANHGRVAEPGEWVVCRVSLKNRPRSRPNRDGDGKTPGNRTSIAQGAAPLQHREGDGRQPPSLLMSPQPSSSSCVTGVTDISDQDEVSSISVRDAPADSQREA

SEQ ID NO: 17552 - DNA, 1866 bp, Panicum virgatum
  misc_feature: Ceres CLONE 1792729
  misc_feature: Encodes the peptide sequence at SEQ ID NO. 17553
gttctcctcaccccccacccgacccgaccccgtccgaaacaagccgacgaacgcgaccgaggaagcggaagcgggagggagggaaaagggcgaaatcgccgccgccgtcagcaacgattgatcggactggacaccgagtcgccttcacctaccatgtgctgctggtgagttcgttgggggtccgtgcggagggagccgctcctcatttcgctggtcctggcaggctccgtgggggattccggacgcggggggagggggagtccttgtctccttgaggccgcattgcagcacggacttgcatctagcgccgcggtttcggcggttcgattcgtctgatcccccgttttgttgtgctcaaagcctgaaactgtgcggctgtatgatagggagcggtggcgctagctcgattggccggggaattcagggggcttgtctcagcctagcctggaattgatggagcagaagagagcaagggcagcggaggagcctgcccggttgatgtgtgatgatgcgctaacggaggtcttccgcaggctgcctgcccgtgcgctcgccgcttgcaggctggtgtgcaagtcctggatgacggtgctcacggatccacacttcatccacgagcaccttagccgcggccggcagaagctgctgctctttgcgagcgaccgggtgagcgataggtcgctcgccatggtgcttgcggatgacaacaagtccatgtaccagttgtcgaggcctgctgcgtctcggagcgtgtttgtccacaattcatgcaatgggctgctgtgcctgggtgacagtacaggagccgtggaggtgctgaacccgacaaccggtgaatctctaatgttgccaactccgacgtacacagcagggagcagccagttctcatcctgtaattggcactgcttggggttttgtccaaagacgagggagcacaaggttgtgcatttctatcctggaacacatattgattcgttcaaagtgcgctgtgaaatatacacacttggagctggtgtctggagacaagttgggagcttccgtggtgctccgatagatagaggggtgcatgtgaatggagcagtgtactatctgacaaagtttcgctacattgcttcatctcgaatcaattgcttgaatcttgagagcgaaaaaattgatgcgatgatgcttcctccacgcaagtcttatggagggcattgctctttgacggagcttgaaggaagggtatgcttgttagttgtggatggtgtgcttgaaggtccgcctcgtacgatggacatattgatgctcaatagtgatgagcagagctggactcccagataccacttctctttgccttggttgattccttcctgttattttactccgaagcacacactcttccatgacgggaaaatttgggtgcaattgttggctaggaatctctactgttttgatccaagatcaaattctgaagaattgacaatagcgtggccagagcttgactttccgtttagcacacatactttcattgagagcatagttcctttgcggaaagactacttcatcaagcacatacagtgactggtgttctgccccttgttttccaaggtggttttcagtttacagcattacagtgtcttagttgtttcttttttctttttcttttatgaaccaagctgttagtcatcttaaggtgatgtgctactctgaattctaattagtgatgacagatgcaatctcaatacatttctgagcactcatgctcttctggcttctaatcgaactgttcattcctctttgtgctaagaagtggataagagagaggagctctccaggagctcttattttactcaatatgatgatgaagatgaaaattgtttaggc

SEQ ID NO: 17553 - protein, 369 aa, Panicum virgatum
  misc_feature: Ceres CLONE 1792729
  misc_feature (11)..(58): Pfam Name: F-box Pfam Description: F-box domain
MEQKRARAAEEPARLMCDDALTEVFRRLPARALAACRLVCKSWMTVLTDPHFIHEHLSRGRQKLLLFASDRVSDRSLAMVLADDNKSMYQLSRPAASRSVFVHNSCNGLLCLGDSTGAVEVLNPTTGESLMLPTPTYTAGSSQFSSCNWHCLGFCPKTREHKVVHFYPGTHIDSFKVRCEIYTLGAGVWRQVGSFRGAPIDRGVHVNGAVYYLTKFRYIASSRINCLNLESEKIDAMMLPPRKSYGGHCSLTELEGRVCLLVVDGVLEGPPRTMDILMLNSDEQSWTPRYHFSLPWLIPSCYFTPKHTLFHDGKIWVQLLARNLYCFDPRSNSEELTIAWPELDFPFSTHTFIESIVPLRKDYFIKHIQ

SEQ ID NO: 17554 - DNA, 3420 bp, Panicum virgatum
  misc_feature: Ceres CLONE 1792746
  misc_feature: Encodes the peptide sequence at SEQ ID NO. 17555
aaatttcttcacacacaccgcgcgctcgccctgccagctctgctcctccgcccgacccgacccgacgcggcctcctcccccgacgaccccgagagcgagcgagcgcggcagcgatgcgcgaggaggtgcggagctcgtcggcggcgccgcccgacccgccgcccgcgcactgggcctcgccgccgcccacccccgtcgccagctccgctggtgcttcatcacctcctgcacaagctattgtagctagcatagattggttaggcagtgaccaagtctccaaggcggggtcgtctcatgtcgctccacctgcttctcagcccgcacttagtactaatgctgatggagctgctgcggatttctttcaatcatcatgcagaccgtgggaacgaggcgacttgcttcgtcgattggccacgtttaagcattcaacatgggcttctaagccaaaggctgctagttcactggcttgtgctcaaagaggctgggtgaacattgacgtggacaagattgagtgtgaatcatgtggtgcacatcttatttttactgcattgacatcctggtcccctgctgaagttgcaaatgctggggaagcttttgctgagcagcttgatgcatcacaccagaatgattgtccctggagggggaatagctgtgctgatagcctggtccagttccaccttaccccatcagctcttgttggtggttttaaagatcgatgtgacggattgttgcagtttgtatctcttcctgttattgcctcgtctgcaattgagagtatgaagctcactagaagctttcaaattgatcgtatattatcccagtcagttacaattttgtctggggagctgggttatagaacagacattacaactggaattgatatcaaccaacaagatgaaacctgctgctactctcaagcacagaagcttattagcgtttgtggatgggagcctagatggcttccaaatgttcaagattgggaagaaaattcgacacgctctgccagaaatgcaggctcagctgaaccagatggccaatttcattctcaatttgctgagcaccgtcaaagttcatactctgcatcagttaagaaagagaagggaaaaggcaaaatgcgtgtcaaagattctggatgcagcatgagatcacctttgctggattgcagcttatgtggagctacagtgagaatttgggacttcaaatctgtgccacgcccttctcattttagtctgaataacatcgacatgcctgatacaggtaggaagcctgtgttgacccgtggaattagtgctactagtgggatcaatggattggttgctgaaggagcggaaaaagaaaatgttgaaggacgtgatgagggaggtactgatgagcagaagtctgtgtcaaatgcacaagttgacttaaatttgacaatggctggaggtttgccatctaaccattctgcattgcccccgatgcctgggcatttcaattatggaggaatgggaagagatctcatcattgggcagcctactggaagcgagcttgggggccatgctgcctcatttgaatctcagggccccagttcaaggaagcgtaaccttgaggaaggtgggagcacagctgacaagccaataaacaggcttcagcctgctgacagcatagaaggaaccgtcattgaccgtgatggtgatgaagttgatgatgccgctcatgattctggtgctcggaacaaaaggcctcgtggttttaatctttttgacatcaatcgcccatcttcttcaggagctggtcccagcagaaacttaaggtttgatctggatatagatgttaataggttcgatacatctaatgctgagggcccatctgcccttcacaacacatttccaaaggattctatgagggaatcttctgttattgcaatggatactgttcacagtgcagaggaaaattcaatggagagtgttgaataccatccatgtgatggtgatgatgttaataagccttctagtgcactcaggagtggtggaatgagtgaggcattggatctcaattatagcaaccaagcacagcaaagcagttttgtacagcttgctcctgaaactgaaagtaatgcaagggagatagggggcagtagtatgaatggaggggaagaagtcctcaatgcagaaacgactcctgcctctgctagagatcagtttagcctgggggttagtggagggagtgtcgggatgggtgcaagtcatgaagctgaaattcatgggactgatgtttctgagcataaaactggtagcgttgttggagacgctgatccagttcctgagctcattgagactatgggccacactggcgagtcagcccctggacctacgttgatggatgagtttgcccctgaagaagttggtcgagaagatcctcatggtgatagccaagatatggcatctcggttagcggttcgagctgacagtgggtcaaaagtttgtggttcaactaaagctgattctgttgagagtggagagaagatgagtcatgccgtaggtcctgagaatagtgcacatccttctctttcttgcaatgcaagagttttttctggcgttgatgcatcaaaagaggaagtcactggtataatgctgactaatgatgattatgatccaggaaatgggctaggagcaacaaatggagaaaacgattatgaaacagatcttccagattttgatccaataaaacaccacaacaattactgcccatgggtaaatggaaatgttgctgctgcatgttgtattagtactggttcgagcacagcgctttctggctggcagctcacagtagacgccattgagacactgcagtctgtaggccaagctcagaatcagacaaggcaatcagactctgcggcttcattatataaggatgatcacgccccacccagacggaagctgctcaaaagggcaaaccacagcaggagctgatccttggtgcttcacatttggtgtactcgaaatttgccaacaatttgtctctgctcgtatggttctgatggatgtctacttgaacgacactggttctgtgatttgtgaaataggtcgctgtggagagctcagaaaccatcatgtggtctgttggaatggaaaaagttgggtagttttgtgcgcggatgattgagtttgcctgccatctctagctatgtcagctcggctattatatttatctaataataatgttctataagattatttcagcaccaaatgactgtaatttaatgtttgccatcttttgttagtgacctgcgcgattgaaaaatatgtatcttagaaggctagaaatatgtgttgtgtgggtacttgtgctgtaagcatatacttgatgcatgaacaaatggctatagaaatgtgatatgaggaaactaaccacgcatccatgtcctctccattgtgtggt

SEQ ID NO: 17555 - protein, 945 aa, Panicum virgatum
  misc_feature: Ceres CLONE 1792746
  misc_feature (89)..(216): Pfam Name: zf-C3HC Pfam Description: C3HC zinc finger-like
MREEVRSSSAAPPDPPPAHWASPPPTPVASSAGASSPPAQAIVASIDWLGSDQVSKAGSSHVAPPASQPALSTNADGAAADFFQSSCRPWERGDLLRRLATFKHSTWASKPKAASSLACAQRGWVNIDVDKIECESCGAHLIFTALTSWSPAEVANAGEAFAEQLDASHQNDCPWRGNSCADSLVQFHLTPSALVGGFKDRCDGLLQFVSLPVIASSAIESMKLTRSFQIDRILSQSVTILSGELGYRTDITTGIDINQQDETCCYSQAQKLISVCGWEPRWLPNVQDWEENSTRSARNAGSAEPDGQFHSQFAEHRQSSYSASVKKEKGKGKMRVKDSGCSMRSPLLDCSLCGATVRIWDFKSVPRPSHFSLNNIDMPDTGRKPVLTRGISATSGINGLVAEGAEKENVEGRDEGGTDEQKSVSNAQVDLNLTMAGGLPSNHSALPPMPGHFNYGGMGRDLIIGQPTGSELGGHAASFESQGPSSRKRNLEEGGSTADKPINRLQPADSIEGTVIDRDGDEVDDAAHDSGARNKRPRGFNLFDINRPSSSGAGPSRNLRFDLDIDVNRFDTSNAEGPSALHNTFPKDSMRESSVIAMDTVHSAEENSMESVEYHPCDGDDVNKPSSALRSGGMSEALDLNYSNQAQQSSFVQLAPETESNAREIGGSSMNGGEEVLNAETTPASARDQFSLGVSGGSVGMGASHEAEIHGTDVSEHKTGSVVGDADPVPELIETMGHTGESAPGPTLMDEFAPEEVGREDPHGDSQDMASRLAVRADSGSKVCGSTKADSVESGEKMSHAVGPENSAHPSLSCNARVFSGVDASKEEVTGIMLTNDDYDPGNGLGATNGENDYETDLPDFDPIKHHNNYCPWVNGNVAAACCISTGSSTALSGWQLTVDAIETLQSVGQAQNQTRQSDSAASLYKDDHAPPRRKLLKRANHSRS

SEQ ID NO: 17556 - DNA, 2042 bp, Panicum virgatum
  misc_feature: Ceres CLONE 1792747
  misc_feature: Encodes the peptide sequence at SEQ ID NO. 17557
tttcaatctgagtgtcgcttgtttcaaatccatcccttgcttcccctccccgcttcctcgtaccaaatctagggtttccgatcgaaatcttccgtctccgccgccaccgccggtgataatgtcggccagcgccgagctcgagaaggacgccgcggccgcggccgccgacggcgacgaggacgcggaggtgaagggcagcgcctccggctgggagctgctgtactgcggcgggacgagcttcgacaatatgggccggaaggtggtgggcggggggcagggcaacctggtgtccccgacgcgattgcggccgctgatgggcgtcgacatccgcttcgtcggctctggctgcactgcttgccactgtgttgctttggatgctgaaggcagatgttatacatggggtcgcaatgagaagggacagctagggcatggggatactcttctgcgtaaccttcctactgttgtttcacaactatcaaaatacaaaatcatcaaagcaagcgttggaagaaatcatacagtggttgtaactgatgatgggaaatcattctcttttggccacaataagcatgggcagttagggacaggctccttgcggaatgaaattgagtcatcgccagtgccctgtatcgttgccgaagcaaccaatgctgtatgtggagctgattttacagtctggttgtcatcagtggaaggctcttctatacttacagcaggccttccccaatatggtcaactcgggcatgaaactgataatgagtacaatgctaaagattcgtctgtcaagctgacgtatgatcctcagccccggccgcgagcaatagctacattttctgggaaaactgtagtcaaagttgcatgcggaactaatcatacagttgcagttgattccagtggctttgtttacacctggggttttggtggatatggaaggttgggccacagagaacagaaggatgaatggcaacctcgtcttgtagaaatcttccagaagcacaatgttctgcctcctaatgctattgtctcagctggttcctcaagttctgcatgcacagctggtggtggacaattgtacatgtggggaaagatgaagaatacaggcgatgattggatgtatccaaagcctgtaatggatttaagtggttggaatatttgctgcatggcttctggtaacatgcaccatgttgttggtgctgatgattcatgcataagctggggtgttgcccagaatggagaacttggttatgggcctaatgggcagaagtcctctgctaatcccaaaaaggttgacattcttgagggaatgcatgttacaagtgttggttgtggatacggagtgtctctaattgttgtggacagggcaaatattggtgatcgacttgataagctggagatttatgatggtgatacaactgaagtagagaaggtggaggtgcaagcaaccaagaaggcgtctgccagctccaattcacgtgccaacaagcgcaagaaaaccaaggatgattctgaatcagaagaggaagatgatgaggatgaaagtggagatgatgagaacggagaaatagaagaggccaagggtaggcgtggccgcaaaccctctaatagggggagaggcaggggagccaaaaaggcagctcctgaggcaaagccatctggaagaggcagaggccgccctaagaaaactgagagccctgctcagaaagctggaagatcgggtggccgtggtggaaagagaggaagaccccggaagtgatcataaggtggtgttgaagtcagatcaagtgatctctaacacctgatgtgattcaaccattgaagatttaatttttggtagcaaagcctccggccgtacctcaatttcgccaattgcagctattcaaaaactccatctcttttttgccccccttttccaaattgagccttccatctgattgcaagtctagaaatgttctaacctgtacatctgtgttctttgttgatgttaatctcacatttggttttaggctattatggatccatcattagagtgatttatcctgttc

SEQ ID NO: 17557 - protein, 544 aa, Panicum virgatum
  misc_feature: Ceres CLONE 1792747
  misc_feature (88)..(137): Pfam Name: RCC1 Pfam Description: Regulator of chromosome condensation (RCC1)
  misc_feature: SWISSPROT Homolog: EC 2.7.11.1 Non-specific serine/threonine protein kinase
MSASAELEKDAAAAAADGDEDAEVKGSASGWELLYCGGTSFDNMGRKVVGGGQGNLVSPTRLRPLMGVDIRFVGSGCTACHCVALDAEGRCYTWGRNEKGQLGHGDTLLRNLPTVVSQLSKYKIIKASVGRNHTVVVTDDGKSFSFGHNKHGQLGTGSLRNEIESSPVPCIVAEATNAVCGADFTVWLSSVEGSSILTAGLPQYGQLGHETDNEYNAKDSSVKLTYDPQPRPRAIATFSGKTVVKVACGTNHTVAVDSSGFVYTWGFGGYGRLGHREQKDEWQPRLVEIFQKHNVLPPNAIVSAGSSSSACTAGGGQLYMWGKMKNTGDDWMYPKPVMDLSGWNICCMASGNMHHVVGADDSCISWGVAQNGELGYGPNGQKSSANPKKVDILEGMHVTSVGCGYGVSLIVVDRANIGDRLDKLEIYDGDTTEVEKVEVQATKKASASSNSRANKRKKTKDDSESEEEDDEDESGDDENGEIEEAKGRRGRKPSNRGRGRGAKKAAPEAKPSGRGRGRPKKTESPAQKAGRSGGRGGKRGRPRK

SEQ ID NO: 17558 - DNA, 927 bp, Panicum virgatum
  misc_feature: Ceres CLONE 1792754
  misc_feature: Encodes the peptide sequence at SEQ ID NO. 17559
agtttgcgctgcgagcatgggcctctcaccgtttcttgcagtgctgcccgccattattgcccttctctccctcgtgttcttcttctccaccggcagaaaagctgctctctcccatggacatggacggaggagcttgccaccgtcgccgccgggcttccctctcgtcggccacctgccgcttcttggatcgctaccccaccggacgctccgggcgatggccggaacgcacggcccggtcatgctcctgcggctcggccgcgtgcccgtcgtggtggcctcctcggcggccgcggcgcaggaggccatgaaggcccgagacgtggccttcgcgggccggtacagcgggccgatggtcgagcgccttttctacgggcgcgaccgcgacatggccttcgcttcctacggcgagcactggcgccaggcgcgacgcgtctgcgtgctccacctcctcagccagcgctgcgtgctctccttccggcgcgttcgccagcaggagacggccgccctgatcggccgcgtccgccgcgatgccgccgccgccgtgaacctgagccatcttctcgtcgtctactccagcgccgtcctcctgcgggccgcgttcggcaacgacgacgacgacgactccagctacgggctcgacggagaaggggagattcttargaagttgctagtcgacgccgaggagttgtggggcttgggcaccctcggcgaggtcctgccgtggatggtgtgcgtgaactccgtgaggggggtgcgtgcctaggcagcgcggacgtctgaagcgctggatggcttcctcccatggggcattgccgaccaccattcaccgtgccaccggggaggtccgcctagaggacacgggggcggcgaccagaattaccgctacttcacgagcgtgctgctggatgtgaaagaggaacgaagagg

SEQ ID NO: 17559 - protein, 248 aa, Panicum virgatum
  misc_feature: Ceres CLONE 1792754
  misc_feature: SWISSPROT Homolog: EC 1.14.13.68 4-hydroxyphenylacetaldehyde oxime monooxygenase
  misc_feature (215)..(215): Xaa is any aa, unknown, or other
MGLSPFLAVLPAIIALLSLVFFFSTGRKAALSHGHGRRSLPPSPPGFPLVGHLPLLGSLPHRTLRAMAGTHGPVMLLRLGRVPVVVASSAAAAQEAMKARDVAFAGRYSGPMVERLFYGRDRDMAFASYGEHWRQARRVCVLHLLSQRCVLSFRRVRQQETAALIGRVRRDAAAAVNLSHLLVVYSSAVLLRAAFGNDDDDDSSYGLDGEGEILXKLLVDAEELWGLGTLGEVLPWMVCVNSVRGVRA

SEQ ID NO: 17560 - DNA, 616 bp, Panicum virgatum
  misc_feature: Ceres CLONE 1792754-R
acaccgagctgctcggataccatgttccagcgcgcacccgtgtcatcatcgacgtcggggccatcgcacgggaccccgccacgtaggagcgcgcaggggagttcctgccggagcggtggttcggggatgacggcgcgtcggcggcggtggcggggcaggacttcacattcttgcccttcggtggcgggcggagagggtgccccggtgccgggtttggcatggcgagcgtcgacctggtgctgacgagcctgctgtaccattttgactgggagctaccggccggtggggcgtccacggtcgacatggatgtggtaggtgaattggccgtgcggttgaagaaacctctgtgtctggtcgctaagccatggtgtccttaataagatccatcacgcatggtgtccatcctgctcatattcatcaggaaattaaataaagagtttaattatccgcacgggccacgtgtccttcactgctatcttatacattcatggtaaacagcaaaatgtaaagtttggatgcataatttacactattgcatataagcatccatataatatgtaattactggctatatatattattctcctctattaatatatatttgctttacagaggt

SEQ ID NO: 17561 - DNA, 1961 bp, Panicum virgatum
  misc_feature: Ceres CLONE 1792761
  misc_feature: Encodes the peptide sequence at SEQ ID NO. 17562
gagccattattgcgaccttgcttctctctcagactctcactgtgttgagcttgcgggcccggatacggtggcggtgggagggatgacgccggcgacggcggaggtggtggaggagctcacgcggctgtaccgggagctgccgccgcgcccggccgtggaggagctggaggcggcggcggcggtgctggcctcggcggacgcggaggaggaggcgcgactcgccgaggtcgacggggcggcggcggcgcgggcgcgggagggcgttcccgcggagctcctcgacgtgctgcgggaggccaggcgcaacgccatcaggctccgcgcgctgctgcagcggaaggaggccgcgcacgtcgtcgagctcgagaggaggttcaaggtcttcgacgacctcatccagagggcgtcgcgcgtggtgtcccccggtgatgggggtgggggcgggggtgatgctgcctacgccgtcgacgaggtcgtcgaggtggaggccaagcggaggccggagctggcggcggcggtggctaccgcggcatcagagatagacagcggaagcaagggcggattgggcttcgaaaccaagtccgtctcgtccctgcgtcgggctgcttctgcagataacgacacagaaaagctgggccttatccaagttgcaagccttatagagtcatcagcaaagaaggggactacagagctcaatctccggggaaaactggtggaccaagttgagtggctccctgtttcacttgggaaattacaagatgttactgagcttgatctatctgagaataggatcatggcactcccatcaacaattggtagccttagatacttgacaaagcttgacctccatgcaaaccagctgatcaatctgcctgatacttttggggaactttccagcctgattgatcttgacctgcatgcaaaccagcttaaatctcttcctacatcatttggaaatctcaccagcttggcaaatcttgacctgagttcaaatatgttgaaggtgcttcctgattgtttaggaaagttgacaaacttgagaaggttaattgctgagacgaacgagcttgaggagctaccatatactattggatcttgcacctctctcatggagcttagattggattttaatcagctaaaagcccttccagaagccatcggaaagttggaaaagctggagatcctcacattacactacaacagaatcaaaggcctgcccacaacaatcggccaacttaccagattgagagagctggatgtcagtttcaatgaagttgaaatgatccctgagaacatttgctttgcggccagccttgtgaagttgaacgtcagcaggaactttgctgacttaagagcactgccgaaatcgataggggaactcgagatgctagaggagttggacatcagtagtaaccagatacgaatactaccagactcgttcgggtacctctcaaaactacgcgtatttcttgctgatgaaactccactggaagtaccacctaaagaagttgtgaaattaggagctcaggaggtggttaattatatgaagaatatggttgcttcaagggaagcaagccggaaggaaacagataagaggagcttctgggcctggatccgctcactgtttggttgttgcaaaaaggatcaaggactgggatctgttcagcttagctgaagcatttcatctgtatagtcatgaattgttcagtgttgatccatgtctcagatcagcgataaactgagacatggacaattaattttattccacttgtgtatctgtatacaaaggatatgtctagctttcttgtacataaagctcattgtgtgtgtataagttcatatgtatgatacttgatacgctgtcatgtcactctccattacatgaaacacgagctgtccagaatttacactgagccaaggtgttgactttcatatgatgtgaatgacagacaatggtgcac

SEQ ID NO: 17562 - protein, 530 aa, Panicum virgatum
  misc_feature: Ceres CLONE 1792761
  misc_feature: SWISSPROT Homolog: EC 4.6.1.1 Adenylate cyclase
MTPATAEVVEELTRLYRELPPRPAVEELEAAAAVLASADAEEEARLAEVDGAAAARAREGVPAELLDVLREARRNAIRLRALLQRKEAAHVVELERRFKVFDDLIQRASRVVSPGDGGGGGGDAAYAVDEVVEVEAKRRPELAAAVATAASEIDSGSKGGLGFETKSVSSLRRAASADNDTEKLGLIQVASLIESSAKKGTTELNLRGKLVDQVEWLPVSLGKLQDVTELDLSENRIMALPSTIGSLRYLTKLDLHANQLINLPDTFGELSSLIDLDLHANQLKSLPTSFGNLTSLANLDLSSNMLKVLPDCLGKLTNLRRLIAETNELEELPYTIGSCTSLMELRLDFNQLKALPEAIGKLEKLEILTLHYNRIKGLPTTIGQLTRLRELDVSFNEVEMIPENICFAASLVKLNVSRNFADLRALPKSIGELEMLEELDISSNQIRILPDSFGYLSKLRVFLADETPLEVPPKEVVKLGAQEVVNYMKNMVASREASRKETDKRSFWAWIRSLFGCCKKDQGLGSVQLS

SEQ ID NO: 17563 - DNA, 555 bp, Panicum virgatum
  misc_feature: Ceres CLONE 1792762
  misc_feature: Encodes the peptide sequence at SEQ ID NO. 17564
acgagcgccagccagtcaccacctacccgaagccgccgcgatcgatcgagccgagcgccccgcccccacgccgccaccgaaaccctagctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccggccgcccccactccggcggcggcggcggccgcgcccgcggcgtggcctcctgccgcgccgccggcggccgtgatgaaggaggagagcaagctgctctgcgacgacaccatcctcgtcgtcgacggcgaggagagggggagaaggacgatcacgatggctgctatcaccacgtcagtaaagaagacgtcggcctggtggagcaactcctccgaacagatatactattaggaggaggggagggctgctttcggggagtgcagg

SEQ ID NO: 17564 - protein, 149 aa, Panicum virgatum
  misc_feature: Ceres CLONE 1792762
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGGGRARGVASCRAAGGRDEGGEQAALRRHHPRRRRRGEGEKDDHDGCYHHVSKEDVGLVEQLLRTDILLGGGEGCFRGVQ

SEQ ID NO: 17565 - DNA, 661 bp, Panicum virgatum
  misc_feature: Ceres CLONE 1792762-R
  misc_feature: Encodes the peptide sequence at SEQ ID NO. 17566
gcgttctgaacccgaatgctgcctacctgatccttcggggcatgaagacactgcatctccgtgtgcaatgtcaaaataacactgctctgcggatggcccaatttttagaggaacatccaaagattgcacgtgtctactatcctggtttgccgagtcaccctgaacatcacattgccaagacccaaatgactggctttggtggtgttgtcagttttgaggttgctggggattttgacggtacaaggagattcattgattctgttaagataccctatcatgccccttcttttggaggctgtgagagcattatcgatcagcctgccatcatgtcttactgggattcaaaggagcagagggacatatacgggatcaaggacaacctgatcaggttcagcattggagtggaggatttcgaggatctgaagaatgatcttgttcaggcccttgagaaggtctaatcacttgattcgttcactttaatattcatatcagatcacggttgtcctggatcttgagagatttgtgagaatatttgagccgatggctgccaataatttttctccttttgcttaatttgttctttcattcacaataagttgagctctctgtactgtgcagtctcgtgattgtcgcaggatgcagtgttgaacttgttcttgtc

SEQ ID NO: 17566 - protein, 151 aa, Panicum virgatum
  misc_feature: Ceres CLONE 1792762-R
  misc_feature (1)..(149): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
VLNPNAAYLILRGMKTLHLRVQCQNNTALRMAQFLEEHPKIARVYYPGLPSHPEHHIAKTQMTGFGGVVSFEVAGDFDGTRRFIDSVKIPYHAPSFGGCESIIDQPAIMSYWDSKEQRDIYGIKDNLIRFSIGVEDFEDLKNDLVQALEKV

SEQ ID NO: 17567 - DNA, 2272 bp, Panicum virgatum
  misc_feature: Ceres CLONE 1792765
  misc_feature: Encodes the peptide sequence at SEQ ID NO. 17568
acacaaacccacctcgctcgcctcactccccgcgcgcgctcccctcccctcccctccccaaccctttccattctcgtcacccccctccgcacaggccttcccaagctctgcttcttcccctttggtccctgcgatcccgattcgaattcctcgaccgcccggcgacgacccatataacaaggttcttctggtgacctcggcggcggcggcggcctagtccgtgtacgccatggctcgcggcgacggcgagctcgagctcacggtgggcgtccgcggcgccgggcgcggcgcggcggcggcggcggacgcgcccgcgccgatcaccctcggcaggctcatcctcgccggcatggtcgccggcggcgtgcagtacggctgggcgctgcagctctccctcctcacgccctacgtgcagaccctggggctttcacacgccctcacttcattcatgtggctgtgtggccctattgctggcttagtggttcaaccgctcgtcggtctgtacagtgacaagtgcaccacgagatggggacgacggaggccatttattctgactggatgtctgctcatctgtcttgccgttgtgatcgttggattctcatcagacattggagctgctctgggagacacaaaggaagagtgcagcctctaccatggtcctcgttggcatgctgcaatcgtctatgttctggggttctggttacttgacttctccaacaataccgtgcaaggtccagctcgtgccctaatggctgatttgtcaggtcgtcatggccctagtgcagctaattcaatcttttgttcttggatggcgttgggaaatatccttgggtactcctctggttccacaaataattggcacaagtggtttcccttcctgaagacaagagcctgttgtgaagcctgtgcaaacctgaaaggagcatttctggtggctgtggtgttcctgatcttctgcttgaccataaccctgatcttcgccaaggaagtaccatacaaaggaaatcaaaacctcccaacaaaagcaaacggtgaggttgaggctgaagctaccggtccacttgccgtgttcaagggcttcaagaacttgccccctgggatgccgtccgtgctcctagtaactggtctcacttggctctcgtggttcccgttcatcctctacgacaccgactggatgggtcgtgagatctaccacggcgacccaaagggaaccaccgctcagaccgcagcgtacgacgaaggtgtcagagttggctcattcgggttgctactcaactctatcgttctagggttcagctccttcctgatcgagccgatgtgccggaaggtcgggccgaggctggtgtgggtgacgagcaacttcatggtctgcatcgccatggccgccaccgcgctcatcagcttctggtcgctcaaggactaccacggatacgtgcaggacgccatcacggcgagcactagcatcaaggccgtgtgcatggtcctgttcgcgttcctcggtgtccccctcgctatcctgtacagcgtccccttcgccgtgacggcgcagctggcggccaccaagggcggcgggcaagggctctgcaccggcgtcctgaacatctccattgtcatccctcaggtgatcatcgctctgggcgcgggcccgtgggacgcgctgttcgggaaggggaacatcccggcgttcggcatggcgtccggcttcgcgctcatcggcggcatcgtgggcctgttcattctgcccaggatctcgaagcgccagttccgggccgtcagcgggggcggccactgagcccggctccgcccggcggccggatcaggccaggccggcgtgcaagaagagtttgtatgttgaacagaataagaacgggaaaccatgccatcgtgcagtgtgcgcttgttgtgtccggtagataggcaggcgtgggcaagtggagaaaggtaacgcgagcatccagcaccaggtctggtctctgctagctagctagtgtaaggagcgagtaggtcagttaaaagctggtgcgtcgtgagggctcggtcgaccggcagcggtcgcgcttgctcctgttgtcgatcatgcatgtgtgtagctcagcggactgatcaggaaaaaaaaagggtattcgatcgacaagaatgtgcagcatgcatgaactgtgtcatgttagaggctgcagtactagatgatgttcatgatggtactagactatgtattgtccgccgtttagatttttggtcggagcagtggaattgaagcgccttgttttgctcc

SEQ ID NO: 17568 - protein, 520 aa, Panicum virgatum
  misc_feature: Ceres CLONE 1792765
  misc_feature (36)..(519): Pfam Name: Sugar_tr Pfam Description: Sugar (and other) transporter
  misc_feature: Functional homolog of the protein sequence given in SEQ ID NO 50772
  misc_feature: Useful for making plants with modulated heat sensitivity
MARGDGELELTVGVRGAGRGAAAAADAPAPITLGRLILAGMVAGGVQYGWALQLSLLTPYVQTLGLSHALTSFMWLCGPIAGLVVQPLVGLYSDKCTTRWGRRRPFILTGCLLICLAVVIVGFSSDIGAALGDTKEECSLYHGPRWHAAIVYVLGFWLLDFSNNTVQGPARALMADLSGRHGPSAANSIFCSWMALGNILGYSSGSTNNWHKWFPFLKTRACCEACANLKGAFLVAVVFLIFCLTITLIFAKEVPYKGNQNLPTKANGEVEAEATGPLAVFKGFKNLPPGMPSVLLVTGLTWLSWFPFILYDTDWMGREIYHGDPKGTTAQTAAYDEGVRVGSFGLLLNSIVLGFSSFLIEPMCRKVGPRLVWVTSNFMVCIAMAATALISFWSLKDYHGYVQDAITASTSIKAVCMVLFAFLGVPLAILYSVPFAVTAQLAATKGGGQGLCTGVLNISIVIPQVIIALGAGPWDALFGKGNIPAFGMASGFALIGGIVGLFILPRISKRQFRAVSGGGH

SEQ ID NO: 17569 - DNA, 639 bp, Panicum virgatum
  misc_feature: Ceres CLONE 1792774-R
  misc_feature: Encodes the peptide sequence at SEQ ID NO. 17570
agaaccccgacgccgacttcgtcaggaacggcggcttctcgtacgccatcgtggccgtgggcgagcacccgtacacggagacccagggcgacagcatgaacctgacgatcccggacccggggccgagcaccatccagacggtgtgcggcgccgtgcggtgcgcgaccgtgctcatcagcggccgccccgtggtgatccagccgttcctggccgccacggacgcgctcgtcgccgcctggctgccgggaaccgagggccagggcgtcaccgacgtgctgttcggcgactacggcttcaccgggaagctgccgcggacgtggttcaagtcggtggaccagctgcccatgaacgtgggcgacgcgcactacgacccgctcttcccgttcggcttcgggctcaccacaaagggcaatgcgtactagaaggggattggtggtagcctgtagtgataggaaaattgaatttttaaacagtgctcagctcccactgtggagtagcatccactagatgagcggtctcattcttatatgataatattgctttgatctttgttcaattcgctcaaggcccgtttacttgtacggtggcttggcttgtagttgaatcgagtagaaatcatatttcgattaaatggaccag

SEQ ID NO: 17570 - protein, 139 aa, Panicum virgatum
  misc_feature: Ceres CLONE 1792774-R
  misc_feature (1)..(136): Pfam Name: Glyco_hydro_3_C Pfam Description: Glycosyl hydrolase family 3 C terminal domain
  misc_feature: SWISSPROT Homolog: EC 3.2.1.21 Beta-glucosidase
NPDADFVRNGGFSYAIVAVGEHPYTETQGDSMNLTIPDPGPSTIQTVCGAVRCATVLISGRPVVIQPFLAATDALVAAWLPGTEGQGVTDVLFGDYGFTGKLPRTWFKSVDQLPMNVGDAHYDPLFPFGFGLTTKGNAY

SEQ ID NO: 17571 - DNA, 1546 bp, Panicum virgatum
  misc_feature: Ceres CLONE 1792774
acggcagcctcctgctcgcctcctcctctgttcttcatcttcttcgttcttcacatccgccctccctctttctggtaagactcgggcggtttcttgctccatcgaagtagtggtgcatgctcgtagccgtcgccgtaattgcacgaacaatcgggcgccgcctgtcctcatgttgatggcatgtagcgctgcgctggagttggaagtctcggagggggggccggccgttcacgcgtgttgggcttttggaaaggggggaaatggtggctttgtgtgaggggatgggattccaaacggttgcaacaaacccattgaagtttgctcacctttttcgtcataggagctgtgcctgtgctctgaaacgcacggtgtagttgcttcatataaacccaggcccccctgtactgttcttgccgggctcacacattttgtggcactgcagggctccatctctgcttctggcgactgattggttcgtcctcatggctctagctcccttcttcttcatccctggtttcactgccttgaagcagcagtagcagtgccaagcaaatagtttgatattatcgtgctggtttttctttcattgcacactaatctcttcttcgattccttttagtctttactaatacgcacaatcttttgttttgcaattgttgctgtttttttaactgtggccagattcctgttcagccagctggtactgtagtgtgtagtgttatgaatttacagagactgctgcaagaaaacactagtctccctaaatttttaatccctttgtgttttattaaaccatgctgttctgtcagcaaaacactagttaaaactaatgataccatcaattcccatcatctggggtttctcagagcgcctattgctagcgcaacggcatggatagaaaagggcaccttgattgatcctgacggcctaccagttaactatttgttaattactcgtccatgtccataatccatttgcaacttgcacgcactaccaacacatggcacgggcaacacaagtcgagctaggcgtcctaattagtctcgttagcacaagccatgatggtttcttggatccctgcatctctgcatccccgtttcttgccgacgttgaccggtcatgggcggcgagctcgccggccgcatcaggtcgggcgtcctcgagcccctggaggaccgcttcacggagattctgatccggtcgctgcaatgctacgacgcgcaggtccggaggcgcctcgtcccgctccttcgccggcacaggatggcgctgctcacggcgccggcggtggccgcgctgctgctgctcttctggtccgcggcgtacggtgacgcccagctgccgtacaaggaccccagcctgcccgtgaaggcccgcgtcaaggacctcctcggccggatgacgctcgccgagaagatcgggcagatgacgcagatcgagcggaaggtcgcgtcgccgcaggtgctcaaggacaacttcatcggcagcctgctcagcggcggcgggagcgtgccgcggctgcaggcgacggcggcgggagtgggtg

SEQ ID NO: 17572 - DNA, 321 bp, Panicum virgatum
  misc_feature: Ceres CLONE 1792775
  misc_feature: Encodes the peptide sequence at SEQ ID NO. 17573
acgccccggcgacgccctcttctcagccggggaagaagccgtcgctgcgcctgccccccgcgccgtggcagctgcctctcgtcggcagcctgccgcagtctcatcctgaacccgctcggtggcctcgctcatcgccccctgcgggacctgtccgctcggcacagcccgctcatgatgagccgactcggcgccgcgcccacccgggcggtgtcctcgggagaggctgccagggaagtgacgaggacctaacacaccgcgctcacaagagggagcctgacgccgacgctagccatgttcggcgactgccggcgcgacgtcctc

SEQ ID NO: 17573 - protein, 82 aa, Panicum virgatum
  misc_feature: Ceres CLONE 1792775
  misc_feature: SWISSPROT Homolog: EC 1.14.13.68 4-hydroxyphenylacetaldehyde oxime monooxygenase
TPRRRPLLSRGRSRRCACPPRRGSCLSSAACRSLILNPLGGLAHRPLRDLSARHSPLMMSRLGAAPTRAVSSGEAAREVTRT

SEQ ID NO: 17574 - DNA, 672 bp, Panicum virgatum
  misc_feature: Ceres CLONE 1792783-R
  misc_feature: Encodes the peptide sequence at SEQ ID NO. 17575
cggctggagcctgctggggcggcgcagcctggcggcgacgtcggaggcggaggcggaggcgtcggagtgctcggtgtgcctggaggagctccgggcgggggacgtgctggtgcacctgccctgcgcgcaccgcttccactggtcctgtggcgtgccctgggtccaggccgcctcgcgctgccccgtctgccgcgccctggtccacctcgcctcctgccctccccccaactgaccgacctgccgcgggatggcttggagtcttctcttcttcggccggacggagcaacgcgggaccgcgccgccgtgcgtggcagacccaggccatggacacgggcggatggcattggcaggcaggctgcgggtgaccgtgcgtgcgcgagatgcctcgtgtcgaggacaccgcagagtgggggtggggatcactggatcagggtcggatgatggtgcacggcgagacggagcactgaatcgatgagcgcatggagcgctgcgatcgcacggggcatcagtttcatggagccatgtgctgattagttttgcacagctgctcacgacgctggttatcccaaatctgtgtagtattcatctcaaaaaaaaaactgtctagttacggtccgtgttcagatttcagaacgtctggttgcctatccaagtcggttacggttacggccg

SEQ ID NO: 17575 - protein, 76 aa, Panicum virgatum
  misc_feature: Ceres CLONE 1792783-R
  misc_feature (23)..(63): Pfam Name: zf-C3HC4 Pfam Description: Zinc finger, C3HC4 type (RING finger)
GWSLLGRRSLAATSEAEAEASECSVCLEELRAGDVLVHLPCAHRFHWSCGVPWVQAASRCPVCRALVHLASCPPPN

SEQ ID NO: 17576 - DNA, 699 bp, Panicum virgatum
  misc_feature: Ceres CLONE 1792783
agaggtagaggtaggtagttgggccattggcattttggcacgccatcagcatgagctctcctcctccttcctaagttcctcctcctcctccctatagatagaaagctgctgctccccgtccaaaggagatgaggctcatgactggtcgtcggagatggccggcttcgtcctcgtcctcgtcctcttcctgctccggatggagggcttccacatacaccaatcgctcctagcgcctcctccgaatcccgtgtctcggggtcgtcgagcagtgcatgcgacacccgacacaatcacagggctaggtagctagcaagcatacatagcttgtggggagcgaggtcgttgcaggcggcgtcttgttgtcatcgctcgcatcgcagctgtcacgtttgtggtgcctctttgagttcgacggcggatggtcatcatggccgggatgctccccggcgtggagtgcgcgcggcggcggcggctccggcagggcgggtcgtcgtccggcgcggcggaggcgccgtgcgggacgcggcggccgtccttctgcctgtacgccggcggccacgaccacgcccaccttggctcggcggcggcctccaaggagaggagcagcagcagcgtgtgcaaggagatgatggcgcgcgcgtggacgctggacaccaacgcccgggaggcgaaggagagactggaccagaagctcagggg

SEQ ID NO: 17577 - DNA, 743 bp, Panicum virgatum
  misc_feature: Ceres CLONE 1792788
  misc_feature: Encodes the peptide sequence at SEQ ID NO. 17578
gcctctccccagctcggcagtcccaatccggtgatcccacaccctagccggaggcatcggccggcgcgcgcgatgcccaccaccgccttcgcccccgcctccgcgtcgccgcctccgtggtctactcgtccgcctcctcgccgcgcccgcgtccgtcttcctccgccgaggagcgggagcagcagcgatgggggccggggcgacgagcccacgacggccaccccgtgggtgagccccgactggctcacgtcgctctcgcgcgcggtcggccgcggcggcgccgacgactcggggatccccgtcgcgtccgccaagctcgacgacgtgcgggacctcctcggcggcgcgctcttcctgccgctcttcaagtggttccgcgaggaagggcccgtgtaccgcctcgccgcggggccgcgggacttcgtcatagtcagcgaccccgccatcgccaagcacgtgcttcgcgggtatgggtcgcgctacgagaaggggctcgtcgccgaggtctccgagtttctcttcgggtccgggttcgccaccgcggagggcgcgctatggacggtgagacgcagagctgttgtgccatccctgcacaaaagatttctttctattatggtggagaaggtattttgtaaatgtgccgagagattaatagagaaacttaagccatatgcttcgagtggggaacctgtcaatatggaagcgaggttttctcagttgacattggacgtgattggtttatc

SEQ ID NO: 17578 - protein, 223 aa, Panicum virgatum
  misc_feature: Ceres CLONE 1792788
  misc_feature: SWISSPROT Homolog: EC 1.14.14.1 Unspecific monooxygenase
  misc_feature: Functional homolog of the protein sequence given in SEQ ID NO 50773
  misc_feature: Useful for making plants with altered cell wall content and/or composition
MPTTAFAPASASPPPWSTRPPPRRARVRLPPPRSGSSSDGGRGDEPTTATPWVSPDWLTSLSRAVGRGGADDSGIPVASAKLDDVRDLLGGALFLPLFKWFREEGPVYRLAAGPRDFVIVSDPAIAKHVLRGYGSRYEKGLVAEVSEFLFGSGFATAEGALWTVRRRAVVPSLHKRFLSIMVEKVFCKCAERLIEKLKPYASSGEPVNMEARFSQLTLDVIGL

SEQ ID NO: 17579 - DNA, 1938 bp, Panicum virgatum
  misc_feature: Ceres CLONE 1792789
  misc_feature: Encodes the peptide sequence at SEQ ID NO. 17580
atccccacaggccacagccgccgcccgcccgcccgccccgtaatctccgacgccagtgcaccggccaccgaagccttccggccgagggtcctgctccgcgaccgcgcgacagcctacgccgcatggagatcgtgcggtcccaccggcagctcgctgccgcagccgccgccgccggcggaggcggcgcggggaccctgccgacctaccgggcggcgccgcagctggaggtgcggctggaggagttcgagctcttcgccatcgaccgcctccgtgttctcaaggggatctcggatgggctctcgcgggggaagaggccggaggagatggagaagctggtcagtgagttgtggaagacacacatgaggcaccaggatccagcagagactttgaacaaggatataatatcacactttgtgctccgcctagtctattgcagaacggaagaattacgaaagtggtttctctccatggagacttcactttttcggtatcgctttcggtttgagagtcctgaatcacagaggatgcttatgactgagtttcaactgccttacaaagcattgccacactcagaatttgaggttgtgaaagacaagttgagccaagttgcacgttccattggtcaatctgcaaatgttgagtccgtgttcttcaaggtaccttttgaagaagttcctgatcttgttgccagccgccgagtgtttctttcaaaaggctatgcttatgtggcaatgagccaggtggtttcattagtggttactcaattccggtgcaatatctcaaaggcacttgttttaacaaacagaaaatggacgacaacaataaaggaacaagaaaaggacaggttgactcctattgtcgaagcattaagcaatgcatattttggacctgattactctcagccgaaggatgctgttgaaatatctctaaaggatattgaccaactggctaaaagttctttccctctttgtatgcggcatatgctagataagttgagggaaaaccatcatctgaagcatggtggtcgaatgcagtttggacttttccttaagggtgctggactaaagttggaggacgccctggcattttggagagcggaattttctcagaaggttggctccgagcggtttgacaaggaatatgcctatagcatcagacataattatggaaaagaaggaaaacggacagattacactccatattcctgtcaaaagatcatttctgcaacacctggtgttggagatcatcatggatgcccttatcggcattttggtgatgaaaatttgcgggccgcactcaacaaaatgggcgtcggtgggcatgcattggaagagataatggataaagtgaagaacaggcattaccagctagcttgcacattgacctttgaggcaacacatggtgtctcctgtgattctggaatcaaccatccaaatcagtatttcagtgaaagtcagaaagttttgcgagccaaagtgggtgctgccatttactatacactttgactgtttttcttgtgctttgctgctattatctacctgagctaatcttccaatttaacatgtcgggatttaatgcacagaaccaaacagtggagagccaatcagcaacctaaattgtattgcagatgcagaaagcatccatctgcaaaaggttaccaggtcaacgctgaaccaaagattcacacttgatgcaattatgtgatggataccagatgctctttgatgcttagctggaatcctattggtacctggtgtttccaaactccagctagtggctgtcatactggacaagcgatgtcaccacattgcatactagaagggttacctagtgctgcgaacaacagcaggttaaggcgcgtgtttgtgtattcctgcaaatctcgaatgaatcaagaaacatattgaattaaagcagcaccgattttgctgttatgtt

SEQ ID NO: 17580 - protein, 460 aa, Panicum virgatum
  misc_feature: Ceres CLONE 1792789
  misc_feature (175)..(441): Pfam Name: DNA_primase_lrg Pfam Description: Eukaryotic and archaeal DNA primase, large subunit
MEIVRSHRQLAAAAAAAGGGGAGTLPTYRAAPQLEVRLEEFELFAIDRLRVLKGISDGLSRGKRPEEMEKLVSELWKTHMRHQDPAETLNKDIISHFVLRLVYCRTEELRKWFLSMETSLFRYRFRFESPESQRMLMTEFQLPYKALPHSEFEVVKDKLSQVARSIGQSANVESVFFKVPFEEVPDLVASRRVFLSKGYAYVAMSQVVSLVVTQFRCNISKALVLTNRKWTTTIKEQEKDRLTPIVEALSNAYFGPDYSQPKDAVEISLKDIDQLAKSSFPLCMRHMLDKLRENHHLKHGGRMQFGLFLKGAGLKLEDALAFWRAEFSQKVGSERFDKEYAYSIRHNYGKEGKRTDYTPYSCQKIISATPGVGDHHGCPYRHFGDENLRAALNKMGVGGHALEEIMDKVKNRHYQLACTLTFEATHGVSCDSGINHPNQYFSESQKVLRAKVGAAIYYTL

SEQ ID NO: 17581 - DNA, 736 bp, Panicum virgatum
  misc_feature: Ceres CLONE 1792794
  misc_feature: Encodes the peptide sequence at SEQ ID NO. 17582
atctcttggcttccactcctccccacccacgccccctccatttcgtcgtcgcttcccttgccgtgcgaatcctctgatcccatcgctgagccgcagccgcagcccaccggaggaaaccctagccagcgcgcccgccgaccgcagcagcagcagcagccgccccgcatggcgtccccggcccggcccgccgccgcctccgtctccagcgccttcggcctctcgcccgaccccaagcgctgctccttcgaccaggcgctccggcagaaggattttcaggagaacagaatgttgatgtcatttgttaatttccatgagcaagaaaaaatttctaaagaaattgtaacagaagcaatagagaactgcatgaagaaacaagcagataacttgttgaattcgctggaagtcatcagcggtaggctgtcacaattggagttatattgctataagctggaacggtctattggagaactacgaagtgatgtgatggattatcatggtgaagcaaatcttaactaccgttgccttgaaaagcatgtgaaagaggttcagcaatccgtggaggtccttcaggaaaagcaggagcttgcagagacccagaaagaaatgagcaaacttcagatagtacacgaggactctgcacaaaagagtgaaggtactgctccatctgttttcatggctagagaaaatgagctcgccctcgtgccgttgccccaagtaaatgctgtccagtctcctg

SEQ ID NO: 17582 - protein, 190 aa, Panicum virgatum
  misc_feature: Ceres CLONE 1792794
  misc_feature: Functional homolog of the protein sequence given in SEQ ID NO 50774
  misc_feature: Useful for making plants with altered carbohydrate content
MASPARPAAASVSSAFGLSPDPKRCSFDQALRQKDFQENRMLMSFVNFHEQEKISKEIVTEAIENCMKKQADNLLNSLEVISGRLSQLELYCYKLERSIGELRSDVMDYHGEANLNYRCLEKHVKEVQQSVEVLQEKQELAETQKEMSKLQIVHEDSAQKSEGTAPSVFMARENELALVPLPQVNAVQSP

SEQ ID NO: 17583 - DNA, 1004 bp, Panicum virgatum
  misc_feature: Ceres CLONE 1792797
  misc_feature: Encodes the peptide sequence at SEQ ID NO. 17584
gtttcagattccaggctttcaggaggattcgagaaggcgaaggcgaaggcgaggagcaagctgtactacatacagacttcggatatggaggaccagttccaggatggcaaggaggaggtcatccaagcatggtacatggatgacagcgaagaggaccagagtcttcctcatcatcgcgagcccaaagagttcattcctctagacaaactctcagaactaggaatattaagctggcgcctaaatgctgatgactgggagaatgatgagaacctcaagaaaattcgtcaagccaggggttactcttacatggacatttgtgatgtgtgtccagagaagttgccaaactacgaggctaagataaagaatttctttgaagaacacttgcatactgatgaagagatacgctattgtcttgagggtagcggctacttcgacgtgagggaccaaaatgatcagtggatccgtatagcagtgaagaaagggggcatgattgttttgcctgctggaatgtatcaccgctttacattggatacagacaactacatcaaggcaatgcgtctctttgtgggagagcctgtctggacgccatacaatcgtccccatgaccatctccctgctaggaaggagtatgtcgagagaatcatcaaccgaggtggaaaccaagctgttgaagctcgttgagtgtatactagcgtctctgcatgtttgcctgttgcgaggtggaaaccaagctgtcgaagttcgttgagtgtataccagcatctctgcatgtttgcttccagtctgcctgttgcgctacaccctagaagtactgctgaataagatcttctaccacaatcagcgcatgccaccatcatgctcgtgtgcgagtcaatagtttgcacaaaacctagatatttgtaatgtgaataatgtggcctttgatgcttgtgcacaatgattggcttgaggagaaggatgcttgaattcctcatagcaactctcctctcggcctggcgtggttc

SEQ ID NO: 17584 - protein, 198 aa, Panicum virgatum
  misc_feature: Ceres CLONE 1792797
  misc_feature (14)..(168): Pfam Name: ARD Pfam Description: ARD/ARD' family
MEDQFQDGKEEVIQAWYMDDSEEDQSLPHHREPKEFIPLDKLSELGILSWRLNADDWENDENLKKIRQARGYSYMDICDVCPEKLPNYEAKIKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVERIINRGGNQAVEAR

SEQ ID NO: 17585 - DNA, 1895 bp, Panicum virgatum
  misc_feature: Ceres CLONE 1792801
  misc_feature: Encodes the peptide sequence at SEQ ID NO. 17586
agatatccaaacccgacgacgcctcactccctcgccgctcgcgcgctccttcgcgccacgccccccgcgacggccggccggcgcgatgccgtccccggcgtcctacctcctcctgaaccccgcgaagccattctacctccgccgcctctcgcacccgcccacgccgccgtacccgtccccgcgcctccacgcccgccggctccatgtctcctgcgacgcgccgcgggggagcggcggcgttggcgggaggcgcgaggccatccccgccggcgccagcaaggccaagaagcagatcgtattcttcgacgccgcgccgccggtggcgcagccgcagccgcagccgcagccgcagcagggcgggagcgccgcagagaagggggagagcgggaaggcgacgaccaaggaaggcggcggcaacgcggcgctggcgctgctgaggagggcgaccaagaagactctgtcggcgctgtccaacctcccgctcgccatctccgagatgttcgccatcgccgccctcatggccctaggcacggtgatcgaccagggagaggcgccgagctactacttggagaagttccccgaggacaacccagtgttcggcttcatcacgtggaggtggatcctgacgcccgggttcgaccacatgttctcctcgacggtcttcctcggcctcctcgcgctgctcgccgcgtccctcatggcctgcacctacactacccagctccccatggtcaaggtcgcgagaagatggtccttcacacattccggagaaagaatcaagaagcaggagtttgcggactgtcttccccgagcatccattcaggatttgggtgtcatcttgatgggtgccggatatgaggtattcacaaaggggccgtccttgtatgctttcaaagggctggcaggtcggtatgcgcctattggcgtgcatttagcaatgcttttcatcatggctggagccacgcttagcgcaacgggaagcttcaaaggctcagtggatgtgcctcaggggctgaattttgtcataggagatgtgatgaaacccagaggggtcctctctgtcgcgcctgatgtttttaatactgaagttcatgtcaaccgattctacatggagtactatgatagtggagaggtcttacaattttatagcgatctttcactttttaaccttgatggtaaagaggtgatgaggaagactatcaaagtgaatgatcccctcaggtatggaggaatcacaatctaccaaacggactggggattttcagcattgcaagtgaagaaaaatggcgaaggacctttcaatttaaccatggcccccttgaaactgaatggcgataagaagctttttggaacgttcttgccgcttgaagactcggattcttcgaatccgagtgtcaaaggaatatcgatgcttgctcgagatctgcagtctatcgtgctgtatgatcaagacggcaagtttgtaagggtccgtcggccaagctcaaaactccccattgagatcaatggtaatgaaatactcattgaagatgctattggcagtactggacttgatcttaaaactgatccaggagttcctattgtgtatgctggatttggtgcactcatgctaacaacctgcattagttatctttcacactctcagatctgggcattgcaagatggaagtacagtagttgttggagggaagacaaatcgagccaaacttgaattttctgaagagatgaaccggttactcgataaagtaccagagctgatcggtgccaatcacgagaatgtagtagatagcaaatccactgctacatgagaacattttgtctgtttttttctcgaacacgcaggagaactgcgtatcattgtattgatagaagaagaaaagagtcatacatagaccc

SEQ ID NO: 17586 - protein, 573 aa, Panicum virgatum
  misc_feature: Ceres CLONE 1792801
  misc_feature (131)..(549): Pfam Name: ResB Pfam Description: ResB-like family
MPSPASYLLLNPAKPFYLRRLSHPPTPPYPSPRLHARRLHVSCDAPRGSGGVGGRREAIPAGASKAKKQIVFFDAAPPVAQPQPQPQPQQGGSAAEKGESGKATTKEGGGNAALALLRRATKKTLSALSNLPLAISEMFAIAALMALGTVIDQGEAPSYYLEKFPEDNPVFGFITWRWILTPGFDHMFSSTVFLGLLALLAASLMACTYTTQLPMVKVARRWSFTHSGERIKKQEFADCLPRASIQDLGVILMGAGYEVFTKGPSLYAFKGLAGRYAPIGVHLAMLFIMAGATLSATGSFKGSVDVPQGLNFVIGDVMKPRGVLSVAPDVFNTEVHVNRFYMEYYDSGEVLQFYSDLSLFNLDGKEVMRKTIKVNDPLRYGGITIYQTDWGFSALQVKKNGEGPFNLTMAPLKLNGDKKLFGTFLPLEDSDSSNPSVKGISMLARDLQSIVLYDQDGKFVRVRRPSSKLPIEINGNEILIEDAIGSTGLDLKTDPGVPIVYAGFGALMLTTCISYLSHSQIWALQDGSTVVVGGKTNRAKLEFSEEMNRLLDKVPELIGANHENVVDSKSTAT

SEQ ID NO: 17587 - DNA, 709 bp, Panicum virgatum
  misc_feature: Ceres CLONE 1792811
  misc_feature: Encodes the peptide sequence at SEQ ID NO. 17588
attcacaagtgcttgctcccatcagtacacacacacacacactcacaccggccggccggccaggcagccaacgacacagctctccctttcctttcctttcctccctgccttccttctccagcaagagatttctagctagctagggtttacactacagtaatacttgtaccgagccatcgatcgatcaccgctcctgcttccttggcaacgctgccgcccgaattccggcgtgcggcgtcaggcgcgctcgctcgctctcagctagctcaggggcggccggccatcccgtcagattcagcggaaggggccatggtgcaagttatttgagctcatctgagagggaggaagtgtggactcttggtcatgcttcttaagatgataaggggcaacctcacaaatgaagagctggcggccaggtgcaccaaggccgaggccccggccgccggcgccggcgccgtcgtcgccaagagtcccgccgtgccgagctcgcggcactggccgccgtccacggagtcgaggatcgtgcgcgtgtcgcgggtgttcggcggcaaggaccggcacagcaaggtgaggaccgtcaaggggctgcgcgaccggcgcgtgcggctgtccgtgccgacggcgatccagctctacgacctccaggaccggctgggcctcagccagccgagcaaggtggtcgactggctgctcgacsccgcgcagcacg

SEQ ID NO: 17588 - protein, 115 aa, Panicum virgatum
  misc_feature: Ceres CLONE 1792811
  misc_feature (46)..(115): Pfam Name: TCP Pfam Description: TCP family transcription factor
  misc_feature: The sequence is a functional homolog of SEQ ID NO 1202 in the 10/666,642 US patent application
  misc_feature: The sequence is a functional homolog of SEQ ID NO 184 in the 10/225,066 US patent application
  misc_feature: The sequence is a functional homolog of SEQ ID NO 2816 in the 10/374,780 US patent application
  misc_feature (112)..(112): Xaa is any aa, unknown, or other
MLLKMIRGNLTNEELAARCTKAEAPAAGAGAVVAKSPAVPSSRHWPPSTESRIVRVSRVFGGKDRHSKVRTVKGLRDRRVRLSVPTAIQLYDLQDRLGLSQPSKVVDWLLDXAQH

SEQ ID NO: 17589 - DNA, 660 bp, Panicum virgatum
  misc_feature: Ceres CLONE 1792811-R
ttaaaggactcatgggcttcagcaattcagtcggcctcgtcaatggcgcgatgccgctggctcacggattgtactacacgcccggtgaaccttgggcaaatggcaatgccgtccacgaccaagtgagccatgacacttcgcatcaaacggtggctcaccactcgccgttctcatcgctgctgtctctggctccggggcctcagctcgtcttctactcgccggaaggtggtggcttcgccatgaaagaagccgccgatcatcagttcccagtaggtaacctcgaccattcggaagggcagctctcactgagctcagcaagaagcttccttcaccccggcagccagggatgattaggtcactgatctctactgctccaagaaggtacgtagaacaataatgcttggtgtagtagtagtcaggtacggtacatggctgaaggttcgttaagcttatgattgcagttttgagatggtatttctacaaatagggggctccagagctacgtagacctgctagcatgcatagtaattaagcctttttttcagggtatgcaatgcaattcgttgcttcttttttatgcaaggaagtaactggtgctatggtgtgtgtgtgttggtttttgtaataacagtttattaatttttgaatctgttcttacct

SEQ ID NO: 17590 - DNA, 720 bp, Panicum virgatum
  misc_feature: Ceres CLONE 1792814
  misc_feature: Encodes the peptide sequence at SEQ ID NO. 17591
ctcgattattctgttcgctcaccaagtctacttccggtcgtctcccctccctctcgcccccagccacgcagccgccgcaggccggagggggcgccatggccgcgtcggatctggggagcaaggccaaggaggccttcgtcgacgacgacttcgagctcgccaccgagctctacacccaggccatcgacgccgggcccgccaccgccgacctctacgccgaccgcgcccaggcgcacatcaagctcggcaactacactgaggctgtggcagatgctaacaaagcaattgaacttgatcctacaatgcataaagcctactatcggaaaggtgctgcatgcatcaaacttgaagaataccaaactgcaaaggctgctctggaattgggtttgtcctatgcaaatggcgactcaaggtttactcgtctgttgaaggaatgtgaagaacgcattgctggtgagcaaacagaacactatacctcttaattagtatatatatttgcagcataggcaatatttttgacttgagtgtgcagtgtggtggatgccattatttgtgactacatgccctgtttgtcagtcttgttttgtcagaattttttacatcagccttgttttatcataattatctcacaggcgccatacttggtttattatgtgtgcagaggaggctagccaagcaccagtaaagaatgttgaggcacctgccactgctactgttgag

SEQ ID NO: 17591 - protein, 128 aa, Panicum virgatum
  misc_feature: Ceres CLONE 1792814
  misc_feature (37)..(70): Pfam Name: TPR_2 Pfam Description: Tetratricopeptide repeat
  misc_feature: SWISSPROT Homolog: EC 3.1.3.16 Phosphoprotein phosphatase
MAASDLGSKAKEAFVDDDFELATELYTQAIDAGPATADLYADRAQAHIKLGNYTEAVADANKAIELDPTMHKAYYRKGAACIKLEEYQTAKAALELGLSYANGDSRFTRLLKECEERIAGEQTEHYTS

SEQ ID NO: 17592 - DNA, 689 bp, Panicum virgatum
  misc_feature: Ceres CLONE 1792814-R
  misc_feature: Encodes the peptide sequence at SEQ ID NO. 17593
cgtctgtttgctaagattatcccagagaagagcaagtatcaggtcttatccaccaaagttgaaatacgccttgcaaaagctgaacagttgacttggacaaccctggactatagtggcagaccaaaggcccttccccagaagataagcacaccagctgaaactgctccaagaccgtcctacccatcttcgaagtctaaaaaagactgggataaattggaagctgaagtcaaaaagatggagaaagaagaaaaacttgatggtgatgctgcgttgaacaagttcttccgcgacatctacaaggatgctgatgaagatatgcggagggccatgatgaagtcatttgttgaatcgaatggcacggttctctcgacaaactggaaagatgttggatcaaagaaggtggaaggcagccctcctgatggaatggagctcaagaagtgggagtactagagttgggtccaccccatcttgtaaatccgggcctcgcgagacatcatgacctaattgcagacttgctggtcgctgtcagttcactcagttggattttgtgccatgcgcttggtcaagtttctgcatttgtaaggtgtctgtttgacgctctagcttgtctgagtactacctgtcgtagttctgctggacacatagggcatgctttgtctgtggtatcgagtgcggaacacattcgcacg

SEQ ID NO: 17593 - protein, 149 aa, Panicum virgatum
  misc_feature: Ceres CLONE 1792814-R
  misc_feature (66)..(147): Pfam Name: SGS Pfam Description: SGS domain
RLFAKIIPEKSKYQVLSTKVEIRLAKAEQLTWTTLDYSGRPKALPQKISTPAETAPRPSYPSSKSKKDWDKLEAEVKKMEKEEKLDGDAALNKFFRDIYKDADEDMRRAMMKSFVESNGTVLSTNWKDVGSKKVEGSPPDGMELKKWEY

SEQ ID NO: 17594 - DNA, 2567 bp, Panicum virgatum
  misc_feature: Ceres CLONE 1792833
  misc_feature: Encodes the peptide sequence at SEQ ID NO. 17595
actttattggaatttcctgcattgcatacaagctgcccctctttgtctatctgttcttaagccttcatctctcctccacctttcatctttcctgcctcttttgttttttgttttacctattctcctaggcatgcttggtatattatgatacagccagtcaaccatgtacttgcttaatttcaaaacgtgatgagacttgttcattgtgctctgcatgtatttgggtgatgttttccattcctttttggtcaacaagctatggtttcaaactcgccaatacttattttccatcattatttttcagagattgcactgaatgggacctatttgatgttttccccattctctatttgggcgctagctgatggatctccacatgaaacttctccttgtctccctcagctgtgttcttctgatgcaggcagcatcatgtgatggaaccacgggggaaactgaaatgacaaattggacatgtgtatgcgcagctcatccgctaggtgaatctaactctaacagcagcttgttgtccaattgctcttcgtcctgtcgttgccagcaagatgagaatggtggcacggggtcatggaactgcacatgtgcctctgacaagacccgtcagaaagaagaacatgctatgctacacgataggagttgcttcacttcctgtaactgtacatccggaagttcagaggaagggaaaagacatgtctccagtaaaacagtcataattacgctcctagtgtgcgtggttctcaccactactgcttttcttgtcaccactgtatactacattcgccgcaaggatgcgctctctcctcgttctcagatatactcctttgataaatacactagctggagcagcagatcaaaccttgtcagccatcgatcatctcctctcccccaactgaaaccgaaaccaaggctcagagttctcaaagagtttctatgtagctgccctatcatttgtgggagtgaaagtggcacattcccgggtgttgtcatcaggttttcgtactcagagttggatgaagcaactgggaaattctcagatgagcatcttattggagttggtggatcaagcaaggtataccgaggccagcttagcgatggcaaagttgttgccgtgaaaaagcttaggcccctgggaggtgccgacgaagacttcgagttcctgtctgagatcaagctgctgtcgaggctgaaccactgccacgtggtgccactgctggggtactgttcggagatccagagccggcagctggagagactgctggtgtttgagtgcatgtccaacggcaacctcagggactgtctggacctgaaacaaggtaggaagcccatggactggcagacccgggtgagcatcgcgcttggcgccgccaggggggtggagtacctgcacgaggcggcagcgccacggatcctccaccgcgatatcaagtccaccaacatcctcctggatgacaagttcagagccaagatcactgaccttggcatggccaagtgcttgatgaacgacggcgtgacgagctgctcgagctccccggcgcggatgttgggcacgttcgggtacttcgcgccggagtacgccatcgtgggcaaggcgtcactcaagtcggacgtgttcagcttcggcgtcgtgatcctggagctcatcaccggccggccgcccatcctcaagtcgtcgtccaccaggactgacgagagcctcgtcatctgggcaacgtcgcggctgcgagacagcaggctggtggtgacggagctgccggacccgacgctgcagggcaagttcccggcggaggagatgcagatcatggcgcacctggcgcgggagtgcctgcagtgggacccggaggccaagcccaccatgaccgaggtcgtccaaatcctctccaccatcgccccgacactccatggaacaaagcgccggaacctccccatcgccgccgccttcaacctcacgccgtcgccgcatgtcggaagatacgatccagagcccgccgacatcgagaggcagcaggagtgctcgacgacgtccgcgcagtggcagcaagggcggtgcgcgccgccgccgggccgcgcgtcctggcccggcgacaggaacaagggcgcggcgggcggcggtgcggtggtgtcgggcgagctagtgaatgggatgctactgatgatgagcccccatgggcggagcagctggcggccgccgccgggcgacgacgaggaggaggtggtggacctgacggagccccgactggagacgttcacgccggcattgttcagatgattcattacttcgtttgccgtcgtcgccgccgtggctcatccagctggctgcagcgcgcccatgctcggctcccgttcgcatcctccgctccgcctccacgcgcgctttgcggtcgcggccttgtcggccatcaccggcggcaccggcgtcggtcaccattctccaacatacctgacgtgggcggcacccgatgaatattccagccgtaccgacaaatcctaatagcaaaacagctcaaacagttgataatctctacagagtaatcaaattcttttgattgcatttc

SEQ ID NO: 17595 - protein, 638 aa, Panicum virgatum
  misc_feature: Ceres CLONE 1792833
  misc_feature (227)..(509): Pfam Name: Pkinase Pfam Description: Protein kinase domain
  misc_feature: SWISSPROT Homolog: EC 2.7.11.1 Non-specific serine/threonine protein kinase
MDLHMKLLLVSLSCVLLMQAASCDGTTGETEMTNWTCVCAAHPLGESNSNSSLLSNCSSSCRCQQDENGGTGSWNCTCASDKTRQKEEHAMLHDRSCFTSCNCTSGSSEEGKRHVSSKTVIITLLVCVVLTTTAFLVTTVYYIRRKDALSPRSQIYSFDKYTSWSSRSNLVSHRSSPLPQLKPKPRLRVLKEFLCSCPIICGSESGTFPGVVIRFSYSELDEATGKFSDEHLIGVGGSSKVYRGQLSDGKVVAVKKLRPLGGADEDFEFLSEIKLLSRLNHCHVVPLLGYCSEIQSRQLERLLVFECMSNGNLRDCLDLKQGRKPMDWQTRVSIALGAARGVEYLHEAAAPRILHRDIKSTNILLDDKFRAKITDLGMAKCLMNDGVTSCSSSPARMLGTFGYFAPEYAIVGKASLKSDVFSFGVVILELITGRPPILKSSSTRTDESLVIWATSRLRDSRLVVTELPDPTLQGKFPAEEMQIMAHLARECLQWDPEAKPTMTEVVQILSTIAPTLHGTKRRNLPIAAAFNLTPSPHVGRYDPEPADIERQQECSTTSAQWQQGRCAPPPGRASWPGDRNKGAAGGGAVVSGELVNGMLLMMSPHGRSSWRPPPGDDEEEVVDLTEPRLETFTPALFR

SEQ ID NO: 17596 - DNA, 737 bp, Panicum virgatum
  misc_feature: Ceres CLONE 1792834
  misc_feature: Encodes the peptide sequence at SEQ ID NO. 17597
aagcgaagcggctgcacgcgcgcctgctccgccgcggcgagcgccgcctgcagccgctgctcctccgcgtgctcgccgccggcgacctccgctacgccgcgctcctgctcgagtccttctcttcgtcctcgtctcctccctccgcgccgctccacaaccgcctcctccacgcgctcgcctccgcccgccacccgctgctgctccccttcttctcccgcgcccaccgcctccgcctcctcaccccgctctccttcaccctgctcttctcctcctccgccgccgccgcatcctcatcgtccacgcgtttcgcggtgtgcgcccacgccttgctgatcaagtccgggcacttcgcgtccgccggcgacccgttcctcgcctccgcgctcgtctccttctacgccaagaaccgcctcctggctgaagccaggctggtgttcgacgagttgccctgcagggacgcagccgtgtacaatgcgctgctctcagcgtacacaaggggcgggctcatcgacactgcggagaagctgttcgaggaaatgcctgagaagaatgtggtttcttggaccgcgatggtgtccggttacgcgcagaacgggaagcacgagcaggcggtagagacattcttggagatgtgggagaaggaaggtgtgcgacccaatgagctcacagtgagcagcgtactgcctgcgtgcgcggatgttggggcgatggagctggggaggaaggtggagaagtac

SEQ ID NO: 17597 - protein, 244 aa, Panicum virgatum
  misc_feature: Ceres CLONE 1792834
  misc_feature (185)..(219): Pfam Name: PPR Pfam Description: PPR repeat
AKRLHARLLRRGERRLQPLLLRVLAAGDLRYAALLLESFSSSSSPPSAPLHNRLLHALASARHPLLLPFFSRAHRLRLLTPLSFTLLFSSSAAAASSSSTRFAVCAHALLIKSGHFASAGDPFLASALVSFYAKNRLLAEARLVFDELPCRDAAVYNALLSAYTRGGLIDTAEKLFEEMPEKNVVSWTAMVSGYAQNGKHEQAVETFLEMWEKEGVRPNELTVSSVLPACADVGAMELGRKVEK

SEQ ID NO: 17598 - DNA, 733 bp, Panicum virgatum
  misc_feature: Ceres CLONE 1792835
  misc_feature: Encodes the peptide sequence at SEQ ID NO. 17599
atcctccggtcagaattgccctcccaagcccaaccaaccccgcgacgcgacccataccaggctccttcctcctccctccccccgtccccgcgcgcggctccgcccctcccaccggacaatcatttcgcttgtgacttccaagttccaccgcagcagccgccaccgcgcacatgccgcctgctcctgtctcgtatagtatatagccgcgggcgaggcggcgatgatcaggccgcaggccgggctgctgctgcggtcgctgggagcgggaggaggcgcgcgccccgccgccatgaggtcggccacctcgctcctcctcggcgccgcgctcgccaccgccttcttcctcctctacacctccctctgccgcgacatcggcggctcccccgggacgccgccgccgcggtgggagcggcgggaggccggtaaggccgtcgagacgggcgccgccgctgttgccgatcgggaggtgcgggacctcaaccccaagcaacgagaacatgtcgccagggaggaagagaggaggaaagtggaggtgacgcacagcgacggcgacggcggcggcggacacggcgccagaaaagatgaggagaacggccgggacagcgagcaggagcagccgcagcagattgtgatgccttctgcgacttcgactcctaccgagcagcagcagcaccagcaggagacccccgtcgaggacgacctggccggacctgctccggcgagcggcgacgtc

SEQ ID NO: 17599 - protein, 147 aa, Panicum virgatum
  misc_feature: Ceres CLONE 1792835
  misc_feature: Functional homolog of the protein sequence given in SEQ ID NO 50775
  misc_feature: Useful for making plants with altered carbohydrate content
MRSATSLLLGAALATAFFLLYTSLCRDIGGSPGTPPPRWERREAGKAVETGAAAVADREVRDLNPKQREHVAREEERRKVEVTHSDGDGGGGHGARKDEENGRDSEQEQPQQIVMPSATSTPTEQQQHQQETPVEDDLAGPAPASGD

SEQ ID NO: 17600 - DNA, 2399 bp, Panicum virgatum
  misc_feature: Ceres CLONE 1792839
  misc_feature: Encodes the peptide sequence at SEQ ID NO. 17601
acgggccaccccgattcattcggccttccccttccgcctccctaccgcggctgctacggcgacccaacccgaccccacctccctccgccgccgccgccgccgccgccgctcaccgcgccctcgccgagcagagctagggtcccggcggccggagccctcagcgctgccatcttccgtccacgcgtccgagcggtaccggaggctctcgcgtcctcggctcccacgcccgtccccggcggcgatccggccggccccagaaccctagggctccgccgcgtcaggaatgatgagtcatcaaccgcaaatggcccctccgagtaggggttctgtgaatggactgtcccatcgaaagctggacagggagagtagcgggaggcatgacaataaaacaaatttggtgagatcatcatctggtggtcttactggtgcagaaaatggcatcaaactagggcatacaagctattcgagggatcggctaatctatgttctaacacaacttattgggcatcacgtgaatgtgcatgtgaaaaatggctctataatctctggaatttttcatgcaacaaactctgacaaagactttggagttgtcttaaaaatggctcagatcataaaggatagttctgccagaggacaaagatttggtgctgatgttgtaaagaagcctgagactatgataataccagcaagggagcttgtccaagttttggccaaggatgtagcacttggtggtgatgagctgccaaaaggtcctggccatgacaaaaggaaagacttactgattgattctgctatttcccgcactcattatcttgaagagagagaacttgagcggtgggcaccagatgatggagattcagagtgtatcgaactggagaaatatgacagaaaagggaataggagctgggaccaatttgaaaccaatgcagctttgtttggggtaaagagtactttcaatgaagaaatttataccacaaagcttgagagaggtcctcatatgagagaacttgaaaagcatgcttcaagaatagctagagaaatagagggagaagataccaaagatattcatcttgcagaggaaaggggcttattcctgggtgatgacttggaccatgatgaagagataaaatattcagcagtgcatagagacacagataacagcaaatacaagtcatttacaaatgtcccaagcagtacacatcatgttgattcatttaacaggacagccaacattgatcccaaggattcactggcatgttcatcaacaatggatgaagaatcatcttcctacatatttgatggtaccgattcatatgccaatatccaaaccaataatgttagccagccaacatctgatgacccatccttttctattgacgaaagcaggttggacaagaagctaagcaaagatggtaatgacaacttggataaaagaaagttgcaacctgagaatactttatctggtggtggcagaccgcttatttctgaagggttggatggaccaccttcaagttcacatgcatatgaaccctcatcttctggtcaaggattcaaatctccagaaaccccagattcaacagtatctgtcaaacatccttctgcagtggaacctgtgacatcctctcaaagacctggtagttcgacgtcttcgatgtcggagcgcattgctgcaaactcggtggcaagcgctcctggcttgtcgccaagctcttcaataggatctctgacctcagaaaagtcaactctgaacccaaatgctaaggaattcaagctaaatcctaatgccaagagcttcactccatcagcatctctgaggccaccacctcctccagcatctgatgcatcatactactatcctaacaacatgccggcggcaccacttggacctggtttaccagtgggcatggggttccctccagcatatggtggccaacctgtcatgtataatactcaacctggaacaccaccccagggttacatgcatcctgctgggccgcagtatgggcagcagatgatgatgggacagactcgtcctgtgtattattatgcacctgagatgcaacaatacagaggaagaaacttctaaatcatactattttgaactgctgctggatgaaagtcgcagcaacccccactgatgggattgtaaccaggcaaaagccgctattagaatggaaagaactggtgatgatctcacaccgacttgtgtgctgcttggattgctttgacaaaaggctcatcattgctccatacctgtgttcatctcaggaggcagttcattatttttgtcgacttttgatgtaaattaaattgcgggtcatctgttggaccctgaaatgaaattcataaatgcgtgattgtcccattgtaatgtaatgttttatgctttgcgttccttc

SEQ ID NO: 17601 - protein, 593 aa, Panicum virgatum
  misc_feature: Ceres CLONE 1792839
  misc_feature (485)..(502): Pfam Name: PAM2 Pfam Description: Ataxin-2 C-terminal region
MAPPSRGSVNGLSHRKLDRESSGRHDNKTNLVRSSSGGLTGAENGIKLGHTSYSRDRLIYVLTQLIGHHVNVHVKNGSIISGIFHATNSDKDFGVVLKMAQIIKDSSARGQRFGADVVKKPETMIIPARELVQVLAKDVALGGDELPKGPGHDKRKDLLIDSAISRTHYLEERELERWAPDDGDSECIELEKYDRKGNRSWDQFETNAALFGVKSTFNEEIYTTKLERGPHMRELEKHASRIAREIEGEDTKDIHLAEERGLFLGDDLDHDEEIKYSAVHRDTDNSKYKSFTNVPSSTHHVDSFNRTANIDPKDSLACSSTMDEESSSYIFDGTDSYANIQTNNVSQPTSDDPSFSIDESRLDKKLSKDGNDNLDKRKLQPENTLSGGGRPLISEGLDGPPSSSHAYEPSSSGQGFKSPETPDSTVSVKHPSAVEPVTSSQRPGSSTSSMSERIAANSVASAPGLSPSSSIGSLTSEKSTLNPNAKEFKLNPNAKSFTPSASLRPPPPPASDASYYYPNNMPAAPLGPGLPVGMGFPPAYGGQPVMYNTQPGTPPQGYMHPAGPQYGQQMMMGQTRPVYYYAPEMQQYRGRNF

SEQ ID NO: 17602 - DNA, 670 bp, Panicum virgatum
  misc_feature: Ceres CLONE 1792842-R
  misc_feature: Encodes the peptide sequence at SEQ ID NO. 17603
ggcgagcagatcatgaaaggttacctgaacgaccccgagtccacgaagaacaccatcgacaaggacggctggctgcacaccggggacatcggctacgttgacgacgacgacgagatcttcatcgtcgacaggctcaaggagatcatcaagtacaaggggttccaggtgccgcctgcggagcttgaggccctcctcatcacgcacccggagatcaaggacgctgctgtcgtatcaatgaaggatgatctcgccggtgaaatcccggtcgccttcatcgtgcggacagaagggtctcaactcaccgaggatgagatcaagcaatttgttgccaaggaggtggttttctacaagaagatccacaaggtcttcttcaccgactccatccccaagaatccttcaggcaagatcctaaggaaggacttgagagccaggctcgccgccggtgtccactgaggccgcagtgtttcagtcggccacactgttgagaaaaggccatgcaataggtggtaccattgttcatgaaatggcagcagaaggggcacctaatcttgtggaaacatatatgttgccgaaagaggttttagtttgtttgttggttggccctgtgtggtgtaatgttcataaatgatatatatagatgcatctagctatattgtttttgaccaaacgg

SEQ ID NO: 17603 - protein, 150 aa, Panicum virgatum
  misc_feature: Ceres CLONE 1792842-R
  misc_feature: SWISSPROT Homolog: EC 6.2.1.12 4-coumarate--CoA ligase
  misc_feature: Functional homolog of the protein sequence given in SEQ ID NO 50770
  misc_feature: Useful for making plants with altered carbohydrate content
  misc_feature: Functional homolog of the protein sequence given in SEQ ID NO 50497
  misc_feature: Useful for making plants with altered cell wall content and/or composition
  misc_feature: Functional homolog of the protein sequence given in SEQ ID NO 50496
  misc_feature: Useful for making plants with altered lignin content
GEQIMKGYLNDPESTKNTIDKDGWLHTGDIGYVDDDDEIFIVDRLKEIIKYKGFQVPPAELEALLITHPEIKDAAVVSMKDDLAGEIPVAFIVRTEGSQLTEDEIKQFVAKEVVFYKKIHKVFFTDSIPKNPSGKILRKDLRARLAAGVH

SEQ ID NO: 17604 - DNA, 106 bp, Panicum virgatum
  misc_feature: Ceres CLONE 1792842
aggaagagccggcggccgccgcggcggcggcgcccgcggcggaggcggcgcaccgggcccagcggcaggacagccagagcaacgcggaccacggcgcggcgcacgg

SEQ ID NO: 17605 - DNA, 1772 bp, Panicum virgatum
  misc_feature: Ceres CLONE 1792846
  misc_feature: Encodes the peptide sequence at SEQ ID NO. 17606
gcatctaccccctcttctccgcagtcgagggcaggcgacgacggcgaggtgcgcctccgtctccggcccttatcgagttgccatcgccggcgtcaacttcacccgcggtgagctcgctgcagctcaccggaaggtgctgccaacttggaggatggcagatgaggaactagctccaagctctaagaagagggttgcagatacccaaatcaacaaggataatcctgagcctgatgatgacggaccagagcaagaaatgggtacgttcaagaaagctagtgaggaagtaatggcaacccgaagaattgtaaaggttcggcaccagcaaccatcatcagtaccttcttctaatcctttctctgcaatcagatttgcccccactgattctagtgcccaagcaagtgccccggtccaagagcctcaatcttcaaatgtcaaagctgatgagggcagcaatggtagtgggaaaggtactttatctgtgccggacaagaatgcaggctctggtgaggtatctgagattccaaaggatgaatcaactgtaaatactggtgccgcaactgaagcaccacctcaagccgttgaaaccagtgatgaggcagaaggcacaaaggatggatctgttggagacaaagtggtagtcggagaacccaacaaaggtaacaacatatcatctgaaattgagagcaaaacaaaaggaggatatgctgaagaaaaggaagcggcagatgaagccgagaataaagataaaattagcaaggatgatactgacaagaaagatggaggtgaatcagagaccagcaatgggttgtctgaagagcagaaagttgctgataacaaagggcagacttcatcagcaacacctcttttctccttcaagaatctgtccagtggtcaaaatgccttcacaggtctagctggaactggattttcaagctcatcattctcatttggttcagcctctaaagatgactctagtgctggtaccctatttggtttgaagactgatggttcttcgttcccttcttttaatcttggtgctaacaactcagctcttgctacttcagtagaggcacccaagaaatttgctatgacagatggccctgttgaaactggtgaagaaaacgagaaggctgtatttactgctgattccgctctgtatgaatacttagatgggggctggaaagaaagaggaaaaggtgaactgaagctgaatatccctgtatctggtggtgagagggctcggcttgtcatgaggaccaagggcaactaccggttggtcctgaacgcaagcctctacgacgacatgttgctcaaggacatggacaagaagggcgcgacatttgcctgcgtgaacagcatcagcgagtcgcagagcggccttgccacgtttgccctgaagttcaaggacatcactatcagggaggagttcaaggacgcggtggaggctcacaagatgaggaaagcacctgaagcgccgctgaagacgactgagaactcgccgaagtcagcagaggtctgaagctgcaccctggtcacacttgcgcatcctctatacgtgtctaggaaggagctagggagatactgtcagttgccgcggagtgttttaagtaagaacatcgtatcatgccatgatgtccagagtttgggtcatacggttccctgatgctgtttctggaacagggggaagcctgtcgaactttcattgttacagtcataacctagtaacctggagatgagactcttttgctctatatatggttttgtattttgct

SEQ ID NO: 17606 - protein, 455 aa, Panicum virgatum
  misc_feature: Ceres CLONE 1792846
  misc_feature (10)..(292): Pfam Name: NUP50 Pfam Description: NUP50 (Nucleoporin 50 kDa)
  misc_feature (317)..(436): Pfam Name: Ran_BP1 Pfam Description: RanBP1 domain
MADEELAPSSKKRVADTQINKDNPEPDDDGPEQEMGTFKKASEEVMATRRIVKVRHQQPSSVPSSNPFSAIRFAPTDSSAQASAPVQEPQSSNVKADEGSNGSGKGTLSVPDKNAGSGEVSEIPKDESTVNTGAATEAPPQAVETSDEAEGTKDGSVGDKVVVGEPNKGNNISSEIESKTKGGYAEEKEAADEAENKDKISKDDTDKKDGGESETSNGLSEEQKVADNKGQTSSATPLFSFKNLSSGQNAFTGLAGTGFSSSSFSFGSASKDDSSAGTLFGLKTDGSSFPSFNLGANNSALATSVEAPKKFAMTDGPVETGEENEKAVFTADSALYEYLDGGWKERGKGELKLNIPVSGGERARLVMRTKGNYRLVLNASLYDDMLLKDMDKKGATFACVNSISESQSGLATFALKFKDITIREEFKDAVEAHKMRKAPEAPLKTTENSPKSAEV

SEQ ID NO: 17607 - DNA, 2338 bp, Panicum virgatum
  misc_feature: Ceres CLONE 1792851
  misc_feature: Encodes the peptide sequence at SEQ ID NO. 17608
ccacgccgccgccgtggtcgtggtcgccacccaccacgactcttccaccccgagaccctcctccgcccatttcgatttcgagccacacggcagcgcggcgagagatcgattgaaaagcgggagccgtgttgagcgcgaccaaggagagccgggcgccccggcggcgatggagcgcggcgaccacggcggccacccgccgcactacccgccgtaccaccacccgtacccgcagccgcagccgtatccttacgggtaccagtacccgccgccgccgcccgccgaggcgggagcgccgtacctcgctccgtcgcccaccttcccgggctacgcccccgccccgccgcagcagtaccactccggccagctacaggcctaccccccgccggcgcagcaccacgcgtacccgccgccggcgcatccctcgccttacggccccgggtacggaccctacccctcctcctcctcctccccgtacccatcctcctacccgagccccaaccagagccccgcgctctcaccaagctccagcttccaccaccagcacgcccccgcgcctgaacccgcctacaccgcgcctgaacctccctcggccgcgccctccgccccgtcctaccccatcgaggatgtcctctccaccatgcgcctctccgaccgttacgactacgcgccgtctccctccgtgcccccgccctcgacccccttctcgggcggcgggatgcaggtggtgccctacggtgcgcccgcgggaggcgggagcagccacggcggtgggatgcaggtggtgccctacggcgcggccgggggagggtcgcagcacggcgggagcttcagggcgtcgctcaaggtggtgttgctccacggcaccctcgacatctgggtgcacgacgcacgccacttgcccaacaaggacatgttctccaagagggtcggcgaactcctcggcccgcgcatcaccagtgccgtcggcagcaagatgtccagcgcgtccatgaccagcgacccctacgtcaccgtacaggtctcctatgctaccgtcgcgcggacctacgtcatccccaattgcgagaaccccgtctggtcgcagaactttgtcgtgcccgtcgcgcatgaggccgccgaagtccagtttgttgtcaaggacagtgatgtcttcggtgctcagatcattggtgcggtggccatctccgctgagaagcttttgacaggggagaggattcagggtgtctaccctctgcttgagcccaatggcaagccgtgcgccccgggagctgtcctgcatctgtccatacagttcatccctgtcgcttgcctcacaatgtaccaccatggggtcattgctggtccggacagtcatggcgtaccccatacttacttcccacttaggcgtggcatgagggtgacactgtatcaagacgcgcatgtgcctgatggttgtctcccagatatatggcttggcaatgggctgcgctacaagcacgggcagtgctggcgcgacatctatgaggccatatgccaggcgaggaagttgatttacattgtggggtggtcagttttccacacgatccaccttgtgagagacgggactcaggctccatcacttggggacctgttgaagatgaagtcacaggaaggtgtccgggtgcttctacttgtttgggatgatccaacatcaaggagcattcttggatttaagatggatggtttcatgggcacacgagatgaggagactcgcagatttttcaagcattcttcagttcatgtgttgctttgcccacgatctgctggaaaacgacacagctgggtgaaacagcaggaaacgggaaccatatttactcatcatcagaaaacagttattgtggatgctgatgctggcaactatagaagaaagataattgcgtttgtcggaggccttgacttatgtggtgggcgatatgatacaccttggcatcctttgtttcggactcttcagactgtgcacaaggaggactattacaatcccaactttgctacagttgatgcccgtggcccaagggaaccgtggcatgatttgcactctaagcttgacggtccagctgcttatgatgttctacaaaacttccaggaacgttggttaaaggcagctaaacgccatgggattaaaaagttggcaaaatcgtattatgatgctctgctcagtattgaaagaataccagagtttataaacataaatgatgcaacatattttagcgacagtgatccagagacatggcatgttcaggtgttccggtctattgattcaaactccgccaagggatttccgaaggatccacgagcagcaaccatgaagaatcttgtttgt

SEQ ID NO: 17608 - protein, 723 aa, Panicum virgatum
  misc_feature: Ceres CLONE 1792851
  misc_feature (234)..(338): Pfam Name: C2 Pfam Description: C2 domain
  misc_feature (553)..(588): Pfam Name: PLDc Pfam Description: Phospholipase D Active site motif
  misc_feature: SWISSPROT Homolog: EC 3.1.4.4 Phospholipase D
MERGDHGGHPPHYPPYHHPYPQPQPYPYGYQYPPPPPAEAGAPYLAPSPTFPGYAPAPPQQYHSGQLQAYPPPAQHHAYPPPAHPSPYGPGYGPYPSSSSSPYPSSYPSPNQSPALSPSSSFHHQHAPAPEPAYTAPEPPSAAPSAPSYPIEDVLSTMRLSDRYDYAPSPSVPPPSTPFSGGGMQVVPYGAPAGGGSSHGGGMQVVPYGAAGGGSQHGGSFRASLKVVLLHGTLDIWVHDARHLPNKDMFSKRVGELLGPRITSAVGSKMSSASMTSDPYVTVQVSYATVARTYVIPNCENPVWSQNFVVPVAHEAAEVQFVVKDSDVFGAQIIGAVAISAEKLLTGERIQGVYPLLEPNGKPCAPGAVLHLSIQFIPVACLTMYHHGVIAGPDSHGVPHTYFPLRRGMRVTLYQDAHVPDGCLPDIWLGNGLRYKHGQCWRDIYEAICQARKLIYIVGWSVFHTIHLVRDGTQAPSLGDLLKMKSQEGVRVLLLVWDDPTSRSILGFKMDGFMGTRDEETRRFFKHSSVHVLLCPRSAGKRHSWVKQQETGTIFTHHQKTVIVDADAGNYRRKIIAFVGGLDLCGGRYDTPWHPLFRTLQTVHKEDYYNPNFATVDARGPREPWHDLHSKLDGPAAYDVLQNFQERWLKAAKRHGIKKLAKSYYDALLSIERIPEFININDATYFSDSDPETWHVQVFRSIDSNSAKGFPKDPRAATMKNLV

SEQ ID NO: 17609 - DNA, 615 bp, Panicum virgatum
  misc_feature: Ceres CLONE 1792851-R
  misc_feature: Encodes the peptide sequence at SEQ ID NO. 17610
cagagagcctggaatgcatgaggcgggtgcgacatcttggggaagagaactggaagcagttcgttgctgacgaggtgacagagatgagaggtcacctcatgaagtatccagtaagcgttgaccgtaaaggcaaggtgaaaccactaccaggatgcgtgaccttcccagatttgggtgggaacatctgtggctcatttatggccatccaggaaaacctcacaatttgaattttagttggtgcaattatacaatagctgatggcttatgaaattgtgaggtaccccagataacaaaatagtgcactaacttaggctgaaaattttgcaagaggtatagtataggttgcagcaggcaagtaggggaaacggtatcagggcctttccccccttcatgcttttgcccttttccttgattcttttagtgcatatatacccacccaatcaatttgttacctttgtttggtacctgtaaagaaaaatatgtggttcatggatatgacattttagaagtgccaagaagttacatgtaaatcctgaaaattgtcttcatgtaaattgatcctgcagagtgttttgaagtattggccattgaattgcatttcgcttttcagtattc

SEQ ID NO: 17610 - protein, 74 aa, Panicum virgatum
  misc_feature: Ceres CLONE 1792851-R
  misc_feature: SWISSPROT Homolog: EC 3.1.4.4 Phospholipase D
ESLECMRRVRHLGEENWKQFVADEVTEMRGHLMKYPVSVDRKGKVKPLPGCVTFPDLGGNICGSFMAIQENLTI

SEQ ID NO: 17611 - DNA, 626 bp, Panicum virgatum
  misc_feature: Ceres CLONE 1792854
  misc_feature: Encodes the peptide sequence at SEQ ID NO. 17612
ctctctctcactctcgacgcgaatcggagcgcgaagcatctcggcgtccttctcctcatccgccacttcactcttacgcgctaagcaaccggccggccccagctcccagtcccagctccggagccggagcagcgggggttctggggcgcgatgtcgtcgccgacgggcgcgccggcgccgaccacgccgccagccccgccggccaacgcgaccaccccaccgccgccgaccccgtccgcgccgccgccgtccgccccggcgtcacccgccccgccagcgccgtccccgccggcccccgccgcgccgccgccctcctccccatccgtcccggcgcccgcgacccccgccgcgtccccgccctcgccctcctcctccaccccgacgacgccctccgcgccgtcgccctcctcccccggtgggggcacgcccgccgcgccgtccccgccctccgacacgccctcgccgccgtcgtccgggggagggggcggcaagtccccctccacgccgtcgtccggcaggtcgccgtccacgccaagccactccccgtccccgcccaagtcccactgggggggcggcggcggcaacgggccctccaggtcgctcgtggtgggcgtggccgttggcgg

SEQ ID NO: 17612 - protein, 158 aa, Panicum virgatum
  misc_feature: Ceres CLONE 1792854
  misc_feature: Functional homolog of the protein sequence given in SEQ ID NO 50206
  misc_feature: Useful for making plants with altered carbohydrate content
MSSPTGAPAPTTPPAPPANATTPPPPTPSAPPPSAPASPAPPAPSPPAPAAPPPSSPSVPAPATPAASPPSPSSSTPTTPSAPSPSSPGGGTPAAPSPPSDTPSPPSSGGGGGKSPSTPSSGRSPSTPSHSPSPPKSHWGGGGGNGPSRSLVVGVAVG

SEQ ID NO: 17613 - DNA, 620 bp, Panicum virgatum
  misc_feature: Ceres CLONE 1792854-R
  misc_feature: Encodes the peptide sequence at SEQ ID NO. 17614
acctccaccatcccctggcgctgcccttggcttctcgaagagcacattcacgtatgaagagttggtgagggcaactgatggattctctgatgctaatctccttggacaaggtggttttgggtacgtccacagaggattgctgccaaatggcaaagagattgctgtaaagcaattgaagcttggaagtggccagggagagcgtgagttccaggctgaggttgagattatcagccgagtacatcacaaacatcttgtgtctttggttggttattgcatttctggaggcaagaggttgcttgtttatgagtttgtccccaacaacacattggaattccacttacatgggaaagatcgaccggcaatggagtggcccactagattaaagattgctttgggcgctgccaagggtttagcgtaccttcatgaagactgtcatccgaagatcattcaccgtgatataaaggcatcaaacattcttcttgacttcaaatttgaagctaaggttgcggattttggacttgcaaaattcactactgataacaacacccatgtttcaacaagagtaatgggcacattcgggtatttggcacctgagtatgcgtcttccggcaagctctcag

SEQ ID NO: 17614 - protein, 206 aa, Panicum virgatum
  misc_feature: Ceres CLONE 1792854-R
  misc_feature (28)..(205): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50776
  misc_feature: Useful for making plants with altered carbohydrate content
  misc_feature: Functional homolog of the protein sequence given in SEQ ID NO 50524
  misc_feature: Useful for making plants with modulated nitrogen use efficiency
  misc_feature: Functional homolog of the protein sequence given in SEQ ID NO 50301
  misc_feature: Useful for making plants with modulated heat sensitivity
PPPSPGAALGFSKSTFTYEELVRATDGFSDANLLGQGGFGYVHRGLLPNGKEIAVKQLKLGSGQGEREFQAEVEIISRVHHKHLVSLVGYCISGGKRLLVYEFVPNNTLEFHLHGKDRPAMEWPTRLKIALGAAKGLAYLHEDCHPKIIHRDIKASNILLDFKFEAKVADFGLAKFTTDNNTHVSTRVMGTFGYLAPEYASSGKLS

SEQ ID NO: 17615 - DNA, 1778 bp, Panicum virgatum
  misc_feature: Ceres CLONE 1792860
  misc_feature: Encodes the peptide sequence at SEQ ID NO. 17616
aaactttattcgaaaaataaaaaaaaggagaagctgaagctggataggcgctagcgagggaggcggccggggcaggacagattcgcagatggcgatcggcgcgttcgcggaggccgctccggcggacggcggggaaggatacagcggccgcgtgacgccgttcgtgctgctgtcctgcgtcgtcgccggcagcggcggcatcctcttcggctacgacctcggcatctccggtggtgtcacctcaatggactcgttcctgaagaggttcttcccggaggtttaccgtcagagtcaggcgcaggacaccagagtgagccactactgcgagttcaacagcgagctcctcaccttgttcacgtcctccctgtacgttgctggccttgtcgcaactctcgttgcggcttccatcacaaggaggtatggccgccgtgtgtcgatgctcatcggtggcaccgtcttcgtcgctggctcagtgttcggtggcgcagctgtaaatgttcccatgcttatccttaaccgaatcctactcggaattggtctgggattcactaatcagtctatcccattgtacttgtcggaaatggcgccgccgcgataccgtggggcaatcaacaatggctttgagctttgcatcagccttggcattctctttgcaaacatcctcaactattttgttataaaaattacagcaggatggggatggaggatatccctgtccatggcagcactccctgctgcgttcctaaccatcggtgtgatcttccttcctgagacaccaagctttataatccaacgcgatggtgacaccaacaaggcaaggatcctgctccagaagctgcgtggaacaacctcagtccaaaaagagcttgatgacttggtttctgctagtaacctctcaaggacaacacagtatccattcagaaacatattcaagagaaagtacaggccgcagcttgtagtagcactgctgatcccattcttcaatcaggttactgggatcaatgtgatgaacttctatgcaccagtcatgttcaggacaatcggtctcaaggagagggcgtccctcttctcctcagtggtgacacgcctatgcgcaacatttgccaacatcatagcaatgatggtggttgacaggtttgggcgcaggaagctcttccttataggcggtgtgcagatgatcctctcgcagttcactgttggtgcaatattggctgcaaagttcaaggactctgaggacatggacaatgagtatgcatacctagtgttgatcacaatgtgtgtgttcgttgcaggctttgcgtggtcatggggccctcttacattcttggtccctgctgaggtttgcccactggagatcaggtccgcagggcagagcattgttgttgctgtggttttcttgatggcattcgtgatcggccagacttttcttgaggttctttgtggtatcaagtcagggacgttctttgtatttggtgggtggatctgcttgatgacactttttgtttatctgttcttgccggaaacaaagaagctgcccatggagcagatggagcaggtctggtcgaggcactggttctggaagaagattgtaggggagaaggtggagaagaaacaagcaaaatcaggggaaacagctttgccgagcttgtagttcttttctgaattgcgggtgcatttaatcaaatctgcaaagaaaatatagtatgggattaccattagcagatgtaaatgtatgattgtatgtaactagtgtttgctactagtttgttgcccttgtc

SEQ ID NO: 17616 - protein, 520 aa, Panicum virgatum
  misc_feature: Ceres CLONE 1792860
  misc_feature (29)..(491): Pfam Name: Sugar_tr Pfam Description: Sugar (and other) transporter
  misc_feature (24)..(443): Pfam Name: MFS_1 Pfam Description: Major Facilitator Superfamily
MAIGAFAEAAPADGGEGYSGRVTPFVLLSCVVAGSGGILFGYDLGISGGVTSMDSFLKRFFPEVYRQSQAQDTRVSHYCEFNSELLTLFTSSLYVAGLVATLVAASITRRYGRRVSMLIGGTVFVAGSVFGGAAVNVPMLILNRILLGIGLGFTNQSIPLYLSEMAPPRYRGAINNGFELCISLGILFANILNYFVIKITAGWGWRISLSMAALPAAFLTIGVIFLPETPSFIIQRDGDTNKARILLQKLRGTTSVQKELDDLVSASNLSRTTQYPFRNIFKRKYRPQLVVALLIPFFNQVTGINVMNFYAPVMFRTIGLKERASLFSSVVTRLCATFANIIAMMVVDRFGRRKLFLIGGVQMILSQFTVGAILAAKFKDSEDMDNEYAYLVLITMCVFVAGFAWSWGPLTFLVPAEVCPLEIRSAGQSIVVAVVFLMAFVIGQTFLEVLCGIKSGTFFVFGGWICLMTLFVYLFLPETKKLPMEQMEQVWSRHWFWKKIVGEKVEKKQAKSGETALPSL

SEQ ID NO: 17617 - DNA, 710 bp, Panicum virgatum
  misc_feature: Ceres CLONE 1792862
  misc_feature: Encodes the peptide sequence at SEQ ID NO. 17618
gcatcatcacagaggaagagcgagcggcaatcgaaacagcagcaatggcggcctccatgatctcgtcgtcagctctggtggcgccggccagggcccagggcctgccgtccctcggccgccgcgcctcctccttcgccgtcgtccgcggcaccggcaagaagatcaagaccgacaagcccttcgggattggcggtggcctcaccgtcgacgtcgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccactggacttctgatctgggccgtcaccctcgccgggctccttggaggcggtgccctccttgtttacaacaccagcgctctcgccagctaagaacactattcatgcacagtccatgcaagcacttgcggttcatgtaagatcagcttgggggtgtctgtctgtaatctagcctgcagctttgatgtccaatataatgcttggttcatgtaacaatgctactacggctctccatacttttgagagagagagagtgagttgagctgcgtgcctcgccgggactcttcgcgttgcctctttggagagagaagagagagcggggaagtcgggcggagatgtccaagatggcggargagaagggcg

SEQ ID NO: 17618 - protein, 131 aa, Panicum virgatum
  misc_feature: Ceres CLONE 1792862
  misc_feature (35)..(131): Pfam Name: PsbR Pfam Description: Photosystem II 10 kDa polypeptide PsbR
MAASMISSSALVAPARAQGLPSLGRRASSFAVVRGTGKKIKTDKPFGIGGGLTVDVDASGRKVKGKGVYQFVDKYGANVDGYSPIYKEEDWSPTGDVYVGGTTGLLIWAVTLAGLLGGGALLVYNTSALAS

SEQ ID NO: 17619 - DNA, 674 bp, Panicum virgatum
  misc_feature: Ceres CLONE 1792862-R
tggggctgtgcgtcgccgccatggccgtcatgctcaaggaccagcagaccaacgagtacggtaccgtcgcctactccgacctcggcggcttcaagtacctcgtctacgccaacggcctctgcgccgcctactcgcttgtcacggccttctacaccgccgtgccaaggcccgccaccgtgtcgcgctcatgggtcgtcttcctcctcgaccaggtgttcacgtacctgatcctagcggcgggcgcggcggcggcggagctactgtacctagcctacaacggcgacaaggaggtgacatggagtgaggcgtgcggcgtgttcggcagcttctgccgccaggcccggacctcggtgggcatcacctttggctccgtggtctgtttcatcctcctctcagtcatctcctcctaccgcctcttcagcacctacgaggcgcccccgtcatcggcgctcggcaacaagggtgtcgagatcgccgcctacccgcgctgaagccgctgcgggcgtacaagaggctgccgtccatggtccatccactggaggctccaaagggaggcggggttgcatcatctctctgtaatgtgtaggcgatcaagtaataagcaaggacttattatatgtgtgaatcatactagtttgctgttacaaatgattagcaccgtgctgatgctgctc

SEQ ID NO: 17620 - DNA, 1716 bp, Panicum virgatum
  misc_feature: Ceres CLONE 1792870
  misc_feature: Encodes the peptide sequence at SEQ ID NO. 17621
acgcccctgtctctctcagatctctctcctcttcttctcccttccgtcgcctcgtcttgccccccaaatcgtcgcggggagcctcccaatccctcgcccgcctcccgtcgcgcgcgccaggtggtccccggggccggtgcttggcctgccgccgcgatggatcgcgccgagctcaccaccgagcaggttctgaagcgggacattccatgggaacattacatgtcaactaagcttatttctgggacatgccttcagcttttacggcgctatgaccacaaaccagagagccagcgtgctcctttgcttgaggaggatgggccagcatatgttcgagttttcctgaatatactacggagtatctctaaggaagagactgtggaatatgtgcttgccctcattgatgagatgcttgcaacaaatcctaaatgcgcagcactgttctatgaccaatctctgtctggtgaagatatttatgagcctttcttaagattgctctggaaaggcaactggtttgtgcaagaaaaaagttgtaagatattgactgatataataagtgcacggcctaagcttcagaatggcatgcttccaaatggagactcttcgaattcgaagagcaagcttacttcaacacatgatgtgttgagaggtttggttgattggatctgttctcagctaaggaatcctacccacccgagctgttctgttcctactgctatccactgcctctccactctgctaagagaaccatatgttaggacattatttgttcaagctgatggtatcaagctgctcattcctttaatatccccagcttcaacacaacagtcaattcagctcctttatgaaacttgcctctgcatctggcttttatccttttatgatgcagcagttgattatttgtccactacaagggtcatgccaagacttgtagaggttgtcaaaggctctactaaagagaaggtggtcagagttgttgtcatgtccttccgtaatttgctggccaagggtgcatttgctgcccagatgatcgatcttggattgccacagatagtacaaaacttgaaagctcaagcatggactgatgaggatctactagatggtttgaatcaactggaggtgggactcaaagacaacctcaagaagttgagctcatttgataagtacaaacagcaagttcttctcggtcaccttgactggtctccaatgcacaaagatccaagtttctggcgtgagaacattaacaatttcgaagaaaatgatttccagattctacgtgtcctgatgacaattatcgacacatcaagtgacaccactgctcttgccgtggcctgctacgacctctcacagttcctccagtaccacccatctggccgaattgtggtggcagacctcaaggccaaggaccgagtcatgaagctcatgaaccacgagaatgctgaagtgaggaaaaacgcactgctgtgtgtgcagaggctattccttggtgcaaagtatgccagcttcctgcaggcttgaggtagaccgcaccgagtttttgtatttagatccagagaacccccactggccatttttcagaatggccgaaccatgattgagaaagaccttgaaaattcttgtccagtatatcctattgttattcgatttccagaaccgatgtataataaataatcagagccacaccctgttcgatgtaataaagtgtccatgggcttgtcg

SEQ ID NO: 17621 - protein, 452 aa, Panicum virgatum
  misc_feature: Ceres CLONE 1792870
  misc_feature (1)..(407): Pfam Name: V-ATPase_H Pfam Description: V-ATPase subunit H
  misc_feature: SWISSPROT Homolog: EC 3.6.3.14 H(+)-transporting two-sector ATPase
MDRAELTTEQVLKRDIPWEHYMSTKLISGTCLQLLRRYDHKPESQRAPLLEEDGPAYVRVFLNILRSISKEETVEYVLALIDEMLATNPKCAALFYDQSLSGEDIYEPFLRLLWKGNWFVQEKSCKILTDIISARPKLQNGMLPNGDSSNSKSKLTSTHDVLRGLVDWICSQLRNPTHPSCSVPTAIHCLSTLLREPYVRTLFVQADGIKLLIPLISPASTQQSIQLLYETCLCIWLLSFYDAAVDYLSTTRVMPRLVEVVKGSTKEKVVRVVVMSFRNLLAKGAFAAQMIDLGLPQIVQNLKAQAWTDEDLLDGLNQLEVGLKDNLKKLSSFDKYKQQVLLGHLDWSPMHKDPSFWRENINNFEENDFQILRVLMTIIDTSSDTTALAVACYDLSQFLQYHPSGRIVVADLKAKDRVMKLMNHENAEVRKNALLCVQRLFLGAKYASFLQA

SEQ ID NO: 17622 - DNA, 2190 bp, Panicum virgatum
  misc_feature: Ceres CLONE 1792882
  misc_feature: Encodes the peptide sequence at SEQ ID NO. 17623
atgccggctcccacctcagctacccctcccgggcaaactaaccagcagagcgagagcatcgtcccttgttgcccttgctatagtatagatagatgcctcctgctctctccgcatccattcttagatcccggctccctcctaataatagtaagtagtagtcttctcctggtgtgtttattggattccttttagctagcgtgttccagagaccaccaccaaagcagctagccaacatggagaacggcaataagatcactagtggtagcagcaggggaggagaagaggaggaggaggccaaggtgcccctgctcgagcccagagcggcagacgaccaccatggaggtggcagcagaagcttgagcaaggtggagcaggaggaggaagagcagcaagatgatgagtggtcgtcgctggggcggcgggcgtgggaggagaacaagaagctgtgggtggtggcggggccctccatcttcacccgcttctcctccttcggcctcaccgtcatcagccaggccttcgtcggccacatcggcgccaccgagctcgccgcatacgccctcgtctcgacagtgctcatgcgattcagcaacggcatcctgctgggcatggcgagcgccctggagacgctgtgcggccagtcctacggcgccaagcagtaccacatgctcggcatctacctccagcgctcctggatcatcctcttcgtctgctccgtcgtcctgctccccgtctacctcttcaccgagcccatgctcgtcgccctgggccaggaccccaagatctccgccgtcgccggcaccatctccctctggtacatccccatcatgttctcctacgtctggtccttcacgctccagatgtacctccaggcgcagagcaagaacatgatcatcacctatctcgccatgctcaacctcgccctccacctcgccctctcctggctcatgaccgtcaagttccagctcggcctggcaggggtcatgggctccatgatcatcgccatgtggatccccgtgtttggccagcttgcctttgtcttcttcgggggttgccctctcacatggaccgggttctcgtctgctgcgttcactgacctcggtgccatcatcaagctctcgctgtcttctggtgtcatgctctgtttggaattgtggtacaacaccatattggtgctcctcacagggtatatgaagaatgcagaggttgcacttgacgccctttcaatatgccttaatatcaacggttgggagatgatgatttctatcggctttttggctgcaacaggagtgcgagtggcaaatgagcttggagctggaagtgcaagaagggccaagtttgcgatatacaatgtcgtcatcacgtctttcttgatcggatttgtgttatttgtgctcttccttttcttccgtggaaaccttgcttacatatttactgagagtcgagcagtggccgatgctgttgctgacctctcacctctgctagccttctccatattgttaaacagtgttcaaccagtgctatcaggtgtcgctgttggtgctggctggcaaagtgtagttgcctacgttaacattacatcatactacttgattggtgtcccccttggaggagtcctaggctatgtagtgggacttcatgtaaagggcatttggattggcatgctgctcggaacactggtccaaactattgtgcttctgttcataacattaaggaccaactaggaaaaacaggtggtgactgctcaagagagattgaagagatggtacatggaagagaacagaagactgcagggctctaggagcaatccttgaaccggccctccaaagtggacctttgtgagttcacaaaaaaaaatatttgatcggcattggaaatcccttggcagacacatatcttctcagttctcaccatctcaggaacgaaatgaggggactttagcctatccagaaaatgtgctcacttcctcaagccaagcaatgaaatccattgtcagcagtagccaacgtccagtagaaaagcactgtatcaattgccaacaggattggcatatatgcgtgagcctgtgttggctagccgtgatggcaagacagactgttgctctgcatcagttttggggtatgctaatgtcccatcagagccgtggttgtggtttgggggcatctgtgctgattttgtgtgtacattttgcgc

SEQ ID NO: 17623 - protein, 495 aa, Panicum virgatum
  misc_feature: Ceres CLONE 1792882
  misc_feature (297)..(460): Pfam Name: MatE Pfam Description: MatE
  misc_feature (77)..(237): Pfam Name: MatE Pfam Description: MatE
MENGNKITSGSSRGGEEEEEAKVPLLEPRAADDHHGGGSRSLSKVEQEEEEQQDDEWSSLGRRAWEENKKLWVVAGPSIFTRFSSFGLTVISQAFVGHIGATELAAYALVSTVLMRFSNGILLGMASALETLCGQSYGAKQYHMLGIYLQRSWIILFVCSVVLLPVYLFTEPMLVALGQDPKISAVAGTISLWYIPIMFSYVWSFTLQMYLQAQSKNMIITYLAMLNLALHLALSWLMTVKFQLGLAGVMGSMIIAMWIPVFGQLAFVFFGGCPLTWTGFSSAAFTDLGAIIKLSLSSGVMLCLELWYNTILVLLTGYMKNAEVALDALSICLNINGWEMMISIGFLAATGVRVANELGAGSARRAKFAIYNVVITSFLIGFVLFVLFLFFRGNLAYIFTESRAVADAVADLSPLLAFSILLNSVQPVLSGVAVGAGWQSVVAYVNITSYYLIGVPLGGVLGYVVGLHVKGIWIGMLLGTLVQTIVLLFITLRTN

SEQ ID NO: 17624 - DNA, 722 bp, Panicum virgatum
  misc_feature: Ceres CLONE 1792886
  misc_feature: Encodes the peptide sequence at SEQ ID NO. 17625
attcgccgtccgcttgctgcctcctcccgctgccccgctagcgctcccccgcggcacctctccgccacgaggcccacgcgcgcgatggcgaccctcaccacgcacctccgctccgcgctcctcgccccgggcggcgggcgccgcggccgccgccgcgcgccctcctccgtgcgctgcgacgcctccccgccgtcctcctccgcggccgcggccgcgtcgctcgacccggacttagacaagaaggccttccgccacaacctcacccgcagcgacaactacaaccgcaagggcttcggccacaagaaggagacgctcgagctcatgagccaggagtacaccagtgatgtgatcaagacgctcaaggagaacgggaaccagcacacctggggccccgtcaccgtgaagctggcggaggcctacggattctgctggggcgtcgagcgcgccgtgcagatcgcctacgaggcgcgcaagcagttccccgaggagcgcatctggctcaccaacgaaatcatccacaaccccaccgtcaacaagaggttggatgagatgggtgtagaaatcattcctgttgatgcaggcatcaaggatttcaatgttgttgaaaaaggcgatgttgttgtgctacctgcatttggagctgctgtggaggagatgtacacactgaatgataagaaagtgcagatagttgatacaacctgcccttgggtttcaaaggtctg

SEQ ID NO: 17625 - protein, 212 aa, Panicum virgatum
  misc_feature: Ceres CLONE 1792886
  misc_feature (106)..(212): Pfam Name: LYTB Pfam Description: LytB protein
  misc_feature: SWISSPROT Homolog: EC 1.17.1.2 4-hydroxy-3-methylbut-2-enyl diphosphate reductase
  misc_feature: Functional homolog of the protein sequence given in SEQ ID NO 50777
  misc_feature: Useful for making plants with modulated nitrogen use efficiency
MATLTTHLRSALLAPGGGRRGRRRAPSSVRCDASPPSSSAAAAASLDPDLDKKAFRHNLTRSDNYNRKGFGHKKETLELMSQEYTSDVIKTLKENGNQHTWGPVTVKLAEAYGFCWGVERAVQIAYEARKQFPEERIWLTNEIIHNPTVNKRLDEMGVEIIPVDAGIKDFNVVEKGDVVVLPAFGAAVEEMYTLNDKKVQIVDTTCPWVSKV

SEQ ID NO: 17626 - DNA, 1712 bp, Panicum virgatum
  misc_feature: Ceres CLONE 1792887
  misc_feature: Encodes the peptide sequence at SEQ ID NO. 17627
gcggtggcgtccgtaggcgctacgaaagctttggatgagttgcgctatataaacagagcccctccctcccacctcgatggctcgatgcaaccaccgccctgccctcacctgttgacttgctccaattggccttgctcgtcgtcatctccacccaccttgagctcgagaggcctttctagccatgggtaaggagaaggttcacatcaacattgtggtcatcggccatgtcgactctggcaagtccacgaccaccggccacctcatctacaagctgggaggcatcgacaagcgcgtcatcgagaggttcgagaaggaggccgccgagatgaacaagaggtccttcaagtacgcctgggtcctcgacaagctcaaggccgagcgcgagaggggcatcaccatcgacattgccctgtggaagttcgagaccaccaagtactactgcacagtgatcgacgctcccggacaccgtgacttcatcaagaacatgatcaccgggacctcccaggccgattgcgccgtgctcatcatcgactccaccactggtggctttgaggcaggcatctccaaggacggccagacccgtgagcacgccctccttgccttcacgcttggtgtcaggcagatgatctgctgttgcaacaagatggacgccaccactcccaagtactccaaggctcggtacgacgagatcgtcaaggaagtggcgtcgtacctgaagaaggtggggtacaatccggacaagatccccttcgtgcccatttccgggttcgaaggtgacaacatgatcgagaggtcgacgaacctggactggtacaagggcccgaccctcctggaggcgctggaccagatcaacgagccgaagcggccgtcggacaagcccctccgccttcccctgcaggacgtgtacaagatcggcggcatcggcaccgtcccggtgggccgcgtggagacgggcgtcctgaagcccggcatggtggtcaccttcgcgcccaccggcctgacgacggaggtgaagtcggtggagatgcaccacgagtcgatgcaggaggcgctgccgggcgacaacgtcgggttcaacgtgaagaacgtggcggtcaagtacctgaagcgcggctacgtggcgtccaactccaaggacgaccccgccaaggaggccgccagcttcacggcgcaggtgatcatcatgaaccacccggggcagatcggcaatggctacgccccggtgctggactgccacacgtcccacatcgccgtcaagttctcggagctgctgaccaagatcgacaggcgctccggcaaggagctcgagagcgcccccaagttcctcaagaacggcgacgctgggttcgtcaagatgatccccaccaagcccatggtggtggagacgttctcagagtacccgccgctggggcggttcgctgtgcgggacatgaggcagacggtggctgtcggcgtgatcaagagcgtgaagaagaaggacccaacgggagcaaaggtcaccaaggctgcggctaagaagaaataaaaatatataggtcgatccgtgccgtggatgttattataacatcccataagctagctagtggagtattttggctagaaagtttgcattactgttattatatcgtcggggctgtttatttgggtctcgcagtgcttagtatgtgtcggtgtcagtttccagaatcaatatatatgctatgtttttcgcc

SEQ ID NO: 17627 - protein, 447 aa, Panicum virgatum
  misc_feature: Ceres CLONE 1792887
  misc_feature (5)..(225): Pfam Name: GTP_EFTU Pfam Description: Elongation factor Tu GTP binding domain
  misc_feature (322)..(430): Pfam Name: GTP_EFTU_D3 Pfam Description: Elongation factor Tu C-terminal domain
  misc_feature (248)..(315): Pfam Name: GTP_EFTU_D2 Pfam Description: Elongation factor Tu domain 2
  misc_feature: SWISSPROT Homolog: EC 2.7.7.4 Sulfate adenylyltransferase
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVASYLKKVGYNPDKIPFVPISGFEGDNMIERSTNLDWYKGPTLLEALDQINEPKRPSDKPLRLPLQDVYKIGGIGTVPVGRVETGVLKPGMVVTFAPTGLTTEVKSVEMHHESMQEALPGDNVGFNVKNVAVKYLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVKKKDPTGAKVTKAAAKKK

SEQ ID NO: 17628 - DNA, 752 bp, Panicum virgatum
  misc_feature: Ceres CLONE 1792891
  misc_feature: Encodes the peptide sequence at SEQ ID NO. 17629
accgcatcgaccgggacggtctctccaaacgctggctactagcctcctctcatcctgatctcccagccctccctccctccaagcagtctctccgatccttgcgcccgcagccagccatgaggccgggcggcggcggaggagacccgcagggcggcgacggggcgacgcagcggaccgcggcggccgggcaggccatggtggagctgcaggccaacgcgtcggcggcggcgggcggcgccgccatggtggtggggctcagcccgctcagcgagacgctgtggcgggacagcaaggcgctcccgccgggcgccggccccgccgcgctcatcgcggacgtgtcggccaggctcacgtggaaggacctctgcgtcaccgtggcgctgggccccggcaagacgcagacggtgctggacgagctcaccggctacgccgagcccggctcgctcaccgctctcatggggccctcggggtccggcaagtccacgctcctcgacgccctcgcgggccgcctcgccaccaacgccttcctctccggcaacgtgctcctcaacggccgcaaggccaagctctccttcggcgccgcggcgtacgtgacgcaggacgacaacctgatcgggacgctgacggtgcgggagacgatcggctactcggcgctgctgcggctgccggacaagatgccgcgggaggacaagcgcgcgctggtggagggcaccatcatcgagatggggctccaggactgcgccgacaccgtc

SEQ ID NO: 17629 - protein, 211 aa, Panicum virgatum
  misc_feature: Ceres CLONE 1792891
  misc_feature: SWISSPROT Homolog: EC 3.6.3.25 Sulfate-transporting ATPase
MRPGGGGGDPQGGDGATQRTAAAGQAMVELQANASAAAGGAAMVVGLSPLSETLWRDSKALPPGAGPAALIADVSARLTWKDLCVTVALGPGKTQTVLDELTGYAEPGSLTALMGPSGSGKSTLLDALAGRLATNAFLSGNVLLNGRKAKLSFGAAAYVTQDDNLIGTLTVRETIGYSALLRLPDKMPREDKRALVEGTIIEMGLQDCADT

SEQ ID NO: 17630 - DNA, 2721 bp, Panicum virgatum
  misc_feature: Ceres CLONE 1792897
  misc_feature: Encodes the peptide sequence at SEQ ID NO. 17631
aaaagcagagcggccagccactcgctttcttcgcaaccacgtctcctccctcccccgccgcccatcccctcctcccctaaaatccccacgccaaatccacccggtccaaaccctagcccaaccccgctccccctccctcccttcccatcctcctcctccccccacgcttccttcgccgctaagcatatccctccccccgcctggatctcgacgaggatgacggtgatggagctcaaggcgctgccgctgggcttccgcttccaccccaccgacgaggagctcgtccgccactacctcaagggcaagatcaccggccagatcaattccgaggtcgaggtcatccccgagatcgacgtctgcaagtgcgagccgtgggacctcccagataaatcgctgatccggtcggatgatcccgagtggttcttcttcgcgcccaaggaccgcaagtaccccaacgggagcaggtcgaatagggccaccgaagctggatactggaaggccacaggcaaggacaggatcatcaagtccaagggtgacaagcgcaagcagcacatcattggcatgaagaagacccttgtgttccaccgcggacgcgcacccaagggtgagcggacagggtggatcatgcacgagtaccgcaccaccgagccggggttcgagtctggcgagcagggtggttacgttctttatcgcctcttccggaagcaagaggagaaacctgagcgccctagcccagatgaagtggataggagtggctactcgcctactccttctcgctcgtcacctcacaacatagaggtgaatgaggaagcaaacacaccattaaacagggaatctccagagtctggtctgcatgaaagtccgatcgagctgccaaaatctgtggaaacccatgccatgccgatgacgaggtggctggcggacagaaatgattacttggtggctactacagcggatgtttcccgtatacctattattggacatgctaatgtacctgaggttgatccttctgctggtgcttcagctcagttcgttcatccacagaatgggaatggtggttttaacaattttgtgcctgatattgcccccaatctaccgcatggaaatgcattcttctctgatttccagcaaggagcttttgattttgatggcaacatgaatcctcccgatgccctcgatgctttcttgaaccaagcacttgttgatcctgatgaacattcatcaacaacatcaaaagttcagtatgactcggacattcctatggaatttgataaccacggggttgcacagggtgaagaatgctggtgggcaaatctagatttcttgctagatgagccaaaccctctgaattctcaatatgagaatacaccattgcttcattatgacataaatgaccaggatgtactttcggtggactctgctgctgattccttgcatgaactgttcaataacatggaggattcaagtgcaaggagggctggaactgggatttctcttatgccccggcagtcacagccctctgtgcagccaaactccgtgttcactaatcagggcactgcactaagaaggctccggctactgttgcctactgatttggagagtggggagagcataactagagatgagagtgaagatgaagtatcgtgcattgtagatgaagtatcgtgcattgtgactccgaactatgtgaatgaagctgcagataaggatgtggtttctgatagagatgaagctgagtcaacagggattgttattagaagccggcctgctccaagttcaagttcagagagttcattgacccaacaagggactgcagtgcgaaggctgcggctgcagtcacacctcaagacaggaccatgtccgagtactgatgatacttcaagttgcatcatcaatgaaacagaaagtcaccacaaagcagagaaatctgagattgtagaggatgcaagtacaaactttgctgaaactgttgatggtatattggacaattgcggtgatagtgaacaaaagaacatgcctgaaattgttgctgaaacagctgtttcagaagccaaatcggttccaaggctgcggaaagcttctgagaagagcgggaaggttgctatcaagcaggaggatggtcttgagccccacgtgagagcaccagctcagaaggggggcttccaaccttacatggtcgggctggttctttcggtgcccctgctgttgcttctctgtgtccgggtgtatggatggatatgaaagataatcccggtgcagtgtagggtagtcatgttctgcgcactcaggttcccagtattgacctggtggtgtgttgtcatgtgtacataactttgtcctacggcatgggtttatagggccgtaggacatcctgtgtctgttctcctggcaagcagagtaagctgaaaatccaaaaaaagaggtagcacgttaggaggaagaaaaagaaaaaaaaagaaccattattagaggcatagtactatagtagtagtacgtccttgtttgttttttttccagctgttgccgcagattctggtgactttgtggtagctgttgtgtagttgcaagccatgccctcggctgctggctttatttcctgatgtaatgtagcaagtccctgttagatagggcgctgaatgtctgatgaaccttggtaatgtcttgttaatgtagatagtccgtgcaaaagtttcagttcctgatgatggtgtcttgctggtc

SEQ ID NO: 17631 - protein, 674 aa, Panicum virgatum
  misc_feature: Ceres CLONE 1792897
  misc_feature (9)..(143): Pfam Name: NAM Pfam Description: No apical meristem (NAM) protein
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Functional homolog of the protein sequence given in SEQ ID NO 50322
  misc_feature: Useful for making plants with modulated oxidative stress sensitivity
MTVMELKALPLGFRFHPTDEELVRHYLKGKITGQINSEVEVIPEIDVCKCEPWDLPDKSLIRSDDPEWFFFAPKDRKYPNGSRSNRATEAGYWKATGKDRIIKSKGDKRKQHIIGMKKTLVFHRGRAPKGERTGWIMHEYRTTEPGFESGEQGGYVLYRLFRKQEEKPERPSPDEVDRSGYSPTPSRSSPHNIEVNEEANTPLNRESPESGLHESPIELPKSVETHAMPMTRWLADRNDYLVATTADVSRIPIIGHANVPEVDPSAGASAQFVHPQNGNGGFNNFVPDIAPNLPHGNAFFSDFQQGAFDFDGNMNPPDALDAFLNQALVDPDEHSSTTSKVQYDSDIPMEFDNHGVAQGEECWWANLDFLLDEPNPLNSQYENTPLLHYDINDQDVLSVDSAADSLHELFNNMEDSSARRAGTGISLMPRQSQPSVQPNSVFTNQGTALRRLRLLLPTDLESGESITRDESEDEVSCIVDEVSCIVTPNYVNEAADKDVVSDRDEAESTGIVIRSRPAPSSSSESSLTQQGTAVRRLRLQSHLKTGPCPSTDDTSSCIINETESHHKAEKSEIVEDASTNFAETVDGILDNCGDSEQKNMPEIVAETAVSEAKSVPRLRKASEKSGKVAIKQEDGLEPHVRAPAQKGGFQPYMVGLVLSVPLLLLLCVRVYGWI

SEQ ID NO: 17632 - DNA, 1471 bp, Panicum virgatum
  misc_feature: Ceres CLONE 1792909
  misc_feature: Encodes the peptide sequence at SEQ ID NO. 17633
aatcctgcagttcgcaacctttaaaaaaaaaatatcctgcagttcttccccgtcccccgcccgcagccaccgcaacgcgcctccctccggcgtgccgaagccggagagctcggcagccgcctgccgcccagccagcaaacagccggttccgccgtgcgcgtcgcgacaaagcacgggaaacagcggccggcaccgcgaatatacccagcccgcggccactccccggctccctccctccctcccctttccgctttgttcacttccgcgccgctcgctgccgtgccgtgccgtcccgccctcccgcgccgcacggctcacatcccatttccactcacccgacctcccaaaacccacacggactcgcgggcgccagcatggcggtggcctccgcctcgcccctcccggcggcgttgtccgccaagcccggccccgcccgctcgccgccgcggcccgctcccggcttcctcccgctccgcgccggcggagccccgcacctcggccccgtcgccgcgtggagggggaggaggtggttccgcgcggaggcgataaagacgcagcaggagaagcagcagacggaggcgcccgtcgaggagtccttccccgtgagggaggcggcgccgcgggacggagcggacgacccgatggttccctcggacgagagctgggtggtcaagctcgagcagtcggtcaacattttcctcacggagtcggtgatcatggtactggatggtgtttaccgtgatcggaactacgccagattttttgtgcttgagacgattgctagggtgccgtattttgcatttatatcggtgcttcacatgtatgaaacctttggctggtggaggagagctgattatataaaggttcactttgccgaaagctggaatgagttccatcacctcctaatcatggaagaattgggtggcaacgctttatggattgatcgtttccttgctcggttcatggcattcttttactacttcatgactgttgggatgtacatgctgagcccaagaatggcatatcatttttctgaatgtgtggagaggcatgcgtattcaacttatgacaagtttctcaagctccatgaagaggagttgaaaagactaccagctccagaggcagctctaaactattacctgaatgaggacctttatttatttgatgagtttcagacagcaagagttccatgttctagaaggcctaaaatagataacttgtatgatgtatttgtcaatatacgagacgatgaggcagagcactgcaagacaatgaaggcctgccaaacgcatggaaatcttcgctctcctcactcagcacacaactgctcggaagcagatatggaatgtgtaatacccgaaaatgattgtgaaggtatcgtggatcgtgtgaaaaagtcacttacaaagtaaagtccgagacatctatcttttgtgttttcagtcattatagtatacaaaattttgatgat

SEQ ID NO: 17633 - protein, 345 aa, Panicum virgatum
  misc_feature: Ceres CLONE 1792909
  misc_feature (39)..(326): Pfam Name: AOX Pfam Description: Alternative oxidase
MAVASASPLPAALSAKPGPARSPPRPAPGFLPLRAGGAPHLGPVAAWRGRRWFRAEAIKTQQEKQQTEAPVEESFPVREAAPRDGADDPMVPSDESWVVKLEQSVNIFLTESVIMVLDGVYRDRNYARFFVLETIARVPYFAFISVLHMYETFGWWRRADYIKVHFAESWNEFHHLLIMEELGGNALWIDRFLARFMAFFYYFMTVGMYMLSPRMAYHFSECVERHAYSTYDKFLKLHEEELKRLPAPEAALNYYLNEDLYLFDEFQTARVPCSRRPKIDNLYDVFVNIRDDEAEHCKTMKACQTHGNLRSPHSAHNCSEADMECVIPENDCEGIVDRVKKSLTK

SEQ ID NO: 17634 - DNA, 1928 bp, Panicum virgatum
  misc_feature: Ceres CLONE 1792920
  misc_feature: Encodes the peptide sequence at SEQ ID NO. 17635
actgccattgctcacttgctcggctcggcaggagcactgtacacacacccacactgacagctggttcgtctctggctgctacggtggtagcagagaccgagaagcaagaggtggccgtcgtcggagctagaggagacgagcgagcttgagacgtaggatcgatggacgtgaacgacgtgctgctggtggtgctggcggcggcgctggcggccatgtggtggcggcggtgctccaagaccggcggcgcggacggcctcccgccggggccgccggggtggccggtggtgggcaacctcttccaggtgatcctgcagcggcggcccttcatgtacgtggtgcgcgacctccgcgagcgctacgggcccatcttcaccatgcgcatggggcagcgcaccctcatcgtcgtcacctccgccgacctcatccacgaggcactcgtcaagcagggccccatgttcgccagccgccccgaggacagccccacccgcctcctcttcagcgtcggcaagtgcaccgtcaactcggcgccctacggcccgctctggcgcgcgctccgccgcaacttcgtcgccgagatcgtgtcgccgcaccgggtcagggccttctcctggatccgggagtgggccgtcgacgcccacctgcgccgcctccgcgccgagttcgccgccgccggcgccgtgcgcgtcatggccagctgccgcctctccatctgcagcatcctcatctgcatctgcttcggcgccaagatccccgacgacctcatccgagagatcgaggaggtgctcaaggatgtcatgatgatgaccatgcccaagctcccggacttcctgccgctcctcacgccgctcttcaggaagcagctcgccgaggcccgccgcctgcgccgccgccagctcgactgccttgtgcctctcgtgcgcgcgcgcagggagttcctccgcgacggcgccgggaaagcggcggcggcggccgccggcgtcgagatgatgagcgggccgggggaggcgtacgtcgactcgctcttcgacctcgagccgcccggccgcgggaagcgcctcggggaggaggagctcgtcacgctctgctccgaggtcatgagcgccggcaccgacaccagcgccaccgcgctggagtgggccatgatgcacctcgtcctcgaccccgccgcccaggagcgcctctacgacgaggtcgtcggcaaggtcggcaagacggcccggatcaccgaggccgacgtcgaggccatgccctacctgcaggcggtggtgaaggagacgttccggcggcacccgccgagccacttcgtgctgtcccacgcggcgacgcgggacacggagctgggcggctaccgcgtgccggcggacgccagcgtggagttctatacggcgtgggtgacggagaacccggcgacgtggccggacccggcggcgtggcgccccgagcggttcctcgacggcggcgagggcttcgacaccgacatcaccggcacccgcgcgctccgcatgatgcccttcggctccggccgccgcatctgccccgccgccacgctcggcgtgctccacatccagctcatgctcgccaacatggtgcgcgagttccggtgggtgccccccgccggcgaaggcccgccggaccccaccgagaccttcgccttcaccgtcgtcatgaagaactcgctccgcgccgccatcgtcgagcgggccgcggcggcgtcggcgtaacgccggccggcgctcttgaatttgccgcggtgcgttggtgctgtacgggtcggtaattacggcgggggttaaatttggtgcggccgcggtataaatactccacggtggtcggcgggtcgatcctagctgttggttggttgacggacggacggacggacggatggatgtgcaagcacgatgttatcataaattctttttttttcttct

SEQ ID NO: 17635 - protein, 519 aa, Panicum virgatum
  misc_feature: Ceres CLONE 1792920
  misc_feature (33)..(512): Pfam Name: p450 Pfam Description: Cytochrome P450
  misc_feature: SWISSPROT Homolog: EC 1.14.13.68 4-hydroxyphenylacetaldehyde oxime monooxygenase
MDVNDVLLVVLAAALAAMWWRRCSKTGGADGLPPGPPGWPVVGNLFQVILQRRPFMYVVRDLRERYGPIFTMRMGQRTLIVVTSADLIHEALVKQGPMFASRPEDSPTRLLFSVGKCTVNSAPYGPLWRALRRNFVAEIVSPHRVRAFSWIREWAVDAHLRRLRAEFAAAGAVRVMASCRLSICSILICICFGAKIPDDLIREIEEVLKDVMMMTMPKLPDFLPLLTPLFRKQLAEARRLRRRQLDCLVPLVRARREFLRDGAGKAAAAAAGVEMMSGPGEAYVDSLFDLEPPGRGKRLGEEELVTLCSEVMSAGTDTSATALEWAMMHLVLDPAAQERLYDEVVGKVGKTARITEADVEAMPYLQAVVKETFRRHPPSHFVLSHAATRDTELGGYRVPADASVEFYTAWVTENPATWPDPAAWRPERFLDGGEGFDTDITGTRALRMMPFGSGRRICPAATLGVLHIQLMLANMVREFRWVPPAGEGPPDPTETFAFTVVMKNSLRAAIVERAAAASA

SEQ ID NO: 17636 - DNA, 1512 bp, Panicum virgatum
  misc_feature: Ceres CLONE 1792935
  misc_feature: Encodes the peptide sequence at SEQ ID NO. 17637
ctctagacttcttctctctcttccctgcggtgcggcgaccatgtccgcgcgcccgcacctggcgctgccgccgcgctccgcggcggagtcgctcttcacgggcgccggcgacgccagccccggcccgctcacgctcgcctccgcgctcttcccctccgacgccgacgcgggcggcggcgcctcgtccggggcgtccggagccgggagcttcacgcagctgctcaccggctccctcgggcagccgccgcctccgcaacagcagcggcagcggcagcggcagcatgaggccgcggagagggggcgaggcggcggggtcgccagggccgggccggcgctggcggtggcgacgccggtgtcggcggcctcgggcgcctccgtcttcacggtgccccccggcctcagcccctccggcctgctcgactcccccggcctgctcttctcgccggccatgggggggtttggaatgtcgcaccagcaggctcttgctcaagttacagctcaagcaagccattcttcactcagaatgtttgaccacattgagcaaccatctttttcagcagctgcagcatcgtctggagctctacaacatatgaactctagtgccaatatgactggaatgccagatatggcaattacaacagcaaacaatgacaatgcatctttgcaatctgctgagccatctcagaggtatcaagtcaatgctcctgttgataagcctgctgatgatggctataactggcggaaatatggtcagaaggtggtgaagggcagtgattgcccaaggagctattacaaatgtactcatcccaattgtccagtcaagaaaaaggtagagcatgcagaagatggtcaaatatctgagatcatatacaaaggaaaacacaatcaccaacgtccaccaaataagcgggcaaaaaatggcaactcttcagcagctgatcaaaatgatcaatctaatgataccacatctggattatcaggcgccaagagagatcaggatgctatatatgggatgtctgaacaagtatctggtttaagtgatggagatgatatagatgatggtgaatcaaggccacatgaagcggatgatgctgacaatgagagcaaaagaagaaatatacaaatttcttcacaaagaaccttgtcggagcctaagatcattgtgcaaacaaccagtgaagttgatcttttggatgatggttatagatggcgtaagtatgggcagaaggtagtcaaaggaaatcctcatccaaggagttactacaagtgcacatttgctggatgcaatattaggaagcacatcgaaagagcatcgtcagaccctaaggctgtcatagcaacctatgaaggaaagcacaaccatgaaccaccagttggtaggggcggcagccagaatgcaggaatgtcacaacagaaagggcagaacagcatatctagtaatcaacactacagcaacactaaccagatgccaattgggattttacaattcaagagcgaacaatagtaatgcac

SEQ ID NO: 17637 - protein, 487 aa, Panicum virgatum
  misc_feature: Ceres CLONE 1792935
  misc_feature (384)..(443): Pfam Name: WRKY Pfam Description: WRKY DNA -binding domain
  misc_feature (227)..(285): Pfam Name: WRKY Pfam Description: WRKY DNA -binding domain
MSARPHLALPPRSAAESLFTGAGDASPGPLTLASALFPSDADAGGGASSGASGAGSFTQLLTGSLGQPPPPQQQRQRQRQHEAAERGRGGGVARAGPALAVATPVSAASGASVFTVPPGLSPSGLLDSPGLLFSPAMGGFGMSHQQALAQVTAQASHSSLRMFDHIEQPSFSAAAASSGALQHMNSSANMTGMPDMAITTANNDNASLQSAEPSQRYQVNAPVDKPADDGYNWRKYGQKVVKGSDCPRSYYKCTHPNCPVKKKVEHAEDGQISEIIYKGKHNHQRPPNKRAKNGNSSAADQNDQSNDTTSGLSGAKRDQDAIYGMSEQVSGLSDGDDIDDGESRPHEADDADNESKRRNIQISSQRTLSEPKIIVQTTSEVDLLDDGYRWRKYGQKVVKGNPHPRSYYKCTFAGCNIRKHIERASSDPKAVIATYEGKHNHEPPVGRGGSQNAGMSQQKGQNSISSNQHYSNTNQMPIGILQFKSEQ

SEQ ID NO: 17638 - DNA, 2650 bp, Panicum virgatum
  misc_feature: Ceres CLONE 1792942
  misc_feature: Encodes the peptide sequence at SEQ ID NO. 17639
gttagtgggtggtgcgagctcagcttcttctcccttttttattttggaaggagggagagctgcctcggacgagctccgagctacagcagcagagggagggaggcagccagggagactagagagagaagggggaagctcctttttctttctggaatcgtttattttaatcctgggatctgattttgtccccatattgggaggattgattatctttctcatctccctctctccccttctcttctcttctcctcccctccccactcagcctcaagaagatcagctttgctgtggaggcaatccctgcctctgccttgttgcctgctcctactctgctccccatgagaggagcacaacctgccctcagattgatcaaactctgttcgtattggtggtacgcctgtgaagcatctttgaggactctcagtttggttgcacaaggcgagctgtaagtgaaaggtttgggtcttctgctaaaacttgatttatcaatcaatatccgaggtgcttctgtgtacacgtatctcttggtgtcattttgatcagttagtagccaaaaactgtatgatggctacttattactcgagcccgggtagtgaaagggactcgcagaacatgtactcaagagacctgggcaatgcatcctatcctatgccatcagctctagggaacttgctgtatctgaacaattctatttcaggaccatacacggaatttagtggtattctgcagtctcagcagaattgcatggagatgcctgaccctggccatccttcagtcatgtcccaagactcatcagcaagggagtctgacatgcttggttcccaccaggggcagcgctctttcggtccagtcaaagatatgaaaaacgagatgttgatgcatatgatggatggatcacaaagtagcactgctgatctcatccatgatgatgaccacaatggtgcacagcttgatttcggtgttctgaacaaccacagttcatcgaacattccctcagtgcaaggccaaggtttatctctgagcctcaacacacaaatcctggcaccttccttaccatactggtctgtcaaaccagatatgttgtcaccacactcttaccatgacagtcttagagttgatgacatccgaatgaagagtatgcagtctgaggcctcacgtgcaatctggaactccaggtatctgaaggcagcacaagaactgcttgatgaggttgtgaacgtatggaaaaatattaagcagaaagctcagaaagaacaagtcgaagctggaaagacagatgccaaggagaccgaaggagggctgaaaagtgagggcgtgtcctctaatccacaggaatctgctgccaatgcagcacctgagctttctactgctgagaggcaagaacttcagaacaagatggcaaagctgatggctatgttggatgaggtggaccggaaatacaagcactactaccaccaaatgcaaagtgtggtttcctcttttgatgtggtagctgggcctggagctgccaagccttacactgcagttgccctccagacaatctcacgacacttccggtgcctgaaggatgctatcaatgatcagatcaatgtcatcagaaagaagcttggagaggaggaaaattcatctggcaaggagggcaaattaactcgtctccggtacattgatcaacagctaaggcaacaacgagctttccaacagtatggcatgattccacaaaatgcctggaggccacagagagggcttcctgaaaactctgttaccattcttcgtgcttggctctttgagcatttccttcacccgtatcctaaagattctgaaaagctgatgctagctaggcaaacaggcttgacaaggagtcagatttcaaattggttcataaatgcccgtgtacgcctttggaaaccaatgattgaggacatgtacaaggaagagattggagatattgagcaagactccaactcttcctccgacaatgcgccaagaagcaagggcaaaatggcatcttctgaagacaaggaggacctgaaaagttctacacctcgggtttgtgagagcagccagctgagcgagtcgagagccagcatagggactatgaacgttggtggagcagctgttggattccagaatgaggccaaccctgacgacagcttcatgaatctgatgctgaaggaccaaagatcaaacgaaggagatggtggcctcctcgtccacaatgctgttgcacatcatcaagatgagaatgcccggttcatggcctaccacttggcagagcttgggagatatggaaatggcaacgtatcactgacacttggcttgcagcactccggcagcagcctctcggttcataatgcccagcagagctttgctggtgtcggagacgatgacatctacaatgctaccgctcctctcggtgtgagcgtcacgtcttcagactatgaatcgatgaaccagatggatcaacggcaaaggttcgagcaatcacctcttctgcatgattttgtggcctgaatgctcatagttcagaagatttttaacacctggcttggctgggtgaataacatatgcctaaaaggagcattgggttgtagcctgtagtttccattcgatacagattggaggtatagcaggaaatgtaatatagtgaggg

SEQ ID NO: 17639 - protein, 648 aa, Panicum virgatum
  misc_feature: Ceres CLONE 1792942
  misc_feature (198)..(339): Pfam Name: POX Pfam Description: Associated with HOX
MATYYSSPGSERDSQNMYSRDLGNASYPMPSALGNLLYLNNSISGPYTEFSGILQSQQNCMEMPDPGHPSVMSQDSSARESDMLGSHQGQRSFGPVKDMKNEMLMHMMDGSQSSTADLIHDDDHNGAQLDFGVLNNHSSSNIPSVQGQGLSLSLNTQILAPSLPYWSVKPDMLSPHSYHDSLRVDDIRMKSMQSEASRAIWNSRYLKAAQELLDEVVNVWKNIKQKAQKEQVEAGKTDAKETEGGLKSEGVSSNPQESAANAAPELSTAERQELQNKMAKLMAMLDEVDRKYKHYYHQMQSVVSSFDVVAGPGAAKPYTAVALQTISRHFRCLKDAINDQINVIRKKLGEEENSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDIEQDSNSSSDNAPRSKGKMASSEDKEDLKSSTPRVCESSQLSESRASIGTMNVGGAAVGFQNEANPDDSFMNLMLKDQRSNEGDGGLLVHNAVAHHQDENARFMAYHLAELGRYGNGNVSLTLGLQHSGSSLSVHNAQQSFAGVGDDDIYNATAPLGVSVTSSDYESMNQMDQRQRFEQSPLLHDFVA

SEQ ID NO: 17640 - DNA, 655 bp, Panicum virgatum
  misc_feature: Ceres CLONE 1792966-R
  misc_feature: Encodes the peptide sequence at SEQ ID NO. 17641
gtgagtccctcatcagcggcgtcaagcaaccatgctccttttacgccatcagagataccagggatgaccatggatgtatcagccctagattcaacgtttggatctgatgtaggaaatgccggacctctgcaattaggaccagatggctcgtcaagagactccatcagatccttagggcagatctggaatttcagcctttctgatctaacagcagatttgatgagcttgggagatttggaagctcttgagaactacaccggtacccctttcctgcattcggattctgacatattacttgattccccagatcaggacgacatagttgagtattttgctgatgccatcaacggatctcaatcagatgaagagaaaccacagtgatgctcttttttcatatcgtagccccgttcaggttcaggaaggactccactctctcatgtagtgtatgtaactttgctgcgatgctgcggcgaacctaactgtgtatccccttccccccacacacaggtggggtaattccgtaattggcctttgccgctagagaatatttttagtagtggttaaaatcctaattctttggaataaacagttggttggtgtagcctttggctggataaaagtcgctggctgtgaatggtgggtgaaatgttcgtcg

SEQ ID NO: 17641 - protein, 126 aa, Panicum virgatum
  misc_feature: Ceres CLONE 1792966-R
  misc_feature: Functional homolog of the protein sequence given in SEQ ID NO 50273
  misc_feature: Useful for making plants with modulated water use efficiency
VSPSSAASSNHAPFTPSEIPGMTMDVSALDSTFGSDVGNAGPLQLGPDGSSRDSIRSLGQIWNFSLSDLTADLMSLGDLEALENYTGTPFLHSDSDILLDSPDQDDIVEYFADAINGSQSDEEKPQ

SEQ ID NO: 17642 - DNA, 722 bp, Panicum virgatum
  misc_feature: Ceres CLONE 1792966
ataactagacgccctcccgctcgaggctccgctcctcagggcgtcaggttcatctgctccctctgtttcccttctccaacctttcccttctctccgagagaaactctctcctgatctccccccttgctcgagatcttccttccctggcggcgacgactgggcgagcggcggcccagccctttgccggcaacgagcgcatcctccaggtatgccgctccggccccttctctttccttgtgctgtgcgagacggagcaccccaaacccagttacaatatattgagctacctactaacttggatttcgtttgcaagaacaagaagaattatcgggtatacatgtgtacacccatgtcctatgctgggtccgcccctgaacccaagcataaccattgttatatttttcttatcaggctcacagaacacggtctttttatgttataaagctgcagtgaaggatgctcaggatattcagagcacgacagagttgcagtcatcagcacaaggtattaatgaagtgcagagtcaacaaccaaatgcaatggccactgatgctcctgcaggagattctggttccttgtcagtagcaagtaatgacaataagaaggtctctcgtgaagacattgaacttgtacagaatttgatagaacgctgtctacagctatacatgaacaaaggagaggttgttaggactctatctactcgtgcaagaatagaacctggc

SEQ ID NO: 17643 - DNA, 1419 bp, Panicum virgatum
  misc_feature: Ceres CLONE 1792978
  misc_feature: Encodes the peptide sequence at SEQ ID NO. 17644
gagcccgaccgcgaccgagcagatcgatcgttattccagctcctctcctcttcttggccgggaagaaagaagggaagaaagggaaggggaggggcgtgggattggctggcgatggcggcggcgctggagttcctggaggcgcagggcgcgacgcggccggagctcgcggagtggtacgcagcgctcgctgacctgtaccagcggaagctgtggcaccagctcaccctcaagctcgaccagttcctcgccctcgccgtcgtccaggcgggcgatgctctgattcagctgtataaccatttcatatcagattttgagaccaagattaatcttctcaaattcgctcacttcacagtggtagtttcacgtcagtatttggacaaagatgcaggtataaactatcttgaaggtgtaatttcaaagctgcgtgatacccgggaagcacgggtcgaagagcccattctgtatgtgaagatgcagattgcaacatttcttcttgagaaagggaatcaaaagggatgtaaggaactgttagaagagggcaaaacaactttggatggcatggttgatgttgatccttcagtacatggtacctattactggttgtgttctcagtatcacaaggcccatcaagactactctgaattctacaagagcgctcttctttatcttgcatacacaacagtggagtcactttcagaaccattcaaacagagcctggcgtttgacctctcactcgctgctttattgggtgaaaacatttacaacttcggggagttacttgctcatccaatcatccgtagccttttggggactcaggctgagtggatttttcatatgttacaagcattcaactctagtaatgtagcactgtaccaagaactctgcaaagctcacaacactgccttgagtgcacagcctgcattggtccaaaatgagaggaaactgcttgaaaagatcaacataatttgcttgatggaaatcattttcagtcgatcatctgaaaaccacacgatcccactgaacaccatagcagaacggaccaggctctcagttgaagatgtggagtatctactgatgaagagcctctctgctcgtcttatagaaggcataattgatcaagttgatggaaccgttcatgtttcatgggttcaaccgagggtgttaggcatagaccaagtaaaatccttgcgtgaccggttggatacctgggttgggaaggtgcacacgaccttgctttcggttgaagcagagacaccagacttgatatcttcatgatgttcctctctttccgcacaaagggttgatgtggcatttcctgatgtgaagaccttatttatctgtccttagactgcagtttctgcagtaacgattgttgtaaccttgttcttcactcagtgaaatttagtagacattcgtagc

SEQ ID NO: 17644 - protein, 387 aa, Panicum virgatum
  misc_feature: Ceres CLONE 1792978
  misc_feature (237)..(345): Pfam Name: PCI Pfam Description: PCI domain
MAAALEFLEAQGATRPELAEWYAALADLYQRKLWHQLTLKLDQFLALAVVQAGDALIQLYNHFISDFETKINLLKFAHFTVVVSRQYLDKDAGINYLEGVISKLRDTREARVEEPILYVKMQIATFLLEKGNQKGCKELLEEGKTTLDGMVDVDPSVHGTYYWLCSQYHKAHQDYSEFYKSALLYLAYTTVESLSEPFKQSLAFDLSLAALLGENIYNFGELLAHPIIRSLLGTQAEWIFHMLQAFNSSNVALYQELCKAHNTALSAQPALVQNERKLLEKINIICLMEIIFSRSSENHTIPLNTIAERTRLSVEDVEYLLMKSLSARLIEGIIDQVDGTVHVSWVQPRVLGIDQVKSLRDRLDTWVGKVHTTLLSVEAETPDLISS

SEQ ID NO: 17645 - DNA, 1176 bp, Panicum virgatum
  misc_feature: Ceres CLONE 1792981
  misc_feature: Encodes the peptide sequence at SEQ ID NO. 17646
aggggtgtggagtagttgacttggagagaggaaggaaggaaggaaggagtctgcgatggagtggagctggctctgctgcggccgatccaacgccagatgcgccgcggtcaacctccccgagccgttccacctcccggcgcccatgcccgagtggccgcaaggagggagttttgcaaagggcacaatagcctgatcccagagctcgtcacctcttcctcagctccacgcctcgctcgcgcgcgcgccccggacgcaccaccaccagcagagatggccgccctcgccgccttctccacggccgccttcgccgccaaaccgcgcctgccccgcgcgcgcctctccgtggcctgctccgccaccggcggcggggacagcagcagcagcggcagcggcgtctcgcttgcctcctccgtcaagaccttctcggccgcgctggcgctgtcgtcggtgctcctctcctcggccgccacctcccctccgcccgccgccgccgacatcgccggcctcaccccgtgcaaggagtccaaggcgttcgccaagcgcgagaagaactcgatcaagaagctgaccgcctcgctcaacaagtacgcccccgacagcgcccccgcgctcgccatcaacgccatcatcgagaagaccaagcgccgcttcgagaactacggcaagttcggcctgctctgcggcgccgacggcctgccgcacctcatcgtcagcggcgaccagcggcactggggcgagttcatcaccccgggcctgctcttcctctacatcgccggctggatcgggtgggtcggcaggagctacctcatcgccatcagcggcgagaagaagcccgccatgagggagatcatcatcgacgtcgagctcgccacgaggctcctccccagggggttcatctggcccgtcgcagcctaccgcgagctcatcaacggagagctcgtcgtcgacgacaaggacatcggctactactaagcgcacctgcatggctggtggcgaccggcgagttgggcagcgactgtgttggggaagatgcatggcttgtggtgtaggagctaataggatgatggaggaatggaagctctgttgtacttaagaaactggatgaagccttgtataactgtacctctctcttgtgtgtattcaccttcttgaaaattcttgagaacgatttcattt

SEQ ID NO: 17646 - protein, 233 aa, Panicum virgatum
  misc_feature: Ceres CLONE 1792981
  misc_feature (50)..(228): Pfam Name: PSI_PsaF Pfam Description: Photosystem I reaction centre subunit III
MAALAAFSTAAFAAKPRLPRARLSVACSATGGGDSSSSGSGVSLASSVKTFSAALALSSVLLSSAATSPPPAAADIAGLTPCKESKAFAKREKNSIKKLTASLNKYAPDSAPALAINAIIEKTKRRFENYGKFGLLCGADGLPHLIVSGDQRHWGEFITPGLLFLYIAGWIGWVGRSYLIAISGEKKPAMREIIIDVELATRLLPRGFIWPVAAYRELINGELVVDDKDIGYY

SEQ ID NO: 17647 - DNA, 1395 bp, Panicum virgatum
  misc_feature: Ceres CLONE 1792986
  misc_feature: Encodes the peptide sequence at SEQ ID NO. 17648
atcccatcccatcttcctcttccgttccgtcactcctctccctcctctcctctcctcccgcgccccactatttattcaatcccaccacgccgatgcgccgccgccccggtggcgtcgccgtcgtgccgccgtagacagaccgccactttttgcaccccgccccccagtcgcaggcgagacggagggcgcgcggcgccggcgatggcgtcggagcccgtggcgcgcgcggtggccgaggaggtggcgcggtggggcgccatgcgccagaccggggtcagcctccgctacatgatggagttcggggcgcggcccacggagcggaccctgctcctcgccgcgcagttcctgcacaaggagctccccatccgcatcgcgcgccgcgcgctcgacctcgagtcgctccccttcggcctctccagcaagcccgccatcctcaaggtgagagattgatatgtggactcattccgtgacatccggtccttcccggaggtgaggagcaaggaagatgagctcgcattcacccagatgatcaaaatgattagggtgcggcacaccaatgtggtgcccacaattgcactgggagtgcagcagctgaagaaggacttgggcggttcgaaggcattcccccctggaatcgatgagatccatcaattccttgaccgcttctacatgtcaaggattgggatccggatgctgatagggcagcatgttgctttgcacgatcctgatccagagcctggtgtgataggacttataaacacaaaaatgtcacccatgacagtagctcgaattgctagtgaagatgcacgtgctatttgcatgagggagtatggatcagctcctgatgtcgacatatatggagatccagattttacgtttccatatgttacaccacatctacatctcatgattttcgagttggtgaagaactcccttcgtgccgtacaggaacggtacatgaagtctgataagcacgcacctccagttcgaatcatagtcgcagatggagcagaggacgtaactattaagattagtgatgaaggtggtggaataccaaggagtggcctctcaagaatctttacttatctatatagtacagcagaaaaccctcctgatctgggtgagcacaatgaaggagtaactatggctggatatggttatgggatccctattagtcgtctttacgctcgatatttcggtggggacttgcagatcatctctatggaaggatatggaactgatgcttacctccacctatcacggctgggagattcggaggaaccattgccctaatcaattgggaagaagccattgctgtaattaggactctattttctttcgcgattgctgtgctggtatgcagatatagttcccgaaggccagcccgctttatat

SEQ ID NO: 17648 - protein, 82 aa, Panicum virgatum
  misc_feature: Ceres CLONE 1792986
  misc_feature: SWISSPROT Homolog: EC 2.7.11.2 [Pyruvate dehydrogenase (acetyl-transferring)] kinase
MASEPVARAVAEEVARWGAMRQTGVSLRYMMEFGARPTERTLLLAAQFLHKELPIRIARRALDLESLPFGLSSKPAILKVRD

SEQ ID NO: 17649 - DNA, 1673 bp, Panicum virgatum
  misc_feature: Ceres CLONE 1792991
  misc_feature: Encodes the peptide sequence at SEQ ID NO. 17650
atcacgccctgtgtgagcttgcagatactacagcacgcgcgcagccagcagggtcgcctcgggctctcaggcggctcaaccagagcgacgtgctgctagctgctcggcagaaactagctagccggtagccatcccttccttccagctccagcggcatggggatggaacctgtggccgcgagccgggaggatgaggaggccaaaaagatggaggccggcggcgacaccgtcggccagaagctcgacgccggcgcgctcttcgtgctccagtccaaggggtcgtggctgcactgcgggtaccacctgacgacgtcgatcgtggcgccgccgctgctgagcctgccgttcgcgttcgcggcgctggggtggacggcggggatcacctgcctggtcatcggcgccgccgtcaccttctactcgtacaacctcatctcccgcgtcctggagcaccacgcgcagcagggccgccgccagctccgcttccgggacatggccacggacatcctagggcctggatgggggaaatactacatcggcccgatccagttcctggtttgcttcggagcagtcatcgcgtgcactctcctagccggccagagcatgaaggcgatctacctgctagccaacccggggggcaccatcaaactgtacgtgttcgtggccatcttcggcgtcttcatgatgatcctggcgcagctgccgtcgttccactcgctccggcacgtcaacctcatctccctgctgctgtgcctcgcttacagcttctgtgccgtcgccggctccatatacctaggaaactccgacaaggcgcccccgaaggactactcggtcacgggtgacgcgcagaaccgtgtgttcggcgtgttcaacgccatcgccatcatcgccaccacatttggcaatggcatcatccctgagatacaggcaacggtgacggcgccggtgacggggaagatgttcagggggctgtgcctgtgctacgcggtggtggtgacgaccttcttcagcgtggccatctcggggtactgggcggtcggcaaccaggcgcagggcaccctgctgagcaacttcatggtggacggcgcggccgtgatcccggagtggctcctcctcatcacccagctcttcacgctgctgcagctctcggcggtgggcgtggtgtacctgcagccgaccaacgaggtcctggagggcctctgctcggacgccaagcaggggcagtacgcggcgcggaacgtggcgccgcggctcgcgtcccgcacggcggccgtcgcgctggccaccaccgtcgccgccatggtgcccttcttcggggacatgaactcgctcatcggcgccttcgggttcctgccgctcgacttcgccgtgccggcggtgttctacaacgccacgttcaagccgtccaagaagggggtcgtgttctggctcaacacggccatcgccgtcgtgttctcggcgctcgccgtgatcgcgtccgtcgcggcggtgcggcagatcgcgctggacgccaagacctacaagcttttcgccaacgtgtgaggagcttttgtagtctgctgcgtgcaatagacgatgtagttcgcgggcgctttgtagtcgtgtagaggggtacggtggctcaggcacgcgcaaatgtgtttttctgcctgcttatatggaggaaaccacgaatct

SEQ ID NO: 17650 - protein, 460 aa, Panicum virgatum
  misc_feature: Ceres CLONE 1792991
  misc_feature (39)..(446): Pfam Name: Aa_trans Pfam Description: Transmembrane amino acid transporter protein
MGMEPVAASREDEEAKKMEAGGDTVGQKLDAGALFVLQSKGSWLHCGYHLTTSIVAPPLLSLPFAFAALGWTAGITCLVIGAAVTFYSYNLISRVLEHHAQQGRRQLRFRDMATDILGPGWGKYYIGPIQFLVCFGAVIACTLLAGQSMKAIYLLANPGGTIKLYVFVAIFGVFMMILAQLPSFHSLRHVNLISLLLCLAYSFCAVAGSIYLGNSDKAPPKDYSVTGDAQNRVFGVFNAIAIIATTFGNGIIPEIQATVTAPVTGKMFRGLCLCYAVVVTTFFSVAISGYWAVGNQAQGTLLSNFMVDGAAVIPEWLLLITQLFTLLQLSAVGVVYLQPTNEVLEGLCSDAKQGQYAARNVAPRLASRTAAVALATTVAAMVPFFGDMNSLIGAFGFLPLDFAVPAVFYNATFKPSKKGVVFWLNTAIAVVFSALAVIASVAAVRQIALDAKTYKLFANV

SEQ ID NO: 17651 - DNA, 2280 bp, Panicum virgatum
  misc_feature: Ceres CLONE 1792998
  misc_feature: Encodes the peptide sequence at SEQ ID NO. 17652
acagttcagggatcgaacacgaggtgcaggagcaatgtcgcttcaggctctgcacctggccagtctgctgcttctcctctcgcctgattgccgctgggcacacgccgccgccggccagctcatctacaacggcttcaagggcgcgaacctcaccctcgacggcggggccgcggtgacgccggacggcctcctggtgctgaccaacggcagcatccagatgaaaggccacgctttccacccgtccccgctgccgttccgggacccgggcgccccgaaccccgccgccgcgcggtccttctccaccgccttcgtgttcgccgtcttcgggcagtacgccgacctgagcgccgacggcctggccttcttcgtcgccgcggacagggcggtgctgtccaccgcgctgccgggcaagttcctgggcctcctcagcgacgccgacaacggcaaccggagcgcccacatcttcgccgtggagctggacacgctcttccacgccgagttccgcgaccccaacagcaaccacgtcggcgtcgacgtcgacagcctggtgtcgcgcgcggccgccgacgccgggtactacgacgacgccaccggggagttccggaacttgaccctcatcagccggaagcccatccatgtgtgggtggactacgacggcggcgccgcgcgggtcaccgtcaccatggccccgctgggtgtgcccaggcctaagaggccgctgctgcaaaccgccgtcgacctctccgacgtggtgtcgggcacggcgtacgtcgggttctcgtcggcgacgggcgtcctccgctcgcgccacttcgtggtcggctggagcttcgcgatggacgggccggccccggcgctcaacatctcggagcttccatccctgccgccctcggggcccaagccccggtccaaggtactggagatcgccctccctgtagcgtcggcggcgctggtcctcgccgtggggagcgccctttacacctgggtgcggcggcggagcaagtacgccgaggtgcgcgaggactgggagctccagttcgggccgcaccggttctcgtacgaggatctgttccacgccaccagggggttcaggggcgagcagctgctcggcgccggcgggttcggaagcgtgtacaggggcgtcctccgcaagaccggcacggaggtcgccgtgaagaaggtgtcgtcgccggcgccacacgagccgtccaagcagcaggggatgcgggcgttcgtcgccgaggtcgcgagcctgggacggctgaggcatcgcaacctcgtgcagctgctcggctactgccggcgcagaggcgagcttctcctggtctacaactacatgcccaacggcagcctcgacaagcacctgtacgaccggagcaagggcgccgccctggagtggcctcagcggctccacatcatcagaggagtcgcctccgcgttgctgtacctgcacgaggactgggagcgagtcgtcgtccaccgggacgtcaaggcgagcaacgtgctcctcgacagcgaaatgaacgggcggctaggagacttcggtctcgcgaggctctacgatcacggggcagacgcgcacaccacgcatgtggtgggcaccatagggtacctcgccccggagctaggccacaccggcaagccgactccggcaaccgacgtcttcgccttcggggcgttccttctggagatcacctgcggacgaaggcccgttgaggaagacgatcaccaggacggcggcagcaaccgtgtcatgctcgctgacagggtggttgagcaatggcgcaagggttcgatcaccagcgtcgtggatgcgaggatggatccggatgggtgtgatcccgaagaggtctctcttgtgttgaagcttgggctgctatgctcgcatccgttatcccatgggagcccaaccatgaggcaggttgtgcagtacctcgacggcaatacggttcttccagacttgtcacctgcagcttccttgggcttcaccgaaatggaggagcgaatgtgccgcagggagttaggccagattgcgacgtccacgagcatgggtactactgtttctggtctctcgggaggaagatgatgataatgtaatgttctttatgagggtgactctgcgtctcagctagggagtgtaactgttagttcttctctttgcattgtcgtagtagtagtacctgataacaaacacagttgctgcctcgatccatcgatccgagaacttttgtgactgtgctccgtgcccgtgcacgagctgaagaatgtaccagcttactc

SEQ ID NO: 17652 - protein, 683 aa, Panicum virgatum
  misc_feature: Ceres CLONE 1792998
  misc_feature (25)..(267): Pfam Name: Lectin_legB Pfam Description: Legume lectin domain
  misc_feature (352)..(634): Pfam Name: Pkinase Pfam Description: Protein kinase domain
  misc_feature: SWISSPROT Homolog: EC 2.7.11.1 Non-specific serine/threonine protein kinase
MSLQALHLASLLLLLSPDCRWAHAAAGQLIYNGFKGANLTLDGGAAVTPDGLLVLTNGSIQMKGHAFHPSPLPFRDPGAPNPAAARSFSTAFVFAVFGQYADLSADGLAFFVAADRAVLSTALPGKFLGLLSDADNGNRSAHIFAVELDTLFHAEFRDPNSNHVGVDVDSLVSRAAADAGYYDDATGEFRNLTLISRKPIHVWVDYDGGAARVTVTMAPLGVPRPKRPLLQTAVDLSDVVSGTAYVGFSSATGVLRSRHFVVGWSFAMDGPAPALNISELPSLPPSGPKPRSKVLEIALPVASAALVLAVGSALYTWVRRRSKYAEVREDWELQFGPHRFSYEDLFHATRGFRGEQLLGAGGFGSVYRGVLRKTGTEVAVKKVSSPAPHEPSKQQGMRAFVAEVASLGRLRHRNLVQLLGYCRRRGELLLVYNYMPNGSLDKHLYDRSKGAALEWPQRLHIIRGVASALLYLHEDWERVVVHRDVKASNVLLDSEMNGRLGDFGLARLYDHGADAHTTHVVGTIGYLAPELGHTGKPTPATDVFAFGAFLLEITCGRRPVEEDDHQDGGSNRVMLADRVVEQWRKGSITSVVDARMDPDGCDPEEVSLVLKLGLLCSHPLSHGSPTMRQVVQYLDGNTVLPDLSPAASLGFTEMEERMCRRELGQIATSTSMGTTVSGLSGGR

SEQ ID NO: 17653 - DNA, 1680 bp, Panicum virgatum
  misc_feature: Ceres CLONE 1793006
  misc_feature: Encodes the peptide sequence at SEQ ID NO. 17654
accttcctttccccttctccgtgcagagcctccctccccaacacggcaacacgcgttcccctcaaattctcccgcacccgcttgaaatccccaaatccgccgcggcgggcttcgaattcgatccccttcccccgagtcgtcggctcgatctgatcggcgagagcagccaccaagccaaccatgtgggcggcgtcgtgcctggcgtcgtgctgcgcggcgtgcgcgtgcgaggcctgccggacggcggtcggcagcatcggccgccgctccgcgcgcatcgcctactgcggcctcttcgcgctctccctcttcgcctcatgggcgctccgcgaggtcgccgcgcccctcctccagtccatcccatggattaaccacttccacaagacgccggaccgcgagtggttcgagaccgacgcggtgctcagggtcagcctcggcaacttcctcttcttcaccatcctcgccgtcatcatggccgggataaaggaccagaaggacccccgcgacaagatccaccacgggggatggatggcaaagatcttctgctgggccgtcatagtcttcctcatgttcttcgtgcccaacggcgtcgtcagcttctatgagtcgatttccaagtttggatctgggctgttccttcttgttcaggttgttcttctgttggactttgttcacggatggaatgagaactgggtcgctaaggatgagcaattctggtacatggctctattggttgtctcagttgtctgttacattgccacattctctttctcgggtcttctatttcactggttcactccatctgggcatgactgcggactcaacctgttcttcattgtcttcacattgattcttgtttttgcgttcgctattgttgccctccacccaaagatcaatggtagcttgttgcctgcatcagttattggtctctactgcgcctatctgtgctacagtggactctctagtgagcctagggattatgagtgcaacggacttcacaatcactcaaaagctgtgtcaactggtagccttacactgggactgctaaccaccatcctttctgtggtttattctgctgtccgtgctggctcttccgcaactgtgctctcaccaccagactcaccacgtggtaccgacaagccattgcttcccttcagcaaggcagatgaacaagaagataagaaggatgtaccaaggccagtgacatactcctactctttcttccacctcatcttctccctggccagcatgtactcagcaatgctcttgactggctggtcaacctccattggtgagagcggaaagcttgttgatgtcgggtggccatctgtctgggtcaggattgcaacccagtgggcgaccgcaggtctgttcatatggtcccttgttgctcccatcctcttccccgacagggaattctaggtcaaccacgacaacctatgaatgcatgcatccctttggagcatcaaccatcaaccatttctactgtggtagctaatctgtcctataaaaatatttgatctgtaatatatgccgtgagcaaatcgagcatgaagccagtgtctgtccgtggctatcaagtctgtcatcaacttaataatattcggcatcaggcattgtgccagtatgtgaacagtgaaatggtgctgcttgtattgtatatacactggaatttgtgtc

SEQ ID NO: 17654 - protein, 413 aa, Panicum virgatum
  misc_feature: Ceres CLONE 1793006
  misc_feature (8)..(413): Pfam Name: Serinc Pfam Description: Serine incorporator (Serinc)
MWAASCLASCCAACACEACRTAVGSIGRRSARIAYCGLFALSLFASWALREVAAPLLQSIPWINHFHKTPDREWFETDAVLRVSLGNFLFFTILAVIMAGIKDQKDPRDKIHHGGWMAKIFCWAVIVFLMFFVPNGVVSFYESISKFGSGLFLLVQVVLLLDFVHGWNENWVAKDEQFWYMALLVVSVVCYIATFSFSGLLFHWFTPSGHDCGLNLFFIVFTLILVFAFAIVALHPKINGSLLPASVIGLYCAYLCYSGLSSEPRDYECNGLHNHSKAVSTGSLTLGLLTTILSVVYSAVRAGSSATVLSPPDSPRGTDKPLLPFSKADEQEDKKDVPRPVTYSYSFFHLIFSLASMYSAMLLTGWSTSIGESGKLVDVGWPSVWVRIATQWATAGLFIWSLVAPILFPDREF

SEQ ID NO: 17655 - DNA, 1211 bp, Panicum virgatum
  misc_feature: Ceres CLONE 1793008
  misc_feature: Encodes the peptide sequence at SEQ ID NO. 17656
tacagaaaggccacagagaccggccgggagcaggagcagcgagatggcggcggcggagtcctcgggcacggcgatagggtcctcgggaagatgggccctccacggcaagacggccctcgtcaccggcggcacgcgcggcatcgggcgtgcggtagtggaggagttggcggcgctgggggcatcgagcatcgtcgccagcagcctcgccgcccccgcccccgcccccgcccccgcgccgtcgcccaagccccgcagccccgcctccgccgcccgccgcaggctcatcatgagcaagcccgtcttcgccgcccacagcgccgtcgcgggcatggacgccgtcgagcgcttgaagagcgggttcgagcagttcaagacccaggtctatgacaagaagccagagctgttcgagccgctcaaggccggccaatcccccaggtacatggttttcgcctgcgccgactcccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgcgctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggagaaggaggccgtgaacgtgtccctctacaacctcttgacctacccctgggtcaaggaaggtgtggagaacgggaccctcaagctggtcggcgcacgctacgacttcgtgaacggtgtgttcgacacatgggtgaaataagccaccaactcctacatcatcaaatacatacatagtacttgcataccgatatgcacctcatcgatgtgaatccgtggagtacttactgcctatttcgaccgcttcgaaccggatcgtcctatgctgtaataagcaatagcattttctactgctttacttcctaaggtggagcttatatatatgtaatatatggtgcgtaatttgaccgcttttgtggtcaagagacatcaactgtataagcctttttcataatattatcatgcagtatctttttact

SEQ ID NO: 17656 - protein, 296 aa, Panicum virgatum
  misc_feature: Ceres CLONE 1793008
  misc_feature (125)..(295): Pfam Name: Pro_CA Pfam Description: Carbonic anhydrase
  misc_feature (81)..(294): SWISSPROT Homolog: EC 4.2.1.1 Carbonate dehydratase
  misc_feature (13)..(40): SWISSPROT Homolog: EC 1.1.1.206 Tropine dehydrogenase
MAAAESSGTAIGSSGRWALHGKTALVTGGTRGIGRAVVEELAALGASSIVASSLAAPAPAPAPAPSPKPRSPASAARRRLIMSKPVFAAHSAVAGMDAVERLKSGFEQFKTQVYDKKPELFEPLKAGQSPRYMVFACADSRCCPSVTLGLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILEKEAVNVSLYNLLTYPWVKEGVENGTLKLVGARYDFVNGVFDTWVK

SEQ ID NO: 17657 - DNA, 698 bp, Panicum virgatum
  misc_feature: Ceres CLONE 1793023
  misc_feature: Encodes the peptide sequence at SEQ ID NO. 17658
agcatgcatcacacattgacacaccctctcgcgcccttcccagcatggcttgctgcaagctctaccattccgtggtgctcgccgtcgccgttgtcatcctcgccgtcggaccggccgcgcggcccgtttcagccgcgtcggcgcaccttcacttgtacatgcacgacgtgctgacgggcccggcgccgacggcggtgcaggtgctgaacggcccccggggccacttcggcgacacggtggtgatcgacgacgtgctcacggagggcgcgtcgcgggcgtcggccgcggtcgggcgcgcgcaggggcactacatctgggcgtcgacggggaacccggagctgctggtgaccatgaacgtggtgctcgatcacgggccctacgccggcagctccgtcaccgtggtggggcgggacgacatcggcgcgccggtgcgggagctgtcggtggtcggcggcaccgggcagttcaggatggcgagagggtacgtgctgtggaagaccgtcagcctcgaccaccccaacgccgtgctcgagctcgatgtcttcgtcagcgcctgagcaagctgagctgcgcacacgtggtgggaagttccgcacatcgccgtgtacggtgtaccgccaaataagcttctagtactttgtggagtataattgcataaataaacgtacggtaacgaaaaacgaagccttttcaaaatc

SEQ ID NO: 17658 - protein, 170 aa, Panicum virgatum
  misc_feature: Ceres CLONE 1793023
  misc_feature (14)..(170): Pfam Name: Dirigent Pfam Description: Dirigent-like protein
MACCKLYHSVVLAVAVVILAVGPAARPVSAASAHLHLYMHDVLTGPAPTAVQVLNGPRGHFGDTVVIDDVLTEGASRASAAVGRAQGHYIWASTGNPELLVTMNVVLDHGPYAGSSVTVVGRDDIGAPVRELSVVGGTGQFRMARGYVLWKTVSLDHPNAVLELDVFVSA

SEQ ID NO: 17659 - DNA, 1866 bp, Panicum virgatum
  misc_feature: Ceres CLONE 1793025
  misc_feature: Encodes the peptide sequence at SEQ ID NO. 17660
ctccccacccgacgcccaaaccctaccccgtctactccatagcgtgtgcggcggcggcggcggcagccggtgaactctgtgtggcactcctgcactccctccaatcctcctctcttcccactccgacagattttaggcctttctcctctcgcagcatctcgcaatccccgtcgcagccatctcctcctcccttaccctctccagcggcggcggcaactccggctcacgacagcgaaggaacaccacgatggcgacgatcgtgaacacgacggaggaggagcctatgctggcggtggttcgcttcaccgccgagctcgcctgggccgacgcaggcccggaggtcgccgaccccgaggtcacccgtctctgcctcgaggcgcaggagcatatcctcgcggggcgctggctcgacatggcctccctcatgcttgcctccgctgacctcctcctcacctctccgtcccgcgtccccgacaaagatcttgagtgcatcctctctgtcatctgcagccttgtcaccaaggctggatccgaggaccaggcgctgcagatcaccgacctcatatgcgccaagcttacccagcagcccgatgacaaaccagccctgcgccttaaagttctgtttagcctgtacaatcttctcccgagcccctacggcaaggcatttgtttacaaaaaggctctcgagcttgccactgccgggaaggctgccgagtgcatcatcccgtcattcaagaacattgacagctttgtcagtgagtggggaattggaaatttggagcagagggagctgtacctggccatcaccaggatcctcaaagaccacaagggcatgaccaaggagtacttcaacttcctcaacaagtacctcgccactttcaagggatcagctgatgactctgctacaattggtgatgcaaaggaagaggctgttgcggcaatcattgagtttgtcaaatcatctacactctttcagtgtgatctacttaatatgccagctgttgcacagcttgagaaggatgagaagtatcagttactttatgaacttttaaagatattccttacaaagaggcttgattcctatttagagtttcagactgcaaactctgccttgctgaaagattatggactggttcatgaggactgcataactaaaatgcgtctcatgtctttgctcgatctgagcagccattgctctggtgaagtcccttattcagcaatcacttcagcacttcagatcaatgatgatgaggtggagcaatggatcgtgaaagcaattgcattcaagatattggattgcagggttgatcagcttaaccagactgtcatcgtcagtcggcatactgagaggatatttgggatgccacagtggcagggcctgcgcacaaaacttggagtctggaagggaaatattgccagtgctatcaacacaatccaagctaacaaagtcactgacgaggggacacaagggatgcgaggcttgatgatccgctgatcggaagcgagtgcaagaatagagtttatagctcgagggattagatgagcaatcttgtaagaatttatcatatgatttagacccgtgatgatgctggatagatttgagttgcagtgcatgctccgcaacaccctttgttccatgtttttgtcagcacagccgtgcaagtcagctgttacgcataccaaattgtgacaggatgcagtttgtttcttcatcgctaactcttgtcctttctaaattttgatcactagcaacttgcgcgtccccccgagcgcttactatttttgtgattctgtgtgatatctgcagagcatgtatctttgacatatgtacatacgtagttgggttaaaaaatattttgatctatg

SEQ ID NO: 17660 - protein, 415 aa, Panicum virgatum
  misc_feature: Ceres CLONE 1793025
  misc_feature (262)..(364): Pfam Name: PCI Pfam Description: PCI domain
MATIVNTTEEEPMLAVVRFTAELAWADAGPEVADPEVTRLCLEAQEHILAGRWLDMASLMLASADLLLTSPSRVPDKDLECILSVICSLVTKAGSEDQALQITDLICAKLTQQPDDKPALRLKVLFSLYNLLPSPYGKAFVYKKALELATAGKAAECIIPSFKNIDSFVSEWGIGNLEQRELYLAITRILKDHKGMTKEYFNFLNKYLATFKGSADDSATIGDAKEEAVAAIIEFVKSSTLFQCDLLNMPAVAQLEKDEKYQLLYELLKIFLTKRLDSYLEFQTANSALLKDYGLVHEDCITKMRLMSLLDLSSHCSGEVPYSAITSALQINDDEVEQWIVKAIAFKILDCRVDQLNQTVIVSRHTERIFGMPQWQGLRTKLGVWKGNIASAINTIQANKVTDEGTQGMRGLMIR

SEQ ID NO: 17661 - DNA, 854 bp, Panicum virgatum
  misc_feature: Ceres CLONE 1793059
  misc_feature: Encodes the peptide sequence at SEQ ID NO. 17662
ctttttgctcctttgttcccttcccatcttcctctcctcggttctcggcactcggcgtcactcgccgcggttcccgccggcggctctccgggtccgggccaatccattccaggaccttctccagaacgaggcggcgcgtgtgcgcgagcgagggggcgttccgcctgccgtgccatggcgccgccgtgcgggctgctgctggccctggcggcggcggcggccgtgctcgcggccgcgggcgcgcgggcgcaggagacgtgcgcgggggcggcgccgccgcggcgcggggcgcgggtgtccgtggccagcttcggcggcgcgggggacggccggacgctcaacacgggcgcgttcgcgcgcgccgtcgccaccgtcgagaggctgcgcgcgcccggcggggcggagctctacgtgccgcccggggtgtggctcacggggccattcaacctcacctcgcggatgacgctcttcctcgcgcgcggcgccgtcatccgcgccacgcaggacacaccaagctggcctctgatcgagccgctgccctcatacgggagaggacgagagctgcccaggggaagatacataagtttaatccatggcagtggactccaggatgttgttatcacaggtgaaaatggaactattgatggtcaaggcagtgtgtggtgggatatgtggaagaaaggtacactgccctacacaaggcctcacctacttgagctgatgacctcttctgatatcatcgtctccaacgtcgtcttccaggattcccccttctggaacattcatcctgtttattgcagcaatgttgtgatcagaaatgtgactgtactagctccacatgactcccccaacac

SEQ ID NO: 17662 - protein, 226 aa, Panicum virgatum
  misc_feature: Ceres CLONE 1793059
  misc_feature: SWISSPROT Homolog: EC 3.2.1.67 Galacturan 1,4-alpha-galacturonidase
  misc_feature: Functional homolog of the protein sequence given in SEQ ID NO 50778
  misc_feature: Useful for making plants with altered carbohydrate content
  misc_feature: Functional homolog of the protein sequence given in SEQ ID NO 50779
  misc_feature: Useful for making plants with altered cell wall content and/or composition
MAPPCGLLLALAAAAAVLAAAGARAQETCAGAAPPRRGARVSVASFGGAGDGRTLNTGAFARAVATVERLRAPGGAELYVPPGVWLTGPFNLTSRMTLFLARGAVIRATQDTPSWPLIEPLPSYGRGRELPRGRYISLIHGSGLQDVVITGENGTIDGQGSVWWDMWKKGTLPYTRPHLLELMTSSDIIVSNVVFQDSPFWNIHPVYCSNVVIRNVTVLAPHDSPN

SEQ ID NO: 17663 - DNA, 673 bp, Panicum virgatum
  misc_feature: Ceres CLONE 1793059-R
  misc_feature: Encodes the peptide sequence at SEQ ID NO. 17664
tggccacccgagctccgacataactgttcggcggatcacaggctcctccccttttgccggctttgctgttggaagcgagacatctggcggtgtgcagaacgtccttgcagagcacctgaacttctttggctcagggtacgggatccacatcaagaccaacactggcaggggaggcttcatcaggaacgtcaccatctccgacgtgaccctggacaacgtccggtacggtctgcggatcgcgggtgatgttggggaccaccctgatgatcgttacaaccggagtgccctcccggttgtggatgccctgacgataaagaatgtccaggggcagaacatcaaggaggctgggctgatcaagggcatcccctactcagccttctcccggatctgcctgtctaacgttaagctcagtggtggtgcgcctgtccagccatggaaatgtgaggctgtcacaggtggcgcgctcgatgtgcaaccatccccgtgcacagaactgacttccacgtccgggacgagcttctgtacaaattcgctttgatgctgaagttagctgctactgcatgctcttaggcggccatttcactccatgcattcttcctttttcatgtgaaaggaattctatttttttcattcctctatatattccggaatgaaatttctggatttggkkgtg

SEQ ID NO: 17664 - protein, 178 aa, Panicum virgatum
  misc_feature: Ceres CLONE 1793059-R
  misc_feature: SWISSPROT Homolog: EC 3.2.1.15 Polygalacturonase
  misc_feature: Functional homolog of the protein sequence given in SEQ ID NO 50778
  misc_feature: Useful for making plants with altered carbohydrate content
  misc_feature: Functional homolog of the protein sequence given in SEQ ID NO 50511
  misc_feature: Useful for making plants with altered cell wall content and/or composition
GHPSSDITVRRITGSSPFAGFAVGSETSGGVQNVLAEHLNFFGSGYGIHIKTNTGRGGFIRNVTISDVTLDNVRYGLRIAGDVGDHPDDRYNRSALPVVDALTIKNVQGQNIKEAGLIKGIPYSAFSRICLSNVKLSGGAPVQPWKCEAVTGGALDVQPSPCTELTSTSGTSFCTNSL

SEQ ID NO: 17665 - DNA, 2130 bp, Panicum virgatum
  misc_feature: Ceres CLONE 1794248
  misc_feature: Encodes the peptide sequence at SEQ ID NO. 17666
tagcgaaccagaaaaaatcgcccccgccctgccgtgtctccgctcccgcatccccaagcggaactctcgctttcggcgcacgctcccgtccggcccccgcatcctccagggcgccccatgagctgaggccgccgccgatgggcccgccccccgccgcgcaagaccccgcgccgtcgccgtcgggcggcagcggctcctccaggcgccgcctccgccggctcgaccgccgcaacgcgtccaagaacatcggctacgacgccaccaacttctgccagttcccgctgtccccgcagccggcctccgcgccggcgtcggggccggcctcgctcgccggctccgcggcctgctcgctcgacctcgtcaacagcttccgcatcggcggcagcggcgacggcggcggggacgtccagctcctctgccagagcctcggcctctccggccccgacgacttcgccatcccgctcgccgactgggaggcgcacaaggccgtgcgctcctcggcctccgcctccgcctcccctgcgtccgcgcagcacaaacccgaaccccccgcgcgggactccccgctccgccacgagggcgccgacgagcccacccggccagcggacgccgaccacgagctaccggcgaaggagccggccgcgagggacgccccaatcgaagctctggagcggccggcacggctggatccgctcgagtccacccgcccggatgtgaagagggcagttggggagggaggaatcaagggcttgcgcccaccgccggtgctcaagccgcccccctcgatggcgctgccgcctgtctgcggggcgggatccacgtgggatatcctgcggtcgttcgcgccggatgagaaagagcatgcccctgcgagcagatctggccgagatttttcacaccaggatgcggaggaggacgaggatgcggcggtagtgttgacgctggaggatctcaggcttggcgagtcgtccgagggcttcactggcacttcttcgctatccaccacgaacgacgacgagacttgcagcacgaccaccgagtccatgttctacatctcaccgaacggccggttcaggaagaagattcggtcatggaaccgaggggtgctcctggggagtggctcgtttgggacggtgtatgaaggcatcagcgagtaagtgctttctctaatgataatatccagttcgtctgtactgtttggttagttgattggaatcaacaattgaacatgctaagcatgcccaaagttagtgtaggttgcgtgtagaagcccactgggttttgcaaaaccaattttttttgcagattatatcttactggctccatttctagatgttatgaatatactgtacattatgtacagcctagtactacatagtattagtaattgagttaattgcatgatttagtctacaactaaaccaacatgatcttaagttgtagcaactcataatcaactaaaattgtggccccatccaattcgaggaaccatattctcaatcatacacaggagcatggcatcttagtgtgccaaaatgcttctgggtgaacacatgattcctcgatcacttgatgattcttttctatttttgcatatgtcaattagaatttaggtatgtttacttgtttgtgttctagggtcacagcaaaattggatatttaacattgagaacaatataccctgttttatctccaatgatcgggatggttgtcttttctagttggcttgctctagtgatttctgtcacaagtctaaagtcccttacactctgttctgttctgttctttttttgcaccatattctcagtgagggtggcttctttgccgtcaaagaagtaagtttatatgatcaagggagcaacgcgaagcagtgtatctttcagcttgagcaggtttgtttcattatgttgtcttgataatatgagagctataatgtattactggtagtttcctatcatatagtgaattgtgacaactactggtagctgaatttgtatggctattgtggtcaatgataggttgaaaggttatttttatggacttccactatgactttctaagatttgatcctttggcctgtgtgctgttagccttaagagggctcagctaccgaactatgcccgattcctc

SEQ ID NO: 17666 - protein, 339 aa, Panicum virgatum
  misc_feature: Ceres CLONE 1794248
  misc_feature: SWISSPROT Homolog: EC 2.7.11.25 Mitogen-activated protein kinase kinase kinase
MGPPPAAQDPAPSPSGGSGSSRRRLRRLDRRNASKNIGYDATNFCQFPLSPQPASAPASGPASLAGSAACSLDLVNSFRIGGSGDGGGDVQLLCQSLGLSGPDDFAIPLADWEAHKAVRSSASASASPASAQHKPEPPARDSPLRHEGADEPTRPADADHELPAKEPAARDAPIEALERPARLDPLESTRPDVKRAVGEGGIKGLRPPPVLKPPPSMALPPVCGAGSTWDILRSFAPDEKEHAPASRSGRDFSHQDAEEDEDAAVVLTLEDLRLGESSEGFTGTSSLSTTNDDETCSTTTESMFYISPNGRFRKKIRSWNRGVLLGSGSFGTVYEGISE

SEQ ID NO: 17667 - DNA, 1789 bp, Panicum virgatum
  misc_feature: Ceres CLONE 1794251
  misc_feature: Encodes the peptide sequence at SEQ ID NO. 17668
gaacccagaaccctagtggggggacacgtcactgcgccggccaggggcaagggcaagaaggccaagcgcggcgccgccatggctgacgctgacgccgacgagatcatgccttcggccgacgggggggagctggagcaggcttcgccgccggagcccgcggccaacgggggcgaggcaccaccggctccggccgcgcccaacgggacggcggcggcggcggcggcggcggggcggggctcgtcgccggagcgggacggcggggaggcggggaggctcaggcgcctcaacgacctgctcgccgcgagggccaaggaggagcgggggcgggcggcggcgctcgaggcgcggctcggcgaggtggaggccgacgcggcggcgctcgcggagggggagcgcgtggcactgcgcgcggcgctcgcggcgccgctccgggccgcggaggcggagcgcgcggcgctgggggcgcgcctcgcggcggcgcgggaggcgctcgggcgcgccgaggcgggggcggcgcgcgaggcgcgggcgcgggccgaggccgcggcggggctggaggcggcgaccgcggagaaggccgcactctcggagcggctgggcgccaaggacgccgaggcggcggccgcggccgcgaaagccgccggattggaggcagcggtcgccggattggaggcggagctctccgacctgcacgcggagaggggccggttggaggagcagttggaggcggcgagggcgtcggcgagggctgtccaggcccagaaggtggaggtggaatcaagcttcaacgagttcaagaggaacgcagaggaagcaaagcaggggatggaggagaagctccaggagaaactgaatgaattggaggctctgcaatcaaggaaggaggaaatggaggcgaaggtcggttctctggaggcggcgctctcggcggccattgctaggaacagcgaattggagtcggaggtggatgaaatgaagatggaggtgcttgctgcaaggaaggaggtcgagaagctccaagccgaggttgcagaggcgggtgagaagcacagctcagcggtagcggaagtatttaggctccggagtaagattgacaaggtggtgaaggcgaatgaggctgctgcagcggcgcatgatattgagaagaaaaggttggagtctgaattggaggttctgaagggggaggttggccggatccaggccgagaaggatgcttctttgggaatggtccatgctaaagatgctgaggttggagagttgagggatgaattgaagaagctccatggttcgatggccgatctccatactctctgcagtgatcttaaggggaagtcttcctccctgcaagatgaaagggattcagttctgaaagcactcgaaaagcagaaagctgaggcagatgagctgaggttgactcttggggagcttgatgtctgtaatggtgagaaggatcgtgagattcagacactgaaggcagaagttgagggcaaggggatcgaaatcagtcacttgaacggggatcttgagcagctgcagcttgcagttgccgaagcacagcgcagggggaagaatgaggtctggagatggctgggcccagctaccacctccgtgttagcagctgcttcctttgtctacgccgcccgtagtcggtgaacagctagctcttttacttgctttttgttcacttcctcgagtatgaattactcagaataaccaggcttcctactcatgacatggtgacactgcaccttactatgaaataaagctattttggagcaactttgtttgc

SEQ ID NO: 17668 - protein, 524 aa, Panicum virgatum
  misc_feature: Ceres CLONE 1794251
  misc_feature: SWISSPROT Homolog: EC 2.7.11.1 Non-specific serine/threonine protein kinase
MADADADEIMPSADGGELEQASPPEPAANGGEAPPAPAAPNGTAAAAAAAGRGSSPERDGGEAGRLRRLNDLLAARAKEERGRAAALEARLGEVEADAAALAEGERVALRAALAAPLRAAEAERAALGARLAAAREALGRAEAGAAREARARAEAAAGLEAATAEKAALSERLGAKDAEAAAAAAKAAGLEAAVAGLEAELSDLHAERGRLEEQLEAARASARAVQAQKVEVESSFNEFKRNAEEAKQGMEEKLQEKLNELEALQSRKEEMEAKVGSLEAALSAAIARNSELESEVDEMKMEVLAARKEVEKLQAEVAEAGEKHSSAVAEVFRLRSKIDKVVKANEAAAAAHDIEKKRLESELEVLKGEVGRIQAEKDASLGMVHAKDAEVGELRDELKKLHGSMADLHTLCSDLKGKSSSLQDERDSVLKALEKQKAEADELRLTLGELDVCNGEKDREIQTLKAEVEGKGIEISHLNGDLEQLQLAVAEAQRRGKNEVWRWLGPATTSVLAAASFVYAARSR

SEQ ID NO: 17669 - DNA, 1859 bp, Panicum virgatum
  misc_feature: Ceres CLONE 1794252
  misc_feature: Encodes the peptide sequence at SEQ ID NO. 17670
gtcagggagacgcacgccgcgtgcacggtgaggaaggaagagtgcttggggagagaggggaatcgagggacacatccgcgtggcttgatcagttgatctcagcagcgatggaggcggcgctagtggagcggctggaggcggcggtggcgcggctggaggccgccgtggcctccggcgcctcgctcgcgtcggcggccccgcgcgacctcgacgtcccggcggccgcggatccggccatcgtggcctacgaggagttcgtcgcggaggcagtcgggcggctcacggccgcggcagagaagatcggcgggaaggtgctcgacgccaccaagctgctcgccgaggccttcgccgtcgccaaggatctgctcgtccaggccaagcagctccagaaaccagcatcaatggctgatgcacaggacttctttaagcccctaagtgatgttatcgccaaagcaactgcaatgactgaaggaaggaggcacgactatttcaaccatttaaagagtgttgctgacagtctccctgctttggcttgggttgcattcttagggaaggattgcggcatgagtttcccaaccgctcatgtagaggaaagctggcagatggctgagttctataataataaggttcttgtggagtacagaaacaaagaccctgatcatgttgagtgggctaaagcactgaaggatctatacatgcctggtttgcgggattatgttaagaagcattatcctcttggtcctgtctggggtcccgctggaggtgctgctgcttcccaaccaaaggttgttgctcctacacctaaagcaccagcagctaaggctcctcctccaccggctcctccttcagcgcctctttttaccaccgagaagtctccgaaatcttcacagcctaaacaagggatgtcagctgtctttcaagagattagttccaaacctgtgactgcagggttgcgaaaggttaccgatgacatgaaaactaaaaaccgtgctgatagaagcggtgttgtcagcagctcggctcctcctcctgcagctcctgagaagacctctcgtgcagggtctttctccttcaagtctggacccccaaagctggaacttcagatgggacgcaaatgggtagttgagaatcaggttggtaagaagacccttgctattgatgattgtgattccagacaatccatctatgtgtacggatgcaaggattccgtccttcgagtaaatggcaaggttaacaatatcactgttgacaaatgcactaaatttggaattgttttcaaggatgttgtagcagcttttgaggttgtcaactgcaatggcgttgaggtccaatgtcagggtacagcaccgacaatatcaatcgacaacacatctggatgtcaattatacttgagcaaagattcgctgggagcttcaattacttctgctaaatctagtgaaatcaatgtgatggttcctagtggtgctaccgatggtgattgggtggagcatgctttgcctcagcagtacatccatagtttcaaggatgggcaatttgtcacgtcaccagtttcgcactctggagcgtaaatacaatgattattactgctattgtgtgtgtttgtttgactggcattgccatgtttgaagatgatggtatgctgagatctgtagcagttttggggtctgttgcagcactgtaccggggctgcagtgttcggtgtgtatgttttgtttacacactggtttggtttggtggttccgtttgtttgtttatttgtttatttgtattccagcacacccgttggtgtatgtcttcaactgttcattctttgacacctgatcttaccatatttcaattgatgtggacggttgctccgc

SEQ ID NO: 17670 - protein, 486 aa, Panicum virgatum
  misc_feature: Ceres CLONE 1794252
  misc_feature (324)..(484): Pfam Name: CAP_C Pfam Description: DE   Adenylate cyclase associated (CAP) C terminal
  misc_feature (1)..(314): Pfam Name: CAP_N Pfam Description: Adenylate cyclase associated (CAP) N terminal
MEAALVERLEAAVARLEAAVASGASLASAAPRDLDVPAAADPAIVAYEEFVAEAVGRLTAAAEKIGGKVLDATKLLAEAFAVAKDLLVQAKQLQKPASMADAQDFFKPLSDVIAKATAMTEGRRHDYFNHLKSVADSLPALAWVAFLGKDCGMSFPTAHVEESWQMAEFYNNKVLVEYRNKDPDHVEWAKALKDLYMPGLRDYVKKHYPLGPVWGPAGGAAASQPKVVAPTPKAPAAKAPPPPAPPSAPLFTTEKSPKSSQPKQGMSAVFQEISSKPVTAGLRKVTDDMKTKNRADRSGVVSSSAPPPAAPEKTSRAGSFSFKSGPPKLELQMGRKWVVENQVGKKTLAIDDCDSRQSIYVYGCKDSVLRVNGKVNNITVDKCTKFGIVFKDVVAAFEVVNCNGVEVQCQGTAPTISIDNTSGCQLYLSKDSLGASITSAKSSEINVMVPSGATDGDWVEHALPQQYIHSFKDGQFVTSPVSHSGA

SEQ ID NO: 17671 - DNA, 1569 bp, Panicum virgatum
  misc_feature: Ceres CLONE 1794254
  misc_feature: Encodes the peptide sequence at SEQ ID NO. 17672
aagcaccagaacaatggtcgccacacgtgtgagcacaaattagaaaaaaaacgatcgtgcgtgcaagctaagtgcccacgaggccacgaggagtagcaaaatctaataattccaaggcatggctgctctacgttctttcatcttgctcctcgtgaccgtcctcgcctccatggccgctacagggactgcctcctttgacctccgcgccgagctcaaccacccctacgccggaagcccgctttccaggtacgaaatggtccgcgaggccgccagcacgagcaaggtccggcgcgcttggaccgccgctaggctggccaatgcgtgcggcgggcgcggcggcggcacctccgcaccggacgtgccggtcacgcccgccggcaggtccttctacaccctgaccgtcggcgtcggcactccgccgcagtggcacacgctcgtccacgacacgggcagcgacctcgtctgggttttctgcaagctggtgggcggcggcgccacgccgaccgaccctctctacgacccgggcaagtcgtcctccttcgccgccgtcccctgcgacggcaagctgtgccgggagggcgagttccagtccaagaactgctccaggaaccggtgcctctacacctacgcctacggcagaggccagacctacggcgaactcgcctccgaggtcttcacgttcggcgcgcaccacaaggtcccggccaccctcaacttcgggtgcggggggaggttcttgaaggccgacatcttcaacgcctccggcttcctcgggctcagcccggacaggctctccttcgtgacgcagctgcagataccaaggttctcctactgcctctccccttacaccgaccgtaagagcggtcacatgttcttcggcgccatggccgacctgtccaggtacaggaccacggggccgatacagaccacttcctttctcaacaaccggatcggcagcaacacctactacttcctgcccctgatcggcgtctcggtcgggggcaagaagctcgacgtcccggcgtcgaacttcgccggcacgttcgtcgactccggctacacgaccggcgccctcacggctccagcgctgcgcgccctcgaggaggcgctggtggatgccctgaagctaccgcggaggggctcctccgacccggactacgacttctgcttccagctgccgcgcggcgtgcccatgacggcggtgccggcgccgccgctggtgtaccacttcgagggcggcgccgcgatggtgctgcctcgggagagctacctcgccgagccgagccccggggagatgtgcctggtgatcggggtggattcgcagccggtcatcggcaacttccagcagcagaacatgcacgtgctcttcgacgtgcagaaccagaagttctccttcgcgcccactcagtgtgaccagatctgagtcgtgacctacatgaacatgagcctctgctgctctgcattgggatggagcagagcacagaacgaagagttactatctgctctactatatatagtgtaagttacagtcaaaaaagaaataacgggcttactagtgtcttggatgtt

SEQ ID NO: 17672 - protein, 417 aa, Panicum virgatum
  misc_feature: Ceres CLONE 1794254
  misc_feature (73)..(412): Pfam Name: Asp Pfam Description: Eukaryotic aspartyl protease
  misc_feature: SWISSPROT Homolog: EC 3.4.23.12 Nepenthesin
MAATGTASFDLRAELNHPYAGSPLSRYEMVREAASTSKVRRAWTAARLANACGGRGGGTSAPDVPVTPAGRSFYTLTVGVGTPPQWHTLVHDTGSDLVWVFCKLVGGGATPTDPLYDPGKSSSFAAVPCDGKLCREGEFQSKNCSRNRCLYTYAYGRGQTYGELASEVFTFGAHHKVPATLNFGCGGRFLKADIFNASGFLGLSPDRLSFVTQLQIPRFSYCLSPYTDRKSGHMFFGAMADLSRYRTTGPIQTTSFLNNRIGSNTYYFLPLIGVSVGGKKLDVPASNFAGTFVDSGYTTGALTAPALRALEEALVDALKLPRRGSSDPDYDFCFQLPRGVPMTAVPAPPLVYHFEGGAAMVLPRESYLAEPSPGEMCLVIGVDSQPVIGNFQQQNMHVLFDVQNQKFSFAPTQCDQI

SEQ ID NO: 17673 - DNA, 2392 bp, Panicum virgatum
  misc_feature: Ceres CLONE 1794258
  misc_feature: Encodes the peptide sequence at SEQ ID NO. 17674
aaatgccaaaggaaacaaacaacccgccggatcggtcgggttcggcggccgcatttatccacccacggccgctgcgcgatggtggcgcgcgccagcgtgtggcctccggcggccgaggccagtggcgagcagccgcggcgccatccggagcccggcggctggcgcacctgcgtcactcgctccgcgctgccgcgattccctcgtgacgtcgacgccgccccgggatgggaaggtgaggaggaggagaatatggggggtggagcgggagaggtgaacggcgggcaggcacggtgactctgccgagggttgcgggatggagaacccgttcgacaacccggcgatgaagagaaccagcgactggatcctttcacaggaattcccgagcgatatcaccatccaggttggggaggcgaccttcaacttgcacaagctccggttggcctcgaggtgcggctacatacggaagcaggtgtccgggatcaatggctccaaggtcacccacatcgacatcacgggcatgccaggcggcgcccgggcgttcgagctcgtcaccaagttctgctacggcgagagcctcgagatcacggaggacaacgtcgcgatgctgcggtgcgccgcggagcacctggacatgaccgacgagagcaagggcgtgagcctggtgggcaggacggaggcctacctggaggccgtggcgctgacgagcctcgccggcgcggtcgcggtgctccgcaggtccgaggagctcatcccggtggccgaggaggtggacctcgtcggtcggagcatcgacgccatcgcgcacatcacctgcagcgacagccggttcaccatgtcgctgggcagcacggccggcagctacaacggcgtgaacgtgtggaaggccgccgacgactggtgggccgacgagctgacctcgctgcggattgacacgttccagagagtcctgattgcgatgaaggcgagggggctcaagggcgttgctttgggcacgctgatcatgctctatgcccagaagtctctgcgaagactgaacatgcacgggagggacaagaagaagatggacccgaggcaggagcacgagaagcgggtggtccttgaaacgatcgtgagcctgctgcccaaggagaagaacaccatttccgtgagcttcctgtcgatgctgctgcgagcggcgctccacctggacacgacgctggcctgccggctcgacctcgagaagcggatggccgcgcagctcgggcaggccgtgctcaacgacctcctgatcccgtcctcctcgcccgaggccgacggcaccacgttcgacgtcgacgccgtccagaggatcctggccgggtacctggaacacgagggcgaggcggcccggctggactacagcacggacgatgacttcgtttcgacggcgtcgccgctcaacgacgtcggcatggtcggcaagctcatggtggcctacctggccgagatcgcctcggacgtgaacctgcccgtcgacaagttcaccgacctcgccgagatgatcccggcacgcgccaggtttaacgaggatggcatgtaccgcgccatcgacatctacttgaaggcgcatccgcatctgagcgaggccgagaggaagaaggtgtgcaaggccatggactgccagcggctgtcgcgcgaggcgtgcgcgcacgcggcgcagaacgaccggctgccggtgcagacggtggtgcaggtcctctaccacgagcagcggcgcctgggcgaggcccccgcacacccgcccagccgcgcgtcgtcgttctccggcggcgagtccccggccccgtcgctgccctacaagccgacgcggagcctcatgggacggcacgcccggggcggcgcggcgcaggacgaggtgtcgcagctgcagcgagaaaacgaggagctcaagatcgagctgatgaggctgaggatgcgcctgagggacccgtcggcgctccctccggccggcggcgctccgctgcccgcggggcggcgcccgccgccgaggaagcccggcggcggcgggttcatgaacaacgtgtccaagaagctcgggcggctcaacccgttcatgcggcatgacgccatggatggaggcaaggtgcgcacgaagacgacaaaggatcggaggcactcgatcggctggtgaggtggctcgtcctaatggccgccggctgcttcccatcttggaccatgacggcaatttcgccggaacatgcagtgcgactcacggatcaaatggctttgagttgtgactagatacaggtaagcatgttaacatgtcacggaacatggatttagtgggctgtaaataatgcgttgtactgttcctaaatcttacagtgtaacttctgtgtagaaattttgagctctgctagtacaatggtagcag

SEQ ID NO: 17674 - protein, 611 aa, Panicum virgatum
  misc_feature: Ceres CLONE 1794258
  misc_feature (193)..(450): Pfam Name: NPH3 Pfam Description: NPH3 family
  misc_feature (14)..(120): Pfam Name: BTB Pfam Description: BTB/POZ domain
MENPFDNPAMKRTSDWILSQEFPSDITIQVGEATFNLHKLRLASRCGYIRKQVSGINGSKVTHIDITGMPGGARAFELVTKFCYGESLEITEDNVAMLRCAAEHLDMTDESKGVSLVGRTEAYLEAVALTSLAGAVAVLRRSEELIPVAEEVDLVGRSIDAIAHITCSDSRFTMSLGSTAGSYNGVNVWKAADDWWADELTSLRIDTFQRVLIAMKARGLKGVALGTLIMLYAQKSLRRLNMHGRDKKKMDPRQEHEKRVVLETIVSLLPKEKNTISVSFLSMLLRAALHLDTTLACRLDLEKRMAAQLGQAVLNDLLIPSSSPEADGTTFDVDAVQRILAGYLEHEGEAARLDYSTDDDFVSTASPLNDVGMVGKLMVAYLAEIASDVNLPVDKFTDLAEMIPARARFNEDGMYRAIDIYLKAHPHLSEAERKKVCKAMDCQRLSREACAHAAQNDRLPVQTVVQVLYHEQRRLGEAPAHPPSRASSFSGGESPAPSLPYKPTRSLMGRHARGGAAQDEVSQLQRENEELKIELMRLRMRLRDPSALPPAGGAPLPAGRRPPPRKPGGGGFMNNVSKKLGRLNPFMRHDAMDGGKVRTKTTKDRRHSIGW

SEQ ID NO: 17675 - DNA, 2220 bp, Panicum virgatum
  misc_feature: Ceres CLONE 1794261
  misc_feature: Encodes the peptide sequence at SEQ ID NO. 17676
gatctttttgtattagagaagaaaaaaagaggagggaggggtagagagagagggagaggcattgccgtgacccttctctggccggcaaccgatgggctcggaggcggagatcacgggcccgctcctcgcgggcggcggcggcgcggaggcggagcgggaggcggtgccgccgtggcgggagcaggtgacggcgcgggggctggcggtgagcgcggtcctgggggtgctcttctgcctcatcacgcacaagctcaacctcacggtcgggatcatcccctcgctcaacgtcgccgcggggctgctcggctacttcctcgtccgcacgtggacggcggcgctcgagaggctcgacgtcgtctccaagcccttcaccaagcaggagaacaccgtcatccagacgtgcgtcgtcgcctgctacgggctcgccttcagcggggggtttggaagttatattcttgcgatggatcagaaaacctacgagcttatcgggccagattatcctggtaacagggctgtggatgtcaagaatccttcacttggttggatgattggttttatgttcgtcgttagcttcctcggcctatttagtcttgttgcgctacgcaaggtaatggtaatcgattacaagctgacctatcccagcgggacagccacagccatgttgataaatagcttccacacaaccaccggagctgagcttgcagacaagcaagttaggtgtcttgggaagtatttaagcattagttttttctggaactgctttaaatggttcttcagtggtgttggagattcttgtggttttgataatttcccatctttgggacttgaagcatttaagaatacgttttattttgatttcagtccaacctacattggatgcggtcttatttgtccacatattgttaactgctctacacttcttggtgccatcatatcatggggtttcctttggccatatatatccacaaaagctggggactggtatccagctaaccttggaagcaatgacttcaaaggactctatgggtacaaggtttttatatctgtagctgtgattcttggggatggtctttataatctgatcaagatcatttatgctactacaaaggaaataatgaatgcacgggcaaagcaaggaagacttccacttgtccaggttcaggatgatgatgaagattctaaattatcagctgaggaaaagcatctgaatgaaacattcataaaggacagtattccttcctggctggctggatctggttatgttggtcttgcagcaatatcgactgcaactgtcccaatgatcttcccacagatcaagtggtaccttgtcctctcagcatatgttgttgctcccctactcgctttctgcaattcgtacggtgctgggctaacagactggaatcttgcatccacatatggaaagattggcctttttatttttgcctcatgggttggtcagaatggaggcgtgattgctggcttagctgcctgtggtgttatgatgtccatcgtagccactgcatctgatctcatgcaggacttcaagaccgggtaccttacactctcttcacctaggtccatgtttgtgtcacagttgattgggaccgcccttggctgcgtcattgccccactcaccttttggctttactggtcggcttttgatattggcaatcctgatggttcgttcaaagctccatacgctgtgatcttccgtgagatgtcgattctaggtgttgaaggattatctgcgctgccccaacactgcctagcgatctgctcatttttcttcattgcgtccctagtgatcaatctcctcagggatgtaactccaaagaatgtgtctagattcattccaatcccgatggctatggcaattcccttctacattggtgcatacttcgccattgacatgtttgttgggacggtcatccttttcgtctgggagagggtgaatcgcaaggaatgtgatgattttgctggtgcagttgcctcaggattgatctgtggtgatgggatctggactgttccttctgcgatactgtcgatccttaggatcgacccaccaatctgcatgtacttcaagccatcccttaccagctaaaactagaactagtgatgtcctttatttggatgtcgtaatgggacatccaactgtgtatatatgttccctgtgaattatagtgcgaagaaactgcagttcccttattcaatattcatcgg

SEQ ID NO: 17676 - protein, 669 aa, Panicum virgatum
  misc_feature: Ceres CLONE 1794261
  misc_feature (31)..(651): Pfam Name: OPT Pfam Description: OPT oligopeptide transporter protein
  misc_feature: The sequence is a functional homolog of SEQ ID NO 214 in the 10/412,699 US patent application
  misc_feature: The sequence is a functional homolog of SEQ ID NO 774 in the 10/412,699 US patent application
MGSEAEITGPLLAGGGGAEAEREAVPPWREQVTARGLAVSAVLGVLFCLITHKLNLTVGIIPSLNVAAGLLGYFLVRTWTAALERLDVVSKPFTKQENTVIQTCVVACYGLAFSGGFGSYILAMDQKTYELIGPDYPGNRAVDVKNPSLGWMIGFMFVVSFLGLFSLVALRKVMVIDYKLTYPSGTATAMLINSFHTTTGAELADKQVRCLGKYLSISFFWNCFKWFFSGVGDSCGFDNFPSLGLEAFKNTFYFDFSPTYIGCGLICPHIVNCSTLLGAIISWGFLWPYISTKAGDWYPANLGSNDFKGLYGYKVFISVAVILGDGLYNLIKIIYATTKEIMNARAKQGRLPLVQVQDDDEDSKLSAEEKHLNETFIKDSIPSWLAGSGYVGLAAISTATVPMIFPQIKWYLVLSAYVVAPLLAFCNSYGAGLTDWNLASTYGKIGLFIFASWVGQNGGVIAGLAACGVMMSIVATASDLMQDFKTGYLTLSSPRSMFVSQLIGTALGCVIAPLTFWLYWSAFDIGNPDGSFKAPYAVIFREMSILGVEGLSALPQHCLAICSFFFIASLVINLLRDVTPKNVSRFIPIPMAMAIPFYIGAYFAIDMFVGTVILFVWERVNRKECDDFAGAVASGLICGDGIWTVPSAILSILRIDPPICMYFKPSLTS

SEQ ID NO: 17677 - DNA, 1027 bp, Panicum virgatum
  misc_feature: Ceres CLONE 1794264
  misc_feature: Encodes the peptide sequence at SEQ ID NO. 17678
cttgctgattgattgattgattcctcctcgccttcactccactccacccctcgctcgctcccccgccccggcggggagggcagcggaaaccctagcggcggcccggtaggcgggctacatgcttcgaggaggttcctcgaggaggagggtagggtagaggagttttgccggtgccagccatgggctgcgtcttcggccgcgcggccgcgtcgtcccccgcggcgccgacgaggaagaggagcaaggagagggcgtccccgcagcccacggcggcggccgaggccgggtcgccctccacggccgccgacgggggcgggagaccgcggcggcggctcgggggccgcagggcggcggggccaaggcaggggtgcgtccccgcggccgccgcggcggagcagctcgccgcgggctggccgccatggctcgtcgtcgtcgcgggggaggccctccgcgggtgggccccgcgccgcgccgacaccttcgagaagctcaataagattggatcgggcacgtacagcaacgtgtaccgcgcgagggacaccgtctccggccgcatcgtggctcttaagaaggttcggttcgacaacctcgagccggagagcgtcaagttcatggccagggagatactgatcctgaggaggctcgatcaccccaatgtgatcaaattggagggcttggtcacttccaggatgtcatgtagcctgtaccttgtcttcgagtacatggagcatgaccttgctgggctcgcagcaagccctgatatcaaattcacgttgcctcaggtgtgtgagacttcattcctgttttattaggtggtggggggggggttacttggtggaattatgtggacwygakbyvctccgccascgcawctcytcyayagaaatgtttcrtrcaccgcmctcgtkatacaggggttgagaatgcgctmgaccaccacaacaatgcattgaacctgcatatcaacagggtctaactagctgttcgaaaataaacagatgcttaggattggagacatttggctggc

SEQ ID NO: 17678 - protein, 210 aa, Panicum virgatum
  misc_feature: Ceres CLONE 1794264
  misc_feature: SWISSPROT Homolog: EC 2.7.11.22 Cyclin-dependent kinase
MGCVFGRAAASSPAAPTRKRSKERASPQPTAAAEAGSPSTAADGGGRPRRRLGGRRAAGPRQGCVPAAAAAEQLAAGWPPWLVVVAGEALRGWAPRRADTFEKLNKIGSGTYSNVYRARDTVSGRIVALKKVRFDNLEPESVKFMAREILILRRLDHPNVIKLEGLVTSRMSCSLYLVFEYMEHDLAGLAASPDIKFTLPQVCETSFLFY

SEQ ID NO: 17679 - DNA, 650 bp, Panicum virgatum
  misc_feature: Ceres CLONE 1794264-R
gatgataacccctgccaaagcaaagagcaaaagtgagaagttccctccgccacatcaggatggagcaatgggtaatccgctgggatcctgtcgtcgtatggagcctatgttcgagcaccaggacgcttccttcagtacagtagtccccattgagaaggggacctcacaaacatggtcgggacccttgtttgatccatcggctcttgggcaatcgagacggaagaagcagacaaccctagatgctaaggctgcagcttactcaaagcagctccaaaaagaaaaggcagggatacgagccagataataattaataaagtatatttttggtgagtttgtggggaagaggttcttcatgatagcatatagatgaatgttcttccttgctttgttcctttggcggttggaaagcaggtaacagtgcttttcagtttccactttagggagaattcttccagattgtgtatatgttatgtgttagtgtttcctgttctttttagatgcttctgaatgagatgtgctgtcactaagacaggactagccttgggttttaccacccttgtatttatgctgtttatgacaattcagttgctcatgtgtatatatgtagtaattctttcgcccctttacatatgtaaagggatagtgattgc

SEQ ID NO: 17680 - DNA, 1746 bp, Panicum virgatum
  misc_feature: Ceres CLONE 1794266
  misc_feature: Encodes the peptide sequence at SEQ ID NO. 17681
attttttcaaataagcccattcaatcccaaagcctccaaacaaagtccccgacccaaatccatccccaatccgttcacgcctccacggtctcgtcggcgccgccgcctccctcctctccggcagcccccgccctccgtctccatcactccccacctgaaataaacagatcttcacccaattagtcggcaggggcggcggcggtgcgatggggaagcacgagttcctgacgccgaaggcgatcgcgaaccggatcaaggccaagggtctgcagaagctgcggtggtactgccagatgtgccagaagcagtgccgcgacgagaacgggttcaagtgccactgcatgtcggagtcgcaccagcggcagatgcaggtcttcggcatggcgcccgagcgcgttgtggagggcttctccgaggagttcctcgagacattcctcgccctgatccgccgcgcgcaccgccactcccgcgtcgccgccaccgtcgtctacaacgagtacatcgccgaccggcaccacgtccacatgaactccaccaggtgggccacgctcaccgagttcgtcaagttcctgggacgcgagggctactgcaaggtcgaggacacgcccaaggggtggttcatgacctacatcgaccgtgactcggagcaggccgtcaaggcacgcctcaagcgcaagaggatcaagtcagacatggccgaggacgagcgccaggagcgcatgatcgcccgccagattgagcgtgcacagaagtccctagccaaagccaatgatgtcgatgatggtaatgttgccgagggcgaatctgagtttgagtccgacagtgaagaagagtattcagattcagacgatggtggagagaaacgggagaatggctcaaaagaggccaacaaagcaaccgggaagattgcgattgctcttcagaagtctgcgccagggccgaaggttaatcctttcgaggataagccaaagttgaattttggtttcgatgaagaggactctggtgtccgagagaaggagaaggatgaggtgggaaataaggggaaggatgtgaaagcagcggaggcaagaaggtcggcattggatgagctgatgaaggaggaggagaaggccaaggaaaggagcaacagaaaggactactggctgtgtcctgggattgtggtcaaggtgatgagtaaatcattggcagagaagggttactacaagcagaaaggggtggtcaagaaagttattgataaatatgttggggagattgagatgttggagagcaagcatgttctaagagttgaccaagatgagcttgagactgtgatcccccaaattggtgggctggtgcggattgtgaatggggcttatcgaggttcgaatgccaggttgctctcagtggatacagagaaattctgtgcaaaagtgcaagttgagaaaggcctctatgatgggaagattctcagggccgtcgaatatgaggacatttgcaagatttcctcgtgatatatagtgtttcctggatcattgcagaagcaaacaagaactatgcgatccagggtactggcgctgtcagtcgatgcatccgtgcttgtttttacgtttgctggaatatcttctgttgaaggagttcaatatgtcgatgtttctagttcactgtaactgctgaaaggctgtgtgagaaaatgttatcatttggtttgcttcttactagaccagaataactgcattcaccattttgcaatactcggtcagcttctat

SEQ ID NO: 17681 - protein, 427 aa, Panicum virgatum
  misc_feature: Ceres CLONE 1794266
  misc_feature (372)..(405): Pfam Name: KOW Pfam Description: KOW motif
MGKHEFLTPKAIANRIKAKGLQKLRWYCQMCQKQCRDENGFKCHCMSESHQRQMQVFGMAPERVVEGFSEEFLETFLALIRRAHRHSRVAATVVYNEYIADRHHVHMNSTRWATLTEFVKFLGREGYCKVEDTPKGWFMTYIDRDSEQAVKARLKRKRIKSDMAEDERQERMIARQIERAQKSLAKANDVDDGNVAEGESEFESDSEEEYSDSDDGGEKRENGSKEANKATGKIAIALQKSAPGPKVNPFEDKPKLNFGFDEEDSGVREKEKDEVGNKGKDVKAAEARRSALDELMKEEEKAKERSNRKDYWLCPGIVVKVMSKSLAEKGYYKQKGVVKKVIDKYVGEIEMLESKHVLRVDQDELETVIPQIGGLVRIVNGAYRGSNARLLSVDTEKFCAKVQVEKGLYDGKILRAVEYEDICKISS

SEQ ID NO: 17682 - DNA, 701 bp, Panicum virgatum
  misc_feature: Ceres CLONE 1794274
  misc_feature: Encodes the peptide sequence at SEQ ID NO. 17683
aaagtaaaaaattcgacaagctagctaagccacccccatcatggagatggagctaagtgcagcaacgctcctcttcgtcttccttgtctccttgccaattcttgtgaccttgctgagccgcaaatcaactccgacctccaagaagaggcggcctccaggcccgtggaacctccctttgattggaagcctcctccacttcgccaagtcgcatccgccggccgttcttcgggacctggccaacaagtatggccccgtgatgttcctccggatgggccagatcgacaccgtcgtgatatcctcgccggcggcggccgaggaggttctccgcgagaaggatatcatcttcgcgtcgaggccgagcaccgtggtttcggagttcttctgctaccaaagcctcgatgtcgtcttctcgccatatggtgcttattggcggacactgcgcaagctctgcacggtggagctcctcagcgcaaagatgatgcggcagttcgcacccatcagggatgccgagacgctgtccctcatcagaaatatccaagctgctggccgaggtggtgggccagtccatctcgcgaggcacctcttgtcctgctccaactcgatcgtagcaaaggcggctttcggcgaggtttgcagcagcgagctccgggaccagttcctgtcggccatggctatggcgttaaacttcaccgggggcttca

SEQ ID NO: 17683 - protein, 220 aa, Panicum virgatum
  misc_feature: Ceres CLONE 1794274
  misc_feature: SWISSPROT Homolog: EC 1.14.13.68 4-hydroxyphenylacetaldehyde oxime monooxygenase
MEMELSAATLLFVFLVSLPILVTLLSRKSTPTSKKRRPPGPWNLPLIGSLLHFAKSHPPAVLRDLANKYGPVMFLRMGQIDTVVISSPAAAEEVLREKDIIFASRPSTVVSEFFCYQSLDVVFSPYGAYWRTLRKLCTVELLSAKMMRQFAPIRDAETLSLIRNIQAAGRGGGPVHLARHLLSCSNSIVAKAAFGEVCSSELRDQFLSAMAMALNFTGGF

SEQ ID NO: 17684 - DNA, 681 bp, Panicum virgatum
  misc_feature: Ceres CLONE 1794274-R
  misc_feature: Encodes the peptide sequence at SEQ ID NO. 17685
cccagatgtaatggctaaggcacaggccgaggtgcgacgagtattcgacaacgtgagcccacaagaccatgaggccaagatggacgagctgcactatatcaaaatggtgatcaaagagagcctgaggctgaacccagtggtgccattgctgattccccatctctgtcgggagacttgcaatgtaggtgggttccaagtcacgaagggcaccagggtcatgatcaatgcgtgggccatggcaaggagtcccgagtattggcatgatgctgagaagttcaggccagagaggtttgaggatggcatgcttgactttaaaggctctcggttcgagtacttgccatttggggcagggaggagaaggtgccctggtgataccttcgggttggctgtattggagctcattattgcacgccttctctactacatcgactggagcctcccagtcgggatggagccggaagacattgatatggaaatgatcgttgaagcaacagctaggaggaagaaccaactgcacctagtggcatcaccatataaggtggttcctatgcaatgctgatcgacgtgatagtcaagtatatgcttgatggccagcatctacggttgcccgcgtacctcataaggtacatgtcttgtttggcaaatgggaatgcacaaataaatacaaatataactacgatc

SEQ ID NO: 17685 - protein, 185 aa, Panicum virgatum
  misc_feature: Ceres CLONE 1794274-R
  misc_feature: SWISSPROT Homolog: EC 1.14.13.68 4-hydroxyphenylacetaldehyde oxime monooxygenase
PDVMAKAQAEVRRVFDNVSPQDHEAKMDELHYIKMVIKESLRLNPVVPLLIPHLCRETCNVGGFQVTKGTRVMINAWAMARSPEYWHDAEKFRPERFEDGMLDFKGSRFEYLPFGAGRRRCPGDTFGLAVLELIIARLLYYIDWSLPVGMEPEDIDMEMIVEATARRKNQLHLVASPYKVVPMQC

SEQ ID NO: 17686 - DNA, 2332 bp, Panicum virgatum
  misc_feature: Ceres CLONE 1794276
  misc_feature: Encodes the peptide sequence at SEQ ID NO. 17687
aacaaacaattccgccagcccaatcgtgtcgccgtcatcagttcacgcccaccactcgctgctgcagcccgccccgcccggacccggccgcgaccgagtcgtcgcgagatccagcgccgtcgtcgcgcaaccgccgctgccgccgccgctgctgctgccggagatgccgagcccgacgatccggaggctggacgttgcgtcgccggtgccggcggacatcgacatcgccaattccgtcgagccgctctcgatcgtcgacatcgcggcagagctcggcctcgggcccgagcactacgacctctacggcaagtacaaggccaaggtgttgctgtcggttcttgatgacctcaatgagcagcaggatgggtactacgtcgttgtgggcggcatcacgccgacaccgctcggggagggcaagtccaccactaccgtcggcctgtgccaggctctgggcgcattccttgataaaaaggttgtcacttgtctccgtcaaccatcacaagggcctacctttggaatcaagggaggtgcagctggaggtggctatagccaagttatacccatggatgagttcaaccttcatctgacaggcgatatccatgcaattacagctgcaaacaatctcttggctgctgctattgatacaaggatcttccatgaaaattctcagtcagacaaggcattgttcaacagattatgtccagcaaacaaagaaggcaagaggcgctttgctgacgtaatgctcaaacgtctggcaaagcttggtatttcgaagacagatcccaatgagcttacaccagatgaagttagacgttttgcaaggcttgacattgaccctgagtcaattacatggcgacgggtgatggatgtcaacgatcgtttcctgaggaaaatcactattggacagggccctgaagaaaaaggaatggtgagagaaacaggctttgacatatcagttgctagtgagataatggctgtgttagctcttacaacttcccttgccgacatgagagaaaggcttggaagaatggtgatagggaacagcaagtcaggagagccaattactgctgatgatcttggtgttggaggtgccttaactgtcctaatgaaagatgcaattcatcccaccctcatgcaaactcttgaaggcacaccagttttagttcatgctggaccatttgctaacattgctcatggaaactcatcgatagttgctgataagatagctttaaagctggttggtaagggtggttttgttgtaactgaggcaggttttggtgctgatattggaactgagaagttcatggatataaagtgtagatacagtggattggtgccacagtgcgctattattgtggccacaattagagctcttaaaatgcatggtggggggcccgatgttgtggctggaaagcctctggatcatgcatatgtgagtgaaaatgtagcccttgttgaagctgggtgtgtcaaccttgctaaacatatagcaaacacaaggagttatggagttaatgttgtagtcgcaatcaacaaatttgcatcagatactgaagcagaaatgaacgcagtgcggaatgcatctatggctgctggagcctttgatgctgtcgtctgcacacaccatgcccatggtggtaaaggagcggttgaacttggactcgcagttcaacgagcatgtgaaagccagtcagagcctctgaagtttctgtatcctttggaatctagcataaaggagaagatcgaatccatagctaagttctatggtgctagtggcgtcgaatattctgaacaggctgagaagcagattgagatgtacaccaagcaaggcttctccaacctcccaatctgcatggcgaaaacccagtactcgttctcacatgttccctccatgaagggcgcccctaccggcttcgctctaccaataagggacgtgagggtcagcatcggagctgggttcatctacccgctcgtgggcaccatgagcacaatgcccggccttccaacaaggccctgcttttacgagatcgacgtcgacactgccaccgggaaggtcatgggcctgtcgtaaactgaagctcagctggtgccgtttagagaccggatcgcatttgcgttggagcggaattgtgcagctacagaatttcgtgtcattcctttccttgagacgaataacagtaataagtatgtatccgttcctggcttcctggaaatgcagtgttacttcttgttactgctttattggtaaaccgggatactgtaaatgtgctcgaacccatgctgtttagactctgttcctgtgtaccatactcaaaacatgcatcccatcttt

SEQ ID NO: 17687 - protein, 689 aa, Panicum virgatum
  misc_feature: Ceres CLONE 1794276
  misc_feature (69)..(689): Pfam Name: FTHFS Pfam Description: Formate--tetrahydrofolate ligase
  misc_feature: SWISSPROT Homolog: EC 6.3.4.3 Formate--tetrahydrofolate ligase
TNNSASPIVSPSSVHAHHSLLQPAPPGPGRDRVVARSSAVVAQPPLPPPLLLPEMPSPTIRRLDVASPVPADIDIANSVEPLSIVDIAAELGLGPEHYDLYGKYKAKVLLSVLDDLNEQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHENSQSDKALFNRLCPANKEGKRRFADVMLKRLAKLGISKTDPNELTPDEVRRFARLDIDPESITWRRVMDVNDRFLRKITIGQGPEEKGMVRETGFDISVASEIMAVLALTTSLADMRERLGRMVIGNSKSGEPITADDLGVGGALTVLMKDAIHPTLMQTLEGTPVLVHAGPFANIAHGNSSIVADKIALKLVGKGGFVVTEAGFGADIGTEKFMDIKCRYSGLVPQCAIIVATIRALKMHGGGPDVVAGKPLDHAYVSENVALVEAGCVNLAKHIANTRSYGVNVVVAINKFASDTEAEMNAVRNASMAAGAFDAVVCTHHAHGGKGAVELGLAVQRACESQSEPLKFLYPLESSIKEKIESIAKFYGASGVEYSEQAEKQIEMYTKQGFSNLPICMAKTQYSFSHVPSMKGAPTGFALPIRDVRVSIGAGFIYPLVGTMSTMPGLPTRPCFYEIDVDTATGKVMGLS

SEQ ID NO: 17688 - DNA, 468 bp, Panicum virgatum
  misc_feature: Ceres CLONE 1794290
  misc_feature: Encodes the peptide sequence at SEQ ID NO. 17689
gggagagacttcaattgcatttgctgagagagtaagagatatgatagctgctagagctggtcttaagaaggttccgtgggatggctatctgaaacacaaccgtcctagtcccaaacacactgaagagaaacaacgcatatttgctgactctgtcttgatgagactagagaagaaatgaagagacgtccagctgtacaagtgcacttgattagggctttgccattcagctaccttgtaattcggttggattccagaaacaaaaaaatgcgagtctgggagaccagctcagttttgttgtaaatttgttagtagttcgatagaatttatagtgtgtacttctcagggaaggaatgctcgcatgtgttttggatgttcattcgatggtctgtgttaggggttgacgcctaagcacggtgctctcttgagataccgtgttggtattaatgaattgtgaccgtatcatggttt

SEQ ID NO: 17689 - protein, 58 aa, Panicum virgatum
  misc_feature: Ceres CLONE 1794290
  misc_feature: SWISSPROT Homolog: EC 2.3.1.51 1-acylglycerol-3-phosphate O-acyltransferase
  misc_feature: The sequence is a functional homolog of SEQ ID NO 26 in US patent 7235714
GETSIAFAERVRDMIAARAGLKKVPWDGYLKHNRPSPKHTEEKQRIFADSVLMRLEKK

SEQ ID NO: 17690 - DNA, 2061 bp, Panicum virgatum
  misc_feature: Ceres CLONE 1794302
  misc_feature: Encodes the peptide sequence at SEQ ID NO. 17691
atcgcttcccaggtcgcaaacgactcatcaaatcgcccgcctccctctcttactctcttcccccatccatctcctgccccctccgcagcggcgagatcgaggtcctctatcacggcggtcttcccgtgttgatttcggcaagctcgcacgcgttccccatcccgatggaggctgccgcggtctccatcgacggggagtcggcgggcgagctgctcctccgcgcggcggcgctggtgccgtggacgcgctacgcgctcgcggccctcgccctcgccgcagtgctcctgtaccggttcctggagctccacttcctcggggacctcctccgcggcctccgcggcggccgcgtcgcgctcaccttccaccccgagtctcaggtgtaccaccgggtcgcctccaagtgccgctcgctccacggcaggtacctcgcgacgccgtggctggcgagtcctcatctgcagacgttgttcctgagcatctccggcagaccgccgtcgttcacctatcggaggcagctgtacactgttcgtgatggtggaaccattgccttggattggttgctagcctctgatcttgaagctgcagatgctgattcttgtgatgaatccagtagtaaggatgattcaacgccacttcttgttgtgatacctggattaactagtgattctagtgctgcttatgtcaagcatttggtcttttctatggcaagcaaaggatggaacgttgttgtaagcaatcataggggtctgggtggcatctccataacatctgattgcttctataatgctggatggacggaagatatgcgcgaagttgttaattttcttcatcaggagtatccagaggctccactattcgctgttgggacaagcataggtgccaatattgtggtcaagtaccttggagaagaaggtgaaagcacccctgttgctggtgctgcatctatttgctcaccctgggatctgctggtgaccaacagatttatttcacgcaagcttgtgcagcgatgttatgacagagcccttgcaattggcctcaagggatatgcaaaactacaccaacctgtcttggcacgacttgcaaactgggaagctattacctcgtcaagctctatccgggaatttgaccgtcatgccacttgtgtcgttgcaaaatatgagacagtggacacattctaccgcaagtgcagtagtgcaaactatattggcaatgtgtcagttcccttgctttgtattagtgctttagatgacccactctgcacaagggaggccattccctaggatgaatgcagggcaaacaaaaacattgtattggcaactactcctaatggtggacatcttgctttctttgaaggcctaactgctagaagattatggtgggtacggcctgtttccgagttcctctgtgctctacatgatagctcctatatgcatcggcaaaaggcacaagaacatggtttgcactcttcattggaatcatcaattgacaagagtccatatgtgaatttcatggaagacggaatggtagctgccgtaactaatgaaggtcctgacaacattgactccttggataaccagattgttggtgagattgaactcagtgatggcatggttgccatacaacagaatgaacacaatggagaaatacagaatgagaattacagtgggatgggtgataaaaacaattcagaagggaatgtgacatctgttcaaggccatgaaggaaatcatagacagagagaagggccatatgcaaataatataggtgatgccattgtccctgttaggagatccataaacaagctcacccggtcgcaggggaagtcggtctggttgcttgcttacattgctgttgtaacgtcttggccgttgcttggaaccctaggttttttcctttttagaaaacggtttagcaattctctgttagctaagaagctgaagaaactgtaaacatttcacgtacacagatgtgtttcgtctggaacacgttaaatccttgtagcatccattaatacatgtatgtatacatcaatccatggtaataaagatccagctgagacat

SEQ ID NO: 17691 - protein, 371 aa, Panicum virgatum
  misc_feature: Ceres CLONE 1794302
  misc_feature: SWISSPROT Homolog: EC 2.3.1.84 Alcohol O-acetyltransferase
MEAAAVSIDGESAGELLLRAAALVPWTRYALAALALAAVLLYRFLELHFLGDLLRGLRGGRVALTFHPESQVYHRVASKCRSLHGRYLATPWLASPHLQTLFLSISGRPPSFTYRRQLYTVRDGGTIALDWLLASDLEAADADSCDESSSKDDSTPLLVVIPGLTSDSSAAYVKHLVFSMASKGWNVVVSNHRGLGGISITSDCFYNAGWTEDMREVVNFLHQEYPEAPLFAVGTSIGANIVVKYLGEEGESTPVAGAASICSPWDLLVTNRFISRKLVQRCYDRALAIGLKGYAKLHQPVLARLANWEAITSSSSIREFDRHATCVVAKYETVDTFYRKCSSANYIGNVSVPLLCISALDDPLCTREAIP

SEQ ID NO: 17692 - DNA, 2394 bp, Panicum virgatum
  misc_feature: Ceres CLONE 1794311
  misc_feature: Encodes the peptide sequence at SEQ ID NO. 17693
acaaccaccaccccgaagccgcgtggagccctcgtccagatcggagccagctcgccgggcgatgccgctccggccgcgggagtagcccgtatttgcccgcccaccgacctcacgagcgatggcggaggacggcgaggagaagctgctcgccacggtgcagcacatcgtgcagacgctggggagcagcgacaccatgacggaggacatcctcaaggtcttctccaactacgacggccgcctctcgcttgacaagctctacgccgcgcgcgccgccgctgccgcggccgcgtctggcggcggcggcggaggaggggcggggggaatcggaggggagcactcgatgcccgcgtccccgccgctgcccccgcctcccgcggcggcggccgcggtgtcggccgcgggggcgaggccgccggtgacgtccatggagcgcaccgtgcgcacgctggaccgccagatctcgcagtttgtggccatggaccggctgatttgggcggactcggccgacgcggacgcgttcctggaggcggtcgacgacctcatcggcaccgtgcaggagctcgacgccgcggggaccaatcgcgccctgctcgaccgcgcggacgagctgctcagccggtgcatggcgcggctggaggacgagttccgggcgctcatagagcgccccgacgacgccgcccccgtggtgcccggcgggttcgggtcggatgggagcgacgaggaggacgacttcggcggcggggacggctacggcgacgagccgattccgatcgccaagccggtgacggactacgacgtcgtcatcgacgctctatcgccgggctccatcgccaacgtgcaccagatcgccaagaggatggtggacgccggcttcggccgtgagtgcgccgaggcatacgccgaggcgcgccgcagcttcgtcgacgagagcgttgcgcgcctcggcatccgcccccgcaccgccgaggaggtccatgcctcaccctgggaggagctcgagttcgacatcgctcgctggatcccggccttcaacatggtgttccgcatcctgattcccagcgagcgccgcctctgtgaccgcgttttcgacggcctcgcccccttcggggaccttgccttcattgccgccgtgcgcacccaggcgttgcagctcatatcgttcggcgacgctatctcttcatcaagccgcgctccggagcgcctcttccgcgtcgttgacatgtacgaggctgtgcgtgacatccttcctgaccttgatcctgtgttctccgacccgtactctgctacactccgcgcggaggtctcgacgatgtgcaacacactggggtcctcaatcaaaggtatatttatggaattggaaaacctcatccgccgtgaccctgcccgagttgctgcccctggtggtggcatacaccccatcactcggtatgttatgaactatctccgtgctgcgtgtgggtcgcggcagacattggaagaggtgatggaaggtgacttgggggttaatggaggagcgcctgtggctgttgaccctgaccgccccacctcatcccttgctgtgcacatagcatggatcatggatgttcttcacaagaatttggatacaaagtctaagatttatcgtgatccgtcacttgcttctatcttcttgttgaacaatggcaagtacatcatacagaaggtgaatgacagtgagttaggtgttttacttggtgatgagtggatcaagcagatgacaactagagttcgccgctggagcgtggattatcagcggacaacatggggcaaggttacaactgtgctgcaaactggtagtccaggcattggtggactcccagccaaggcgatgctgcagaaattgcgtatgtttaatacatactttgaggagatctttgcgacacaatcagaatgggtgatagcagatgaacagctaagggtggacattagggcagcagtggaggattcagtgatgccagtttatgcctctttaattgccaagttgaagtcttctcctgaaactgggcgtgatttgtacatcaaatacaccccagaagatgttgtagcccgcatccatcacttgtttgaaggagcagcaaagtgataaattaatcggtaacttgttatgcgacagcttctgctctattatattcgtcaagatgctatcatggattttgggttcgtgcttaatatctggtagtcacgtatgatgatgctgttggctcaacttgcaatgaagctatggagttcagcaaatgtaggtctgtgtgtctgtatcaatcagtagcgtaattatgttgtaacaatattagggctccatttctgtttcaaactctactttaatttaacccattaagtgttatgtgtgaagttcattaagtttgtcctgaaccttcc

SEQ ID NO: 17693 - protein, 660 aa, Panicum virgatum
  misc_feature: Ceres CLONE 1794311
  misc_feature (95)..(656): Pfam Name: Exo70 Pfam Description: Exo70 exocyst complex subunit
MAEDGEEKLLATVQHIVQTLGSSDTMTEDILKVFSNYDGRLSLDKLYAARAAAAAAASGGGGGGGAGGIGGEHSMPASPPLPPPPAAAAAVSAAGARPPVTSMERTVRTLDRQISQFVAMDRLIWADSADADAFLEAVDDLIGTVQELDAAGTNRALLDRADELLSRCMARLEDEFRALIERPDDAAPVVPGGFGSDGSDEEDDFGGGDGYGDEPIPIAKPVTDYDVVIDALSPGSIANVHQIAKRMVDAGFGRECAEAYAEARRSFVDESVARLGIRPRTAEEVHASPWEELEFDIARWIPAFNMVFRILIPSERRLCDRVFDGLAPFGDLAFIAAVRTQALQLISFGDAISSSSRAPERLFRVVDMYEAVRDILPDLDPVFSDPYSATLRAEVSTMCNTLGSSIKGIFMELENLIRRDPARVAAPGGGIHPITRYVMNYLRAACGSRQTLEEVMEGDLGVNGGAPVAVDPDRPTSSLAVHIAWIMDVLHKNLDTKSKIYRDPSLASIFLLNNGKYIIQKVNDSELGVLLGDEWIKQMTTRVRRWSVDYQRTTWGKVTTVLQTGSPGIGGLPAKAMLQKLRMFNTYFEEIFATQSEWVIADEQLRVDIRAAVEDSVMPVYASLIAKLKSSPETGRDLYIKYTPEDVVARIHHLFEGAAK

SEQ ID NO: 17694 - DNA, 2633 bp, Panicum virgatum
  misc_feature: Ceres CLONE 1794318
  misc_feature: Encodes the peptide sequence at SEQ ID NO. 17695
attcccccacacagcaccactgcaacacacacagcatttgcttaattagctaataagcacgaccctatcggtactaatggcggctttgatgatgaagaacaagaagcagatgccggcggtggtggcgttggccgccgccgcaccacagcggcctgctcatgcagccgcagccgccgccgccggcgaagcagtcgtcgttcacgctcgcgcagctgctgaagcgcgtcaacgaggcgcgcagcgacgcgtcgtcgcccacgtcctcgcccacgcactcgcactacaccatcgagctgggcggctccgtgccgggctccaccggcagcgacctgagcgagcacatgcacggcggcggcggcgggggcgggccgctgctgccgttcgtgctcaagttcacggacctcacgtacagcgtcaagcagcggaagaagggctcgtgcctgccgttcgggcgcgcgggcggggagacggccgagcccgaggcgcccaggatgaagacgctgctggacaacatctccggcgaggcgcgggagggcgagatcatggcggtgctcggcgccagcgggtccgggaagagcacgctcatcgacgcgctcgccaaccgcatcgtcaaggagagcctccacggctccgtcacgctcaacggcgagtcgctcgacggcaacctgctcaaggtcatctctgcgtacgtgatgcaggacgacctcctgtacccgatgctcaccgtcgaggagacgctcatgttcgccgccgagttccgcctcccgcggtccctgcccaccaaggagaagcggaagcgagtgcaggcgctcatcgaccagctcggcctgcgcagcgcggccggcaccatcatcggcgacgagggccaccgcggcgtgtcgggcggggagcgccggcgcgtgtccatcggcgtggacatcatccacgacccgatcgtgctgttcctggacgagcccacctccgggctcgactccaccagcgccttcatggtggtcaaggtgctgcagcgcatcgcgcagagcggcagcgtggtggtcatgtccatccaccagccgagctaccgcatcctgggcctgctggaccgcctcctgttcctctcccgcgggcagaccgtgttctacggcccgccgggcgcgctgccgtccttcttcgacgacttcggcaagcccatcccgggcaacgagaacccgacggagttcgcgctcgacctcatccgggagctggagaccatgccggacggggccagggacctcgtggagcacaacaagaagtggcagatgcggcgcgtggcgcccaagacgatgaagcaccacgacgacgggccgtcgccgccgctgtccctcaaggaggccatcagcgccagcatctctcgcgggaagctcgtgtccggcgcgaccgacgggtccgtgtcgtcggcgccggcggccgcggtgtccaagttcgccaacccgttctgggtggagatgggcgtcctgactcggcgcgccttcatcaacacgaagcgcacgccggagatcttcgtcatccgcctggccgccgtgctggtgacggggttcatcctggcgactatcttctggcgcctggacgagtcccccaagggcgtgcaggagcggctgggcttcttcgccatcgccatgtccaccatgttctacacctgctccgacgcgctccccgtgttcctgaacgaacgctacatcttcctccgcgagacggcctacaacgcgtaccggcggtcctcgtacgtgctctcccacaccctcgtcggcttcccgtccctgatcgtgctgtccctggcgttcgcgctcaccaccttcttcgccgtgggccttgccggcggcgccgggggcttcttcttcttcgtggccatcgtgctggcgtccttctgggccgggtccgggttcgcgacgttcctctcgggcgtggtgaccaacgtgatgctggggtaccccgtggtggtgtcgacgctggcctacttcctcctgttcagcggcttcttcatcaaccgcgaccgcatcccgcggtactggatctggttccactacctgtcgctggtcaagtacccgtacgaggcggtgatgcagaacgagttcagcgacccggcgcggtgcttcgtgcgcggcgtgcagatgttcgacaacacgccgctggccgcgctgccggcggcgctcaaggtgcgggtgctgcgcgccatgagccaggcgctgggggtggacatcgggacggccacgtgcatcaccacggggcccgacttcctggcgcagcaggccgtcacggacctcaccaagtgggactgcctctggatcaccgtcgcctgggggttcctcttccggatcctcttctacatctcgctgctgctcgggagcaggaacaagaggaggtgatcatccggccctgcctgctttcgcgggcggctaccttggatttcttcttgggaatttatccccatttcctttctgatcgaccgcatcatctgattagtagtagtatgggacgggagttgtgtatcgcatcgcgtgtaaatttgcttgtaagtttccatggcaagttcaaattgtaattcgaccacatttacttgtgcaatggttcccctttttggggggctttgtgtttcatttggtccgtctggactccgt

SEQ ID NO: 17695 - protein, 740 aa, Panicum virgatum
  misc_feature: Ceres CLONE 1794318
  misc_feature (434)..(644): Pfam Name: ABC2_membrane Pfam Description: ABC-2 type transporter
  misc_feature (126)..(316): Pfam Name: ABC_tran Pfam Description: ABC transporter
  misc_feature: SWISSPROT Homolog: EC 3.6.3.43 Peptide-transporting ATPase
MQPQPPPPAKQSSFTLAQLLKRVNEARSDASSPTSSPTHSHYTIELGGSVPGSTGSDLSEHMHGGGGGGGPLLPFVLKFTDLTYSVKQRKKGSCLPFGRAGGETAEPEAPRMKTLLDNISGEAREGEIMAVLGASGSGKSTLIDALANRIVKESLHGSVTLNGESLDGNLLKVISAYVMQDDLLYPMLTVEETLMFAAEFRLPRSLPTKEKRKRVQALIDQLGLRSAAGTIIGDEGHRGVSGGERRRVSIGVDIIHDPIVLFLDEPTSGLDSTSAFMVVKVLQRIAQSGSVVVMSIHQPSYRILGLLDRLLFLSRGQTVFYGPPGALPSFFDDFGKPIPGNENPTEFALDLIRELETMPDGARDLVEHNKKWQMRRVAPKTMKHHDDGPSPPLSLKEAISASISRGKLVSGATDGSVSSAPAAAVSKFANPFWVEMGVLTRRAFINTKRTPEIFVIRLAAVLVTGFILATIFWRLDESPKGVQERLGFFAIAMSTMFYTCSDALPVFLNERYIFLRETAYNAYRRSSYVLSHTLVGFPSLIVLSLAFALTTFFAVGLAGGAGGFFFFVAIVLASFWAGSGFATFLSGVVTNVMLGYPVVVSTLAYFLLFSGFFINRDRIPRYWIWFHYLSLVKYPYEAVMQNEFSDPARCFVRGVQMFDNTPLAALPAALKVRVLRAMSQALGVDIGTATCITTGPDFLAQQAVTDLTKWDCLWITVAWGFLFRILFYISLLLGSRNKRR

SEQ ID NO: 17696 - DNA, 2895 bp, Panicum virgatum
  misc_feature: Ceres CLONE 1794319
  misc_feature: Encodes the peptide sequence at SEQ ID NO. 17697
ataaatatcctcactgggcggcggctagggtttttagtcctctctcccggcggcgcctccacatctcgtctctcggatcgggaggcgaaaccaagtaacatatatattagtagtgtgatcttcaaaagaagtcaagatggtgaagttcacagcggaagagctccgtgccatcatggacaaaaagaacaacatccgtaatatgtctgttattgctcatgtggaccacggcaagtctacccttacagactcccttgtggcagctgctgggattattgcccaggaagttgctggtgatgtccgcatgactgatactcgcgctgatgaagcagagcgtggtattacaatcaaatccactggtatctctctctactatgagatgactcctgagtcactgaagaattacaaggatgagagagatggcaaccagtatttgatcaaccttatcgactcacctgggcacgtcgatttttcttcggaagtgacagctgcccttcgtatcaccgatggtgctctggtggtggttgactgtattgaaggtgtctgcgtgcaaactgagactgtgctccgtcaggctcttggtgagagaattaggccagtccttactgtgaacaagatggacaggtgcttccttgagcttcaggttgagggtgaggaagcctaccagactttctcccgtgtgattgagaatgccaacgtcattatggcaacatatgaagataagctccttggtgatgtccaagtctacccggagaagggaactgttgctttctctgctggtctgcacggctgggccttcaccctcaccaactttgccaagatgtatgcatctaagtttggagttgatgaaactaagatgatggagaggctctggggtgagaacttctttgacccagccacgaagaagtggaccaccaagaacacaggctcagctacctgcaagagaggatttgttcagttctgctatgagcccatcaagcagatcatcaacacctgcatgaacgaccagaaggataagttgtggccaatgcttcaaaagctcaatgttaccatgaaggctgatgagaaggaattggttggcaaggctttgatgaagcgtgttatgcaaacctggctgccagctagtactgcactgcttgagatgatgatattccaccttccttccccagcaaaggcacagaagtatcgtgtggagaacctgtacgagggaccccttgatgatatctatgctactgccatcaggaactgtgatccggagggtcctctcatgctgtatgtttcaaagatgattccagcttctgacaaagggcggttctttgccttcggtcgtgtcttctccgggaaggttgctaccggtatgaaggttcggatcatgggccccaactatgtgcctggacagaagaaggatctgtacgtgaagagtgtccagcgtactgttatctggatgggaaagaaacaagagtctgttgaggatgttccctgtggtaacaccgttgctatggtgggtctggatcagttcatcacgaagaatgccacactcaccaatgagaaggaagtcgatgcatgcccaatcagagcaatgaagttctcagtgtctcctgttgtgcgtgttgctgttcagtgcaaggttgcctctgacctaccgaagctagttgaaggtttgaaacgtctggccaagtctgatcctatggtcctctgtaccatggaagaatctggtgagcatattattgctggagctggtgagcttcaccttgagatctgcctgaaggatctgcaggaagacttcatgggtggtgctgaaattattgtttcccctcctgttgtctctttccgtgaaactgttcttgagaagtcctgcagaacagtcatgagcaagtctcccaacaagcacaaccgtctttacatggaagcccggccgttggaagagggtcttcctgaggctattgatgagggacgcattggcccacgtgatgatcccaaggtgcgctccaagatcctctcgaaggagtttgggtgggacaaggatctggccaagaagatttggtgctttggacctgagaccacaggcccaaacatggtcgtcgatatgtgtaagggagtacagtatctcaatgaaatcaaggattcggttgtggctggtttccagtgggcctcaaaggagggagcacttgctgaggagaacatgcgtggcatttgctttgaggtctgtgatgttgttcttcatgctgatgccattcacaggggtggtggccaggtcattccaactgccaggagggtcatctatgcttctcagctcactgccaagccaaggctgctggagccagtgtaccttgtggagatccaggctcctgagaatgctcttggtggtatctacggtgttctgaaccagaagagagggcacgtgtttgaggagatgcagaggccgggtaccccgctctacaacatcaaggcttacctccctgtcatcgagtcctttgggttctccagccaactgagggccgcaacctctggtcaggcgttccctcagtgtgtgtttgaccactgggacatgatgggctctgatcctttggaggctggctcccaggctgctcagctggtgttggacatccgcaagaggaagggtctcaaggaacagatgaccccgctttctgagttcgaggacaagctctaaattttttggccttctgtggtactgataccccctgctggtttaatggtccatctgtctactgtaatgggaactactttcgaatttcattttgtttagtggtcatatgcttctgtttccaaacatgattagtcaaatggtagtgtcgtgccgaagactattttggtatccgtcttgatggaacagatgaaacagttggtatctgtgttttaagtggtgatatttgcggc

SEQ ID NO: 17697 - protein, 843 aa, Panicum virgatum
  misc_feature: Ceres CLONE 1794319
  misc_feature (17)..(342): Pfam Name: GTP_EFTU Pfam Description: Elongation factor Tu GTP binding domain
  misc_feature (605)..(722): Pfam Name: EFG_IV Pfam Description: Elongation factor G, domain IV
  misc_feature (724)..(812): Pfam Name: EFG_C Pfam Description: Elongation factor G C-terminus
  misc_feature (391)..(468): Pfam Name: GTP_EFTU_D2 Pfam Description: Elongation factor Tu domain 2
MVKFTAEELRAIMDKKNNIRNMSVIAHVDHGKSTLTDSLVAAAGIIAQEVAGDVRMTDTRADEAERGITIKSTGISLYYEMTPESLKNYKDERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTLTNFAKMYASKFGVDETKMMERLWGENFFDPATKKWTTKNTGSATCKRGFVQFCYEPIKQIINTCMNDQKDKLWPMLQKLNVTMKADEKELVGKALMKRVMQTWLPASTALLEMMIFHLPSPAKAQKYRVENLYEGPLDDIYATAIRNCDPEGPLMLYVSKMIPASDKGRFFAFGRVFSGKVATGMKVRIMGPNYVPGQKKDLYVKSVQRTVIWMGKKQESVEDVPCGNTVAMVGLDQFITKNATLTNEKEVDACPIRAMKFSVSPVVRVAVQCKVASDLPKLVEGLKRLAKSDPMVLCTMEESGEHIIAGAGELHLEICLKDLQEDFMGGAEIIVSPPVVSFRETVLEKSCRTVMSKSPNKHNRLYMEARPLEEGLPEAIDEGRIGPRDDPKVRSKILSKEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 17698 - DNA, 1970 bp, Panicum virgatum
  misc_feature: Ceres CLONE 1794324
  misc_feature: Encodes the peptide sequence at SEQ ID NO. 17699
gaggtagaggcgaggcgaccaacccccaaagccagaacaaaaccaccacctcctctcgcccctgctccgctcgctactcggcaagccaggggaaccggaaccaaccccacacaccgcaggcgagcccacgccgacgcggccgcggctcaagccacccccgatgggctgctgccgctcctcgctgcggacggtgacgctctcggagaagaagccgccggggagggtggcgggggcgctccccccgcaccgcccctccctctcgctgaaccagctccaggcgcgggcgccctccgcggccgccgccggccgcgaggtgccggcggtcaaggagttctcgctggaggagctgcgcgccgccacgggcggcttcgcgccggagaacatcgtctccgagagcggcgagaaggcgccgaatttcgtgtacaagggccgcctcgaggccacccgccgcgcgatcgccgtcaagaagttcaccaagatggcctggcccgatgtcaagcagttcgcggaggaggccaggggggtcggcaagctgcgacactgccgcatggccaacctgatcggctactgctgcgacggggacgagcgcctgctcgtcgccgagttcatgcccaacgacacgctcgccaagcacctcttccactgggaaaaccagacacttgaatgggctatgcgtctaagagttgcatactacatcgctgaagcactggagtattgcagcaatgagggaaggcctctgtatcacgacctaaattcatacagggttctctttgatgagaatggtgatcctcgcctttcatgctttggcctcatgaaaaacagcagggatgggaaaagttatagcacaaatcttgcatacacacctccagaatatttaagaaatggaagagttacatcagaaagtatcatatacagttatggcactatacttctggatctcctcagtggaaagcgtatacctccttctcgtgcttgtgatatgataaaaggcaacaatctccaagtactgatggactcacatttggagggaaactacccaacagaagaagcgaccacaatggttgatctggtctctcagtgcttacggtatgaacctagggatcgccccaacaccaaaaagctggtttctgttcttgagcccatgcaaataaaatcagaggtaccatcctatgagatgcttggcattccaaagcatgaagaggaagcgcctcccactccccctccgcagccacagcaccctctttctgccatgggtgaagcctgttctaggatggatttgacggctatccatcagattctagtgaatacacattacagggatgatgaagggactaatgagctgtcgttccaggaatggacacagcagatgagggacatgttggaagctaggaaacgtggagactttgcttttcgtgataaagatttcaaggcagccatagactgttatacacagtttgttgatgtggggacgatggtatcaccaacagtgttcgcgaggcggagcctgtgccacctcatgtccgaccagcctgatgccgccctccgtgatgcaatgcaggcgcaatgcgtgtaccctgattggcccaccgcattctacatgcaggccgtcgccctctcgaagctgaacatgcagagcgacgccatggacatgctgaatgaggcttcgcagctcgaagagaagcggcagaagaacaccaaaccttgaaagtccagccagctcggcgtcccctcctccggctccaaaggtggttatgttgagacatgctactcactcggtgcttcctaaaagtcgtggttagctcctgttccctgggtttggggatgtaattggatggatggtgtgctgtagagttagtcctgtgatgattgttaatacctggtttagcatttctctgctgcatttttttgggcccgtgtacatcttacattgacaaaggtcgaaacaggcggaatgcaaggggatttacttc

SEQ ID NO: 17699 - protein, 514 aa, Panicum virgatum
  misc_feature: Ceres CLONE 1794324
  misc_feature (87)..(325): Pfam Name: Pkinase Pfam Description: Protein kinase domain
  misc_feature: SWISSPROT Homolog: EC 2.7.11.1 Non-specific serine/threonine protein kinase
MGCCRSSLRTVTLSEKKPPGRVAGALPPHRPSLSLNQLQARAPSAAAAGREVPAVKEFSLEELRAATGGFAPENIVSESGEKAPNFVYKGRLEATRRAIAVKKFTKMAWPDVKQFAEEARGVGKLRHCRMANLIGYCCDGDERLLVAEFMPNDTLAKHLFHWENQTLEWAMRLRVAYYIAEALEYCSNEGRPLYHDLNSYRVLFDENGDPRLSCFGLMKNSRDGKSYSTNLAYTPPEYLRNGRVTSESIIYSYGTILLDLLSGKRIPPSRACDMIKGNNLQVLMDSHLEGNYPTEEATTMVDLVSQCLRYEPRDRPNTKKLVSVLEPMQIKSEVPSYEMLGIPKHEEEAPPTPPPQPQHPLSAMGEACSRMDLTAIHQILVNTHYRDDEGTNELSFQEWTQQMRDMLEARKRGDFAFRDKDFKAAIDCYTQFVDVGTMVSPTVFARRSLCHLMSDQPDAALRDAMQAQCVYPDWPTAFYMQAVALSKLNMQSDAMDMLNEASQLEEKRQKNTKP

SEQ ID NO: 17700 - DNA, 2125 bp, Panicum virgatum
  misc_feature: Ceres CLONE 1794328
  misc_feature: Encodes the peptide sequence at SEQ ID NO. 17701
agactccgattgagctcatggcgatgcggctcctgtccccctccacgccgcccccacacttcccgagccccggcgcgaagccgcccgcctcggcggccacagctttgtcgtcttcgtcgtcgtcgtacttctccctccgcctccggcgcgcgcgcgcggctgcagcggctggcgcggccgcggccgcggcgggcgggcccgagcggggtgagggccgcttcgagggagaggcgatgggcggggcgttcgacaggggcctcgcggagatcgcgaagaaggtgccgctcttcgagccggcgacggacggggagctcgccgccgcggccggcgagcggccgctgcccatcaacctcgagctctggctctaccgcgccaaggtgcacaccaggaaatttgagttccctgaagcagagaagctgctagacaagtgtatctcattctggcctgaagacagacgtccatatgtggcattggggaagctttacagcaagcagtcgaggtatgacaaagctagagcggtgtatgagaggggatgccaggcgacgcaaggcgaaaacccatacatttggcagtgttgggcagtcctagaaagcaaaggtggaaatattcgaagagcacgagagctgtttgatgctgctactgtggctgatgcaaagcacattgctgcttggcatgggtgggcaattttagaaataaagcaaggaaacataaaaaaggcacgaaacctacttgggaaagccctaaaatattgtggaggaaatgaatatatttaccaaactcttgctttgcttgaagctaaagcagagcgctttgaacaagctcagactttgttccaacaagccactcaatccaatccgaaaagttgtgcaagctggcttgcgtgggctcaggttgaaatgcgtgcaggaaacaatacaatggcccgaaagctcttcgagaaagctgtccaggctagtccgaaaaaccggttttcatggcatgtatgggcattattcgaggcaaatgagggtaacattgacaaggcaaggaagttgctcaagattgggcatgctgtaaaccccagggacccagtaattctccagtcacttgcactgctggaatataactattcatcagcaaatgttgctcgtgtgttattcagaaaagcatctcagattgacccaaggcatcagcctgtttggatagcttgggggtggatggagtggaaggaaggaaatgcaagaacagcaagggccctctatcagagagctttgtcagttaattcgacaaatgagtgtgctgctcgttgtcttcaggcttggggagtcctggaacagcgtgctggtaactatatcgctgccagaagacttttgagatcgtccctgagcataaactctcaaagtgaggtgacatggatgacatgggcagcactagaggaggaacagggggatccagttcgagctgaagaaattcggaatctatactttcaacagcgtatcgaagttgtagatgatgcatcctgggtcatgggcttcctcgacatcatcgaccctgccctagacagcgtgaagaagctcctaaacctagaccagccatccatgccggcaaggcaggacactgttaaaagcacagcagatccgagtcctcctaccaccaggagttctgcagctgagtcttcagaaacttcagcgactggaggttcagatacctctggcctttccagcaatgatgctggtaacagaggcagcaaagcagttgaggctccaggaagtgattttgatttggacggtttcatcaaaaagaggctcgccctcgaccctgcagagctggatgcggttcttgaaggttctgatcctaggggagttgtttctcagaggaggaaacggcggctgcccaggaagcctcttcctcttctccctgtcccataacttttccagatcaatttgttctattccaccggtaaaaatcactaatgccaatggcattactgtaagaagagaacgacaccctggccgctgccattagcagtcacctgttaattgttatcgccaccaagtgtacgtagttctgccaccatctgtcctagtagaagtttagccctgtacataaataagactgtgcctacataatttattcagatttgact

SEQ ID NO: 17701 - protein, 629 aa, Panicum virgatum
  misc_feature: Ceres CLONE 1794328
  misc_feature (283)..(316): Pfam Name: TPR_2 Pfam Description: Tetratricopeptide repeat
MAMRLLSPSTPPPHFPSPGAKPPASAATALSSSSSSYFSLRLRRARAAAAAGAAAAAAGGPERGEGRFEGEAMGGAFDRGLAEIAKKVPLFEPATDGELAAAAGERPLPINLELWLYRAKVHTRKFEFPEAEKLLDKCISFWPEDRRPYVALGKLYSKQSRYDKARAVYERGCQATQGENPYIWQCWAVLESKGGNIRRARELFDAATVADAKHIAAWHGWAILEIKQGNIKKARNLLGKALKYCGGNEYIYQTLALLEAKAERFEQAQTLFQQATQSNPKSCASWLAWAQVEMRAGNNTMARKLFEKAVQASPKNRFSWHVWALFEANEGNIDKARKLLKIGHAVNPRDPVILQSLALLEYNYSSANVARVLFRKASQIDPRHQPVWIAWGWMEWKEGNARTARALYQRALSVNSTNECAARCLQAWGVLEQRAGNYIAARRLLRSSLSINSQSEVTWMTWAALEEEQGDPVRAEEIRNLYFQQRIEVVDDASWVMGFLDIIDPALDSVKKLLNLDQPSMPARQDTVKSTADPSPPTTRSSAAESSETSATGGSDTSGLSSNDAGNRGSKAVEAPGSDFDLDGFIKKRLALDPAELDAVLEGSDPRGVVSQRRKRRLPRKPLPLLPVP

SEQ ID NO: 17702 - DNA, 706 bp, Panicum virgatum
  misc_feature: Ceres CLONE 1794334
  misc_feature: Encodes the peptide sequence at SEQ ID NO. 17703
gttcttgtagtgcatggttcccagcaggtcgccacctctcggagagagagagacagagagagagagagagagagagagagagagagagagagggaccaataagcaggagggtctaggcgtctagctagctgagccatggccaaggcacacgtcctggtgctgccgatgccgtgccagggccacgtcacgccgctcatggagctctcccaccgcctggtcgaccacggcatcgaggtcaccttcgtcaacaccgaggtggaccacgcgatggtggtcaccgcgctgcgggcgtccggcggcgaggcggcgctgggcggcggcatccgcctggcgtccatcccggatgggctggccggcgacgaggaccgcaaggacctcaacaagctcatcgacgcctacacgcgccacatgccgggccacctggagcggctcatcgccgacctggaggccgccgggcggcccagggtcaagtggctcgtcggcgacgtcaacatgggctggtccttcgaggtcgccaggaagttcggcatccgggtcgtgtccttctggccggcggccacggcgtgcctcgccatcatgctcaagatccccgagctgatcgaggacggactcatcgacgacaagggcttgccacggcggcaggagatgttccagctcgccccggggatgccggcgctgcacacgtcgcagctgtcgtggaacaacg

SEQ ID NO: 17703 - protein, 190 aa, Panicum virgatum
  misc_feature: Ceres CLONE 1794334
  misc_feature: SWISSPROT Homolog: EC 2.4.1.115 Anthocyanidin 3-O-glucosyltransferase
  misc_feature: Functional homolog of the protein sequence given in SEQ ID NO 50296
  misc_feature: Useful for making plants with altered carbohydrate content
MAKAHVLVLPMPCQGHVTPLMELSHRLVDHGIEVTFVNTEVDHAMVVTALRASGGEAALGGGIRLASIPDGLAGDEDRKDLNKLIDAYTRHMPGHLERLIADLEAAGRPRVKWLVGDVNMGWSFEVARKFGIRVVSFWPAATACLAIMLKIPELIEDGLIDDKGLPRRQEMFQLAPGMPALHTSQLSWNN

SEQ ID NO: 17704 - DNA, 681 bp, Panicum virgatum
  misc_feature: Ceres CLONE 1794334-R
  misc_feature: Encodes the peptide sequence at SEQ ID NO. 17705
tcacccccggcctcagcaaggcgtggctcgccgagttccaccagtgcgtcgccggcagaggcataatcgtcagctggtgctcccagcagcaggtcctggcgcaccgcgcggtggggtgcttcgtatcacactgcgggtggaactcgactatggagggattgcggaacggggtgccgttcctgtgctggccctacttctgcgaccagtacctgaaccgaagctacatcaccggcgtgtggaggaccggcctggcggcgtcccccaacgcggagggggtcgtgaccaaggaggagctgaggagcaaggtggagcaggtcgtcggcgacggcgagatcagggagagggcgcggctgttcagggacgcggctcgccggtgcgtcggcgaaggggggtcctcgcacgagaactttaaaaagcttgtggacctgctacgcgagtgagtagttggcctgggaaccccagcctgatctacagtcctatgatgtgttcctggtgttctattgtgtttgggcagtccccaatttgtgcaagagttcatagaaaacggctgcactatggggttacgaacagatcaattgcattatccgactaattaaccagtgtagctcatgtattcaacctgataagagcagggctaatagattttgcccgctggcggcggagagcagcgccatgtcatcc

SEQ ID NO: 17705 - protein, 145 aa, Panicum virgatum
  misc_feature: Ceres CLONE 1794334-R
  misc_feature: SWISSPROT Homolog: EC 2.4.1.195 N-hydroxythioamide S-beta-glucosyltransferase
  misc_feature: Functional homolog of the protein sequence given in SEQ ID NO 50296
  misc_feature: Useful for making plants with altered carbohydrate content
TPGLSKAWLAEFHQCVAGRGIIVSWCSQQQVLAHRAVGCFVSHCGWNSTMEGLRNGVPFLCWPYFCDQYLNRSYITGVWRTGLAASPNAEGVVTKEELRSKVEQVVGDGEIRERARLFRDAARRCVGEGGSSHENFKKLVDLLRE

SEQ ID NO: 17706 - DNA, 2395 bp, Panicum virgatum
  misc_feature: Ceres CLONE 1794347
  misc_feature: Encodes the peptide sequence at SEQ ID NO. 17707
gttctctcaagcatttgatttcgcagcccaccaattccggtctcttccaactcccaagttccaagtggcgagcgcgagaacggggagaagtggttgtctgaatccactccggcgaggattgaggaggcgggaatgggggaaggagcggatgaggcgttgaaggtggtggatttggaggacgaggagggggaggaggaggctgcagtggcggggtcgagcagggagacgcggatgctgcccaggatgccggtgcgggtgctgctcgccgagggagacgactccacgcgccacgtcatctccgcgctgctccgcaagtgcggctaccgagttgctgcggcctctgatggtgtgaaggcgtgggacatactgcaggaaaaatcattcaacatagaccttgttttaactgaagttgatttgcctttgatgtctggtttcctcctgttatccacaatcatggagcatgatgcgtccaagaacatccccgttataatgatgtcctcgcacgattcagtaagcatggttttcaaatgcatgctcaagggtgcagcagatttccttgtcaagccgataagaaagaatgagttaaggaacttatggcagcacgtttggagaaaacaactggcaaatggtgggcctgatgtgcagcatatacagcacgaagagaatcttgcagaaagaattgaacagaagattgctgtgacaaaagttgataatttgaacaaagatggggcctgtaaagatagagaatgcagtgaacaagaaagtgatgctcaaagttcttgcacaaggtcagagctggaggctgaaagtaagcaaactaacaatattttggagtataagcaaccaactgaaaggcaattctttattcctagccacaagaacggcaagttaagtggacagaccaaacttagaagtaataacttgattccaacaagagaagattatttatcaccaaagaaaagggcatgtttgaatgataatcattttgagaaagcttccagagatattgaggtagtccacattattgacaatcaacagaagcatgacatgcagagggaggtggatactatgagaacaacatctactggaaatgacgagaagggctccattccagcacacctgttggaactatctctcagaagaactgactatggtaaattagagaaccaggagaaaaatgatagaagaatgctgaatcattctacttcgtctgcattctccttgtataactgtaggactgcgtccacattaggaaatgctggcgatggtcagttatgtagcacctcagaaacacaagcggacgtggaaaacaaaaatggagattcggcagccccctctcatgacattactgaaacaaatcgtcctattagagttgtaccatttcctgtccctgttcaaggtctcacatttgatgggcagccattctggaatggtacaccagtggcatccctattctactcacagtccgctcctcccatttggaatagcaaaacatccatgtggcaagaatcaaccccacaagcaaccccagtgcagcagaagtcacaacagaatgagccaaatgaaatgggccctaagccagttcaaagtgcagaggaacaatctcagagaagtcatcctagttccaatgggaagcaactgcgtgttgaaattcctaaagatgaggcacggcatgtttctcctatgactggtgaaagcggaactagcaccgtgcttgacagcgctagaaatactctcagcgtcagcggctgtgacagcaattccaaccggatccctgcccctactgaatcgtccaacacatttcagggtgttcctgaaaccccaagtgctgaaggttcacgtcacctgagccagagagaggctgcactgaacaaattccggctaaagaggaaggataggtgctttgagaagaaggttcggtaccagagcaggaaattactcgcagagcagcggccacgggtcaagggccagtttgttcgtcaagatcatagcatccaaggaagttgaggatgctgccaccactggtgactaccacactgcggatataatgatcgtcagtgtcagattttgctgaagagttggaagcaatcacactgagtactgtttgccttgtaatttgataaagcttgtacgatatatgtatgtataggctaactctgttattttcataggttaggcacaggacctggtacgacttagggtttgtcactaggcgttagaaaatacactggaatgctttgtttcaggtcaaagataagatgtatctcttccgtagcacgtctttgctataaaaccttgtaactaactagtcatcttgtttgatgttccggatagaggttgtgtgaattgtgaaggatgtccagactccagagacatgcccatttctgtgcagttt

SEQ ID NO: 17707 - protein, 624 aa, Panicum virgatum
  misc_feature: Ceres CLONE 1794347
  misc_feature (40)..(156): Pfam Name: Response_reg Pfam Description: Response regulator receiver domain
  misc_feature (575)..(619): Pfam Name: CCT Pfam Description: CCT motif
  misc_feature: SWISSPROT Homolog: EC 3.1.4.17 3',5'-cyclic-nucleotide phosphodiesterase
MGEGADEALKVVDLEDEEGEEEAAVAGSSRETRMLPRMPVRVLLAEGDDSTRHVISALLRKCGYRVAAASDGVKAWDILQEKSFNIDLVLTEVDLPLMSGFLLLSTIMEHDASKNIPVIMMSSHDSVSMVFKCMLKGAADFLVKPIRKNELRNLWQHVWRKQLANGGPDVQHIQHEENLAERIEQKIAVTKVDNLNKDGACKDRECSEQESDAQSSCTRSELEAESKQTNNILEYKQPTERQFFIPSHKNGKLSGQTKLRSNNLIPTREDYLSPKKRACLNDNHFEKASRDIEVVHIIDNQQKHDMQREVDTMRTTSTGNDEKGSIPAHLLELSLRRTDYGKLENQEKNDRRMLNHSTSSAFSLYNCRTASTLGNAGDGQLCSTSETQADVENKNGDSAAPSHDITETNRPIRVVPFPVPVQGLTFDGQPFWNGTPVASLFYSQSAPPIWNSKTSMWQESTPQATPVQQKSQQNEPNEMGPKPVQSAEEQSQRSHPSSNGKQLRVEIPKDEARHVSPMTGESGTSTVLDSARNTLSVSGCDSNSNRIPAPTESSNTFQGVPETPSAEGSRHLSQREAALNKFRLKRKDRCFEKKVRYQSRKLLAEQRPRVKGQFVRQDHSIQGS

SEQ ID NO: 17708 - DNA, 744 bp, Panicum virgatum
  misc_feature: Ceres CLONE 1794357
  misc_feature: Encodes the peptide sequence at SEQ ID NO. 17709
atcgcatctccatcgccagataattccgacacacgaatttcttcagttcctcctcgcgctcctccccttccccgagcaaccaccagcagcagcggcgccatggccaccgcctcctccctcttcctgtcctcgtcccccatctccaccgcgccgcgaacccgcaacggccccgcggcggcctgccctccctccgcccggccgtccctgcgcctccggcagaggccgtccccggccatcgcggccgccgtgcaggccgagcaccagtccgccgtggtcgcggcgccgaagccgcccgcgctcccgttccgcgtcggacacgggtttgacctccaccgcctcgaaccgaacctcccgctcatcatcggcggcatcaacatcccccacgaccgtggctgcgaggcccactccgacggggacgtgctgctgcactgcgtggtggacgcgattctcggcgcgctggggctgccagacatcgggcagatcttcccagactcagacccacggtggaagggtgccgattcttccgtgttcatgagggaagctgtaagtttctcttctttctagtgatgagtgcttgttgaatgcttcatcgtaacgaaatgtagagtttctgtaagcatggtagattcttgagaaaacagttggatagtccctaccaattgatatgaagcgtgtcatatattgattaccagaaacttgctgaataattcgtaaattcacttcatatatcatactgtgttgctc

SEQ ID NO: 17709 - protein, 154 aa, Panicum virgatum
  misc_feature: Ceres CLONE 1794357
  misc_feature (69)..(153): Pfam Name: YgbB Pfam Description: YgbB family
  misc_feature: SWISSPROT Homolog: EC 4.6.1.12 2-C-methyl-D-erythritol 2,4-cyclodiphosphate synthase
MATASSLFLSSSPISTAPRTRNGPAAACPPSARPSLRLRQRPSPAIAAAVQAEHQSAVVAAPKPPALPFRVGHGFDLHRLEPNLPLIIGGINIPHDRGCEAHSDGDVLLHCVVDAILGALGLPDIGQIFPDSDPRWKGADSSVFMREAVSFSSF

SEQ ID NO: 17710 - DNA, 668 bp, Panicum virgatum
  misc_feature: Ceres CLONE 1794357-R
ctacataagccacttgactgttgaaagttagcttagttccaattatttagcttactttgttaacaaatatttagcataacactttattagagcgtgatgttataaaatcagagcatgattgtgtcctcttctcatactagaacttttttatattttatacgttgaagtgctgtagtctgtaatacagaagctgatgaaactgatgcgccatcctgttaacatacttgggttctcatgcaatttcaggtgaaattgatgcatgaagcaggctatgagctgggcaaccttgatgctacactgatcttacaaaaaccaaaactcagtccattcaaggagacaatccgatccaacttgtgtgacctacttggggcagatccatctgtcgtcaatctcaaggccaagacgcacgagaaggttgacagtctaggggaaaacaggagcatagctgcccatactgtagttcttctgatgcggaagtagaaaactggaagagtggaagtagtgaattgtatgattgtatcctattacagggattgaattttagtgtgaacaaaaggctgttacgttatacctgtgtaacctgtccttcagtgatctggtcactatggggaatctccatgtcggtgaaacgataaagctgaatgcaatgagaagttttctgtatttag

SEQ ID NO: 17711 - DNA, 1293 bp, Panicum virgatum
  misc_feature: Ceres CLONE 1794358
  misc_feature: Encodes the peptide sequence at SEQ ID NO. 17712
gtgatctggccccccgagcacggccaaaaaggcgccccgactccaacgccgcgcggcagctcagcctcccccggcgagcgagctcctactcccaccactccgccagcttcgccctcggaaccggctgccagcggaacgggaacgcgccgcgagaaatgctgcaccggtgcgggctgctcccgtgcctccgcggcgactggggcggggcgggccggctcgacccccgcgtcgcggacgagccgggcggcggcggcggggggggggggggccaagcgggtacgcgygggctgagaycgagtccgtgacggggggcttctcgtcccgcgtcatcgggcaggggggcttcagcaccgtctacctcgcctgcctctcctcctcccgcctcggcgccgtcaaggggcagcgcagcagcgagcgcctccaccgcgccttccgccaggagctcgccgtgctcctctcgctccgccacccgcacgtcgtccgcctggtcggctactgcgatgagcgagatgagggcgtcctggtgttcgagtacgccccgaacggcgacctccacgggaggctccacgggcgcggcaagccatcgctcccgtggccgcgccgcatggcgatcgcgttccaggtggccatggcgctggagcacctccacgaggcccgcgacccggccgtgatccacggggacatcaaggccgccaacgtgctgctagacgccagcctcgacgccaagctctgcgacttcggcttcgcgcacgtcggcttctccgccgcgctccagccgccgccggaggccgcggcgccgcccagggcgcccgcgcgccccgtcatgggctccccgggctacgtcgacccgcacttcctccgctccggcgtcgccaccaagaagagcgacgtctacagctacggcgtcctgctgctggagctcctgaccgggcgggaggccacctgcgccgacacggggtgccggctcgccgccgccgtggggcccacgctcggcgaagggaaagtggccgacgtggtggaccggaggctaggagacgagtacgacgcccacgaggccgcgaccgtggcggcgctcgcgctgcgctgcgtcagcgacggccccgggctccggccgtccatggcggaggtcgtgcgcgagctccaggagaagacgacggcgctgatctccgccgccgggagcaaaccggccggcaaggcggcttcatgagctgtacactgcaggctgtaaataccagtagctttgtttagagatgatggtagatggtaaagataatgttttttactcagtttgtc

SEQ ID NO: 17712 - protein, 200 aa, Panicum virgatum
  misc_feature: Ceres CLONE 1794358
  misc_feature: SWISSPROT Homolog: EC 2.7.11.1 Non-specific serine/threonine protein kinase
MAIAFQVAMALEHLHEARDPAVIHGDIKAANVLLDASLDAKLCDFGFAHVGFSAALQPPPEAAAPPRAPARPVMGSPGYVDPHFLRSGVATKKSDVYSYGVLLLELLTGREATCADTGCRLAAAVGPTLGEGKVADVVDRRLGDEYDAHEAATVAALALRCVSDGPGLRPSMAEVVRELQEKTTALISAAGSKPAGKAAS

SEQ ID NO: 17713 - DNA, 714 bp, Panicum virgatum
  misc_feature: Ceres CLONE 1794375
  misc_feature: Encodes the peptide sequence at SEQ ID NO. 17714
gttttcctccgttcttctcactccccgagaggcaacctccggcggccggttgcttcccacgccgcgaatggcgtcccccgcatccgcctcggcgcggcctctatccctaaccctaaccgtccctttcccccgttattcctcgcgcgtcctccccttgcccttctcccgccgcctcccgagccgctgcgtcgcgctagcgccggcgcggcctggcgccgcgctcctctccagcctcagcgacgcgcgggagcaggatgaggaggaggaagaggagttctacgaggagggggatgagcaacaggaatacgacgaggaggaggaggaacaggaatacgacgaggaggacgaggagctggtggaggtgggctacgtgtccggcgcgcacggggtgcgcggcgacgtcctcgtcacgccacgcaccgacttccctgagctccgcttcgccacgccggggacgcgatggctgagggctcgggctgctgggaagcaacacgtcagggaattcgagcttgttcgaggaaaggcccacacggggaagaagtgttggatcgtcagctttgatggcatcgataatctggatgaggctaggcaaatagtcggttcagctatactcgtgaaagctggagataggccagaaattgaggctgatgagttctattcacttgatcttgttggaatgagagttattgtcaagaatacaggcaagcttgtagg

SEQ ID NO: 17714 - protein, 215 aa, Panicum virgatum
  misc_feature: Ceres CLONE 1794375
  misc_feature (98)..(187): Pfam Name: RimM Pfam Description: RimM N-terminal domain
MASPASASARPLSLTLTVPFPRYSSRVLPLPFSRRLPSRCVALAPARPGAALLSSLSDAREQDEEEEEEFYEEGDEQQEYDEEEEEQEYDEEDEELVEVGYVSGAHGVRGDVLVTPRTDFPELRFATPGTRWLRARAAGKQHVREFELVRGKAHTGKKCWIVSFDGIDNLDEARQIVGSAILVKAGDRPEIEADEFYSLDLVGMRVIVKNTGKLV

SEQ ID NO: 17715 - DNA, 701 bp, Panicum virgatum
  misc_feature: Ceres CLONE 1794387
  misc_feature: Encodes the peptide sequence at SEQ ID NO. 17716
tctcgcatcgcaaacactttgccccctcgcgtccgtcgactactcgcgcccccgaccttttgcgcttccgcccccggcgccctcacgaaatccccgaacgcgcggcgccaggagaggagtcgagacccggaccgagacgcgcagcacgcggaaccctcgagggccaggacgcgaaaagggaggacacgcacagccacgcgtctgcggcggcaggccggcggcgaggcgagggctctgctcccggcggcgttcggggcaagggcggaggagccgatcgcgcgcgccattgggggcggccacgcggtgccgtgttgacccccgctccgcgaccggcgcgcgcggttcgtgcggcgcttggcccctccccggggagaggctgctgatttccccttctcgccgtcctcggcgcgatggaggccggctactgcaaccgcaagaagacggacatctgcgagggcgtctgcgacaccgagtatggttcaaagtcagttctgagcatgtcaaggctgaagtgtgcactgcggggatttgatttgagggctctcttgatcctactgattggtattcctattatgatcttcgtcatatacgtacatggacagaaggtcacttacttcctccgcccgatctgggaaaagcctccaaagcccttcacaatacatcctcactactatcatgagaatgtctctatggataccctc

SEQ ID NO: 17716 - protein, 96 aa, Panicum virgatum
  misc_feature: Ceres CLONE 1794387
  misc_feature: Functional homolog of the protein sequence given in SEQ ID NO 50780
  misc_feature: Useful for making plants with altered carbohydrate content
MEAGYCNRKKTDICEGVCDTEYGSKSVLSMSRLKCALRGFDLRALLILLIGIPIMIFVIYVHGQKVTYFLRPIWEKPPKPFTIHPHYYHENVSMDT

SEQ ID NO: 17717 - DNA, 2366 bp, Panicum virgatum
  misc_feature: Ceres CLONE 1794395
  misc_feature: Encodes the peptide sequence at SEQ ID NO. 17718
ataatcgtcgtcgtcttcctcctccttcctgctttgtcgactccgcccaccaacgcataaacccgacctgcccaccccttccttcattcttccttctgctactctgctcttctgacggtccgacccccgtcgttcgaggaaaacccggggaggggaggattgggtgattgcacatgggcggatcgagttccacggggcgggggaagacgaagggctcctccccgctcgccatgacgccggtggaggaggtggacatctccgccgtccggtacaagccgcccacgctgcaggcgccgcacctcaccggcttctcgctcagggccttcgtctggctcatggagtcgcccctcctgggcccactcatcacctccgtcctcaagtcgcagaacaacatgccgcagacgctgcagcagacggtgatccccgagcgccccatgtactacccggagtacccaccgcaggacacggagccaggagttgtgcttgtgggggaagataggcacccagtggaaagagtccacgaagcactgcagtacctcccgtcgtatgatccgtcaatgcgttgggcgaccgaggagaagctccctttcctttactggaagatccgtgacttcgcacatgcataccgctcagggatcactactccatcagttgttgctgagcatgtcattgcgggggtggaagagtggaacaacaagaagcctccaatgccaatgttaatctattttaatgcagatgatctcagaaggcaagctgaggcatccacaaaaagatttgagcaaggaaacccggtgtccattttggatgggatctttgttgccattaaggatgacattgactgtttcccttatccaacgaagagcgctacaacattttttgaccaaatccacactgtggagaaagatgcagtctgcgttgctcggttacgaaaatgtggagtcatctttatcgggaaagcaaacatgcacgagcttggtcttggtgtaacaggaaacaatccaaattatgggacagcaaggaatccacattccgtcgatagatatactggtggttcttcatctggtcctgctgcattagtctcatcggggttatgctcagtagcaattggaacggatggtggaggttcagttagaattccatccgcactttgtggtattgttggtttcaagacaacatatgggcggactgatatgactggggtactttgtgactctgggactgttgaagttgcttctcctcttgcatcatcagtcgaggatgctatgctagtgtattttgcaatagcaggctcaagacccatggataagcttacccttagaccatcaccgctgtgtgtcccaaatttgttatcccctgacaacagcaatatcctgggatcagttaaaatagggaaatatacagagtggtttcatgatgtttctgaccgtgagatatcaagtacatgtgaagatgcacttaaacttctttgtaacacttttggatgtcaaatagaagagataatattaccagagcttgaagagatgcgtactgcccatgttgtctcaattggctcagaatcgttctctgacctgaatcctcattacaaagcaggaaggagaacagaatttacgctggatactcgaacaagtttggcactttttgggtcattctcctcaactgattatgtggcttctcaatgcataaggaggaggataatgcactatcacatggaagctttcacgaaggttgatttcatagcaactcctacaactggcatgacggcaccaaaaataccaccaagtgctctgaagtctggagaatctgattacgttgtgtcagcttacctgatgcgattcatcatagctgggaaccttctcggtctaccagcaataactgtgcctgttggtcatgacaagcagggccttcctataggtttgcaactgataggtcggccatggggtgaggctagcttactgcgggtggcttctgcagtggaggagctgtgcctgaagaaacggaaccgaccctccacattttatgacattttgaagtcctgaaatgccatcatatataattcctctgttcgtgacggcgtgggtggtgaggtgtcgctgatcgtgactgagaagagtgttaccacctcgagttgtctgtaatcagcacgatggggacggccgcagcctgcagaccattcctgcacaatgtgtaataagtctgatgtagaaagaaatcaatttgtaattgtgacatatcgacatggatgtgcacaaggtgtgtgagaaacagtgtgaatgctgtgctgtctgctgatgtccgtccctttttctgcaagctactcttgaatctccatcctctatcatatcgccaaggaggggcattttcgggac

SEQ ID NO: 17718 - protein, 601 aa, Panicum virgatum
  misc_feature: Ceres CLONE 1794395
  misc_feature (141)..(575): Pfam Name: Amidase Pfam Description: Amidase
  misc_feature: SWISSPROT Homolog: EC 3.5.1.4 Amidase
MTPVEEVDISAVRYKPPTLQAPHLTGFSLRAFVWLMESPLLGPLITSVLKSQNNMPQTLQQTVIPERPMYYPEYPPQDTEPGVVLVGEDRHPVERVHEALQYLPSYDPSMRWATEEKLPFLYWKIRDFAHAYRSGITTPSVVAEHVIAGVEEWNNKKPPMPMLIYFNADDLRRQAEASTKRFEQGNPVSILDGIFVAIKDDIDCFPYPTKSATTFFDQIHTVEKDAVCVARLRKCGVIFIGKANMHELGLGVTGNNPNYGTARNPHSVDRYTGGSSSGPAALVSSGLCSVAIGTDGGGSVRIPSALCGIVGFKTTYGRTDMTGVLCDSGTVEVASPLASSVEDAMLVYFAIAGSRPMDKLTLRPSPLCVPNLLSPDNSNILGSVKIGKYTEWFHDVSDREISSTCEDALKLLCNTFGCQIEEIILPELEEMRTAHVVSIGSESFSDLNPHYKAGRRTEFTLDTRTSLALFGSFSSTDYVASQCIRRRIMHYHMEAFTKVDFIATPTTGMTAPKIPPSALKSGESDYVVSAYLMRFIIAGNLLGLPAITVPVGHDKQGLPIGLQLIGRPWGEASLLRVASAVEELCLKKRNRPSTFYDILKS

SEQ ID NO: 17719 - DNA, 180 bp, Panicum virgatum
  misc_feature: Ceres CLONE 1794395-R
ttaaaggcttgtggtgaaaaaaaacatttttttgtttgtggtgggtagctcggggggtcccggagggggggtagaacccagtgtatttctgttgttttttttggggtttccccccttttttttacctctttttgtatttttcctcccttttttttttgccggtggggggggtttttgggg

SEQ ID NO: 17720 - DNA, 1516 bp, Panicum virgatum
  misc_feature: Ceres CLONE 1794422
  misc_feature: Encodes the peptide sequence at SEQ ID NO. 17721
cctcctgttcatttctctcctccaccccctccccctccccctcctcgccgctcgccgctgaagagggaggttccctggtgcgtgcgggatggaggcggcgacgatggcgtggacggcggcggtcgtcggggtcgggctggtgtactggttcgtctgggttatgggcgcggcggaggtgaagggcaagcgggcggtggatctcaagatgggatccatcacgcgggacaaggtgcaggacaagtacacgcagtactggtccttcttccgccgccccaaggagacggctaccaccgccgccgcggcggagaaggtgcccgacttcgtcgacaccttctacaacctcgtcaccgacatctacgagtggggctggggccagtccttccacttctccccctccctccccggccgctcccaccgcgaggccacgcgcgtccacgaggagcgcgtcgtcgacctcctcggcgccaagcagggccaccgcctcctcgacgtcggctgcggcgtcggcgggcccatgcgcgccatcgccgggtactcgggatccaacgtcgtcggcatcaccatcaacgactaccaggtgaaccgcgcccgcgcccacaaccgcaaggccggcctcgactcccgctgcgaggtcgtctgcggcaacttcctctccatgcccttcccggacgcctccttcgacggcgcctactccatcgaggccacctgccacgcgcccaggctgcaggacgtctacggcgaggtgttccgcgtgctcaagcccggcggcctctacgtctcctacgagtgggtcaccacctcgctgtaccgcgccgaggacccggaccacgtcgactgcatccaaggcatcgagcgcggcgacgcgctcccggggctgcgccgccaggacgagatcgcgtccatcgccaaggaggtcggcttcgaggtgctcaaggagcaggacctcgccctgccccccgcgctgccctggtggacgcgcctcaagatggggcgcatcgcatactggcgcaactccctcctcgtccgcgtgctcaccatgctccggatcgctcccaagggcgtgtccgaggtgcacgagatgcttttcgagaccgcgcagcacctcaccaaaggcggcgagaccggcatcttcacgcccatgcacatggtgctcctccgcaagcccgccgccgccaccgaggcggcgaaatagtgcaagactaggacacacttgcccaccgcaaggggaagtagaagaaataatctggcaggaacagcagaggtaagaagagcaggccactcggagagcttcaggaatcaaatttgatctcttagagaagatactaggaaggaaccatgcttgttgttactcttttcttgttcgtatcgtagatttcagtttaattattttggtggaggattatccggttgaagagagggagaggttgttgggatttaaatttgttttctcgcttgcttgatcggtggatccatctatgtctatctatctatctatcatcagccatgttttgtctgc

SEQ ID NO: 17721 - protein, 367 aa, Panicum virgatum
  misc_feature: Ceres CLONE 1794422
  misc_feature (240)..(359): Pfam Name: Sterol_MT_C Pfam Description: Sterol methyltransferase C-terminal
  misc_feature (133)..(231): Pfam Name: Methyltransf_11 Pfam Description: Methyltransferase domain
  misc_feature: SWISSPROT Homolog: EC 2.1.1.143 24-methylenesterol C-methyltransferase
MEAATMAWTAAVVGVGLVYWFVWVMGAAEVKGKRAVDLKMGSITRDKVQDKYTQYWSFFRRPKETATTAAAAEKVPDFVDTFYNLVTDIYEWGWGQSFHFSPSLPGRSHREATRVHEERVVDLLGAKQGHRLLDVGCGVGGPMRAIAGYSGSNVVGITINDYQVNRARAHNRKAGLDSRCEVVCGNFLSMPFPDASFDGAYSIEATCHAPRLQDVYGEVFRVLKPGGLYVSYEWVTTSLYRAEDPDHVDCIQGIERGDALPGLRRQDEIASIAKEVGFEVLKEQDLALPPALPWWTRLKMGRIAYWRNSLLVRVLTMLRIAPKGVSEVHEMLFETAQHLTKGGETGIFTPMHMVLLRKPAAATEAAK

SEQ ID NO: 17722 - DNA, 1752 bp, Panicum virgatum
  misc_feature: Ceres CLONE 1794428
  misc_feature: Encodes the peptide sequence at SEQ ID NO. 17723
aatctcgcacggactccccctcctccctcctcgcaagagccaccgcggcgccgcgcgcctgcagccgcgatctaccgcccggcgagacgagagcgcccccgcgcccccagggaatgcggagcgatgaggcggcgctcaggcactgacgtcgccggtcagcgcaagcttcgcggcggccgcacctgccaccgcaagcacgtcgaggacgggtagacgcccgcccccaatcccatccttcccgctgctagtcgtcgtagggtagagttttctctcagtttggattggatcggaaggaggaggagtagggggatcatcgatcgatcgatcgagcatcatgggggacggtcacggtgacggggaggtgaaggccggcggggtgctgcaggggcgctacgagctcggccgcgtcctggggcacggcaacttcgggcgcgtccacgcggcgcgggacctgcgcacgggccggagcgtggcggtgaaggtgctgtccaaggaccgggtggtgcgcgcggggatgatggagcagatcaagcgcgagatcgccgtcatgaagcgggtgtcccaccccaacatcgtcgagcttcacgaggtgatggccacgcgctccaggatctacctggcgctcgagctcgtccgcggcggggagctcttcgcgcggatcgtgcgcgccggccgggtcagggaggacgtcgcgcgccgctacttccgccagctcatctccgccgtcggcttctgccacgcgcgcggcgtgttccaccgtgacctcaagccggagaacctgctcatcgacgacgcgggaaacctcaaggtggtcgacttcggcctcagcgcgctcgccgaccacgcccgcagcgacgggctgctgcacacgctctgcggcacgcccgggtacgtcgcgccggaggtgttccggaacaaggggtacgacggcgccaaggccgacatctggtcgtgcggggtcatcctctacgtgctcctcgccggctcgctcccgttcccggaggacaacatcgccgccatgttcaagaagatgagccgcggggactaccgctgcccgccgtggctatccacggaggcgcgcgggctcatccccaggctgctcgaccccaacccggacacacgcatcaccgtcgcccagatcgtcgagacgccgtggttcaagaagccgtccgtcgcgaggcccgtcaacgccgccaccgagccgccggccgagcctgcctgcgccgccaaggacggcggcgacaaggacgagccgccggagacactgaacgcgttccacctgatctccctgtccgcggggttcgacctctcgcctctgttcgacgtcgaggggggctccgcgaggggccaccgggacggcggcttgcggttcgcgacgcgggagtcggcgagcggcgtcatctcccggctcgaggaggtggccgcccgcggcgggggccggatgcgggtgaccaagagcggcgcccgcggcgtacggttcgagggcgcggagcgcggggggcccaagggccgcctcgccgtggccgccgacatcttcagcgtggcgccgtccgtgctcgttgtcgacgtgaagaaggacggcggcgacacgctcgagtaccggtccttctgcagcgacgagctccggccggcgctccaggacatcgtctgggccgccgacccggcacccgccgccgcgtatggctctgtatcgtagtgccattgttgtttgggttaaactattttgaaatttgccattacaatttttcatcc

SEQ ID NO: 17723 - protein, 453 aa, Panicum virgatum
  misc_feature: Ceres CLONE 1794428
  misc_feature (20)..(275): Pfam Name: Pkinase Pfam Description: Protein kinase domain
  misc_feature (307)..(374): Pfam Name: NAF Pfam Description: NAF domain
  misc_feature: SWISSPROT Homolog: EC 2.7.11.1 Non-specific serine/threonine protein kinase
MGDGHGDGEVKAGGVLQGRYELGRVLGHGNFGRVHAARDLRTGRSVAVKVLSKDRVVRAGMMEQIKREIAVMKRVSHPNIVELHEVMATRSRIYLALELVRGGELFARIVRAGRVREDVARRYFRQLISAVGFCHARGVFHRDLKPENLLIDDAGNLKVVDFGLSALADHARSDGLLHTLCGTPGYVAPEVFRNKGYDGAKADIWSCGVILYVLLAGSLPFPEDNIAAMFKKMSRGDYRCPPWLSTEARGLIPRLLDPNPDTRITVAQIVETPWFKKPSVARPVNAATEPPAEPACAAKDGGDKDEPPETLNAFHLISLSAGFDLSPLFDVEGGSARGHRDGGLRFATRESASGVISRLEEVAARGGGRMRVTKSGARGVRFEGAERGGPKGRLAVAADIFSVAPSVLVVDVKKDGGDTLEYRSFCSDELRPALQDIVWAADPAPAAAYGSVS

SEQ ID NO: 17724 - DNA, 2139 bp, Panicum virgatum
  misc_feature: Ceres CLONE 1794431
  misc_feature: Encodes the peptide sequence at SEQ ID NO. 17725
attcccaacggccgtgggggaacgcgacggcgaggaaagcaaagctccccgccccgccccgccccggccaggcacagcccccatccatttctgaggaaggattaccacctcccctccgttcccctcgcgtcgcgtcgcgcgattcgattcggttcctttcctccgctccgttccgttcgtcgccgctgcggctgcgccccggaccggaccccagcgacgcccccaaaggctgcggccgtcgcagtcccatcgattccgcccgcccgctttcccacccctcgaagccgaatccgatggttccacccgttgaccgcctccgccctcggaggccgcgccgcctcctccccgccctcctcggcccgcgcgcccccgccctatagatagacacccgccgcccactccccgatggcggtcgccggcgacgacgacgacagcatggatcgggacttcgccgccaggctgcgcctggcgcattcgccctccccggccccgcctgccgccgcggccgcttcctcctcccccaccgccacaggggggatcgccttccgcgcgccgcaggagcagttcaccgccgccgacttcgagctcggcaagatctacggcgtcggctcctactcaaaggtggtgcgggccaagaagaaggacgcgggcaacgtctacgcgctcaaggtcatggacaaaaagttcatcaccaaggagaacaaaatctcctacgtcaagatggagcgcattgtgctcgaccagctcgatcatccgggtgtcataaggctgttcttcaccttccaggactcatactccctctacatggcgctcgagtcgtgcgaaggcggggaattgtttgatcagattgttcggaaaggccggctgtctgaggaggaggcacagttttatgccgctgaaattgttgatatattggagtatttgcatagcgttggtctaattcatcgggatctcaagccagaaaatttactgcttacttctgatgggcacatcaagatagctgattttggtagtgtcaagcctacaagggatactccaatcaaagtcctgccaaattcaactaatgaaagggcctgcacatttgttggaacagctgcatatgtaccacctgaggtcctgaactctgccccagcaacctttggaaatgacttatgggcgttggggtgcacactgtaccaaatgctttctggctcttcaccgtttaaagatgccactgagtggttaattttccagagaatcattgcaagggacatcaaattccctgagtatttttcagatgaagcaaaagatcttattgacaagttgctggatgttgatccaagcaaaaggccaggtgcggggcccgatggttattcttccttgaagaagcaccctttcttcagaggcattgactggaaaaacctgaggaagacacgaccaccaaagctcgccattgacccaaatgcaaacgaagatgaggacagccaggattcaaattggctatcacacatgggaagtaccacagttaaccaacagtcaaacactgttaataataatggtgctgcgtcatctgaagtacgctcccatatatctaaattagcttccatcgactccttcgactcaaaatggcaagaattcctggaccctggtgagtctgtagtcttgatatcaaagctgaagaagattaataagctagcaaacaagaaggtccagctgatcctcactgataaacctcaattgatctatgttgacccgtcaaaaatggtggccaaggggaacattatttggtctgatgacccaagtgaacttagtgttcaagtaacaaattcatcacattttagaatatgcacgccaaagaaaatttcaacatttgaggactcaaaacagcgtgcctggcagtggaaaaaggcaattgaagacctccaacgctgccagaagtattgattttcaattcaaactaggttcctgaaacctcaaatcaggcaatatgaatacagtacaacatccttttcacttagaggaacatggaggagcttgttttcctgctgtcctgctcatgtgcctggttgcaaggaagttactcgctaattggcatgttgacgatgcccctatgaattttccatttctattgacacttaaatatagggcacaattttgttt

SEQ ID NO: 17725 - protein, 505 aa, Panicum virgatum
  misc_feature: Ceres CLONE 1794431
  misc_feature (59)..(325): Pfam Name: Pkinase Pfam Description: Protein kinase domain
  misc_feature: SWISSPROT Homolog: EC 2.7.11.1 Non-specific serine/threonine protein kinase
MAVAGDDDDSMDRDFAARLRLAHSPSPAPPAAAAASSSPTATGGIAFRAPQEQFTAADFELGKIYGVGSYSKVVRAKKKDAGNVYALKVMDKKFITKENKISYVKMERIVLDQLDHPGVIRLFFTFQDSYSLYMALESCEGGELFDQIVRKGRLSEEEAQFYAAEIVDILEYLHSVGLIHRDLKPENLLLTSDGHIKIADFGSVKPTRDTPIKVLPNSTNERACTFVGTAAYVPPEVLNSAPATFGNDLWALGCTLYQMLSGSSPFKDATEWLIFQRIIARDIKFPEYFSDEAKDLIDKLLDVDPSKRPGAGPDGYSSLKKHPFFRGIDWKNLRKTRPPKLAIDPNANEDEDSQDSNWLSHMGSTTVNQQSNTVNNNGAASSEVRSHISKLASIDSFDSKWQEFLDPGESVVLISKLKKINKLANKKVQLILTDKPQLIYVDPSKMVAKGNIIWSDDPSELSVQVTNSSHFRICTPKKISTFEDSKQRAWQWKKAIEDLQRCQKY

SEQ ID NO: 17726 - DNA, 1112 bp, Panicum virgatum
  misc_feature: Ceres CLONE 1794433
  misc_feature: Encodes the peptide sequence at SEQ ID NO. 17727
aagaggggaaagtggcgcttgcttcatatcgtcctcgtctgcgatctccttccatccagccgtctcgggcagccacgagatcgcgagcggcgtagatctgcgcgtcaggggatgaagattaccgcgcttctggtgctgaagccgtcgacctccggcgccgggagctcctcgtcaggcggcgggtcggacccggaggcggtggtgctcgcgaacgcgacggacgtgagccacttcggctacttccagcgcggcgccgcccgcgagttcatcgtcttcgtcgcccgaaccgtcgcgcagcgcacctagcctggccagcgtcagtccgtccagcacgaagaatataaggtccattcacacaacagaaatggtctttgtgcggtggcattcatggacgatcactatcctgtacggagtgcattttctcttctgaataaggttcttgatgagtaccagaaggattttggggactcctggaaatctgctactgcagatggaactcaacagtggcctttcctcacggatgctttgacaaaatttcaggaccctgcagaagctgacaaattaatgaaaatccagagggacttggatgaaacaaaaatcatcctacataaaactattgagagtgtccttgccaggggagagagactggatagcttggttgagaaaagctctgacctgagcgctgcttcacagatgttctacaagcaggcaaagaagacaaaccagtgttgcactatactttaaactccgccgcatgtatcgttgttgcaaagtgccagagacaaaaagatctatattgtatgaatttactgtgagttaaattacccatggagcgtggttacaaggcccgaagtcgatgctggtggattgatgttaggcagacagcggtttctttccttgaatatgtggaattgagttttttccatgtgaaaatcgctgtgttacgatcaagctctgtaccgtcattctttggtgattatgcaaccttgtagcgcccactaacatcatttattgtactataaggcttaccgcaaactacagaaatcaccgacatctttgtttcccctgcatagattgttgaattctcattaggtgtcctgttcccagcccat

SEQ ID NO: 17727 - protein, 118 aa, Panicum virgatum
  misc_feature: Ceres CLONE 1794433
  misc_feature (22)..(108): Pfam Name: Synaptobrevin Pfam Description: Synaptobrevin
MDDHYPVRSAFSLLNKVLDEYQKDFGDSWKSATADGTQQWPFLTDALTKFQDPAEADKLMKIQRDLDETKIILHKTIESVLARGERLDSLVEKSSDLSAASQMFYKQAKKTNQCCTIL

SEQ ID NO: 17728 - DNA, 1236 bp, Panicum virgatum
  misc_feature: Ceres CLONE 1794443
  misc_feature: Encodes the peptide sequence at SEQ ID NO. 17729
aaactgacccagtctgtcacaccagcagtaacagcccactccgtgctctcgcggacacagtggaagcaggcaagcagccgccgccgccaccgccagcagagcgaggcggggagcagagcataccggtgaggcgagcgaccggtgtcttaagcgaaggcaagcgcggctgatctgatccctccttccctcgcgctgcagtcgacagggggcatcgatccgttgctcgttcgttaatcattacccctgtgctcttcagaatcctagtctctgctgctctggttcttcctagcccggttccttgatcccggtttcggttgggtctgcgcgcagagggaacgggccaacggggccgcggcggccatggaggaagcggggaggggggcggtctgcggcttgctcaaggtcgttgtggcgcgcggccgcagcctcgccgtcagggacttcacctccagcgacccgtacgtcatcgtccgcgtcgccgacacaactacaaagacaaaagtcatcaacagttgcctaaatccagtttggaatgaagagatgacattctccatgaaagaaccagtaggagtcatcaaatttgaggtgtttgactgggaccggttcaagtatgatgacaagatggggcacgccttcctggacctgcagcctgtggcagcagcgacaaagctgcggcgagcgctgcggctcacggcaggagagaccaaactccggaaggtagcccccgacgtcgacaactgcctgctctctgacagcttcgtgatctacgccaacggggaggtcgcgctagacacctgtctgcgactgcgtgacgtcgagtctggtgagctgttcatcacggtcaagtggattgaagctgaaaacacaaaatgatcacaacccaggagaccattagcggtacattttacttgcaacaatagatgaggtgacgtggtgtagaggtagttctttgttgtgcccttacctgatttatcagtggtatttcttctttccttgtgtgtccactgtctgacctgaatgtaaattttccacggttctttttttttgtgaggaaaaaaagattgatcattaagcttaattaggtctcgttacaatctaagagcacaacatgttgtatacaactaggaatttctgttaaccgaaccccagagctgaaagctcgtctagcatgttgtgccaattcatgcgcaactatatttagctctattgatattgaccagatgaacatttcccagc

SEQ ID NO: 17729 - protein, 170 aa, Panicum virgatum
  misc_feature: Ceres CLONE 1794443
  misc_feature (13)..(92): Pfam Name: C2 Pfam Description: C2 domain
  misc_feature: SWISSPROT Homolog: EC 2.7.11.13 Protein kinase C
MEEAGRGAVCGLLKVVVARGRSLAVRDFTSSDPYVIVRVADTTTKTKVINSCLNPVWNEEMTFSMKEPVGVIKFEVFDWDRFKYDDKMGHAFLDLQPVAAATKLRRALRLTAGETKLRKVAPDVDNCLLSDSFVIYANGEVALDTCLRLRDVESGELFITVKWIEAENTK

SEQ ID NO: 17730 - DNA, 1560 bp, Panicum virgatum
  misc_feature: Ceres CLONE 1794448
  misc_feature: Encodes the peptide sequence at SEQ ID NO. 17731
accgcggaagcacgaggcagcatatgtcacggaggaccagcgtcccacgctcctcccgcgtagcctccgcgccctccattcctacctcccggcgagacgtgccccagccagctcctattgccagcagtagaagaagctagctaaatctcgcgtttttccttttccttttcgtttcgtttcggggtctgctctcgagcttcctggagcagcttccgtttttggttcccggcatcctttggtctcggatccatcctccccgataaaaagcgaggcggagcggcgaggaagaaaagcgagggagcgagcaatgggggtcaagggattcgtcgagggcgggatcgcctccatcgtggccggctgctccacccacccgctcgacctcatcaaggtccgcatgcagctgcagggggaggcggcggccgcggcgccgccgcagccggcgatgcgcccggcgctcgcggtccccgcgggcggccagaccgtggcgctcccgcaggaagtccccgtggcgccgccgcggaagcccggcccgctgtccgtcggcgcgcagatcctgcgctccgagggcgccgcggggctcttctccggggtgtccgccaccatgctccgccagacgctctactccaccacgcggatggggctctacgacatcctcaagaccaagtggacccaggacaacggcggcgtgctccccctgcaccgcaagatcgccgcggggctcatcgccggcggcgtcggcgcggccgtcggcaaccccgccgacgtggccatggtgcggatgcaggcggacgggcgcctgcccctcgccgagcgccgcaactaccgcagcgtcggggacgccatcggccggatggcgcgcgacgagggcgtccgcagcctctggcgcggctcctcgctcacggtcaaccgcgccatgatcgtcacggcgtcgcagctggccacctacgaccaggccaaggaggccatcctcgcgcgccggggccccggcgccgacggcctcgccacgcacgtcgccgccagcttcaccgcgggcctcgtcgccgccgcggcgtccaaccccgtcgacgtcgtcaagacgcggatgatgaacatgaaggtggcgccgggggcgcccccgccgtacgccggcgccgtggactgcgcgctcaagaccgtgcggtccgaggggcccatggcgctgtacaaggggttcatccccaccgtgatgcgccagggacccttcaccgtcgtgctcttcgtgacgctcgagcaggtgcgcaaggtcttcaagggcgtcgagttctgagaccgcccgccgccaccaccacgacgatgatgacgacaaccgccgccgccgccgccgtgttaccggtctaccaccgcgtcggctgctacgaatcattgcggctgccgtgcccgccttagcttgcatcccgtgtcagcctagcgttaatccctttcctgcatcctgttgaaatggatgaaaatagggaatgttgaattgagtacttgaccagatgtacaatggaaatttcagatattttataaaaaaatcgctgcagcaatgtctagcagtttttc

SEQ ID NO: 17731 - protein, 325 aa, Panicum virgatum
  misc_feature: Ceres CLONE 1794448
  misc_feature (230)..(324): Pfam Name: Mito_carr Pfam Description: Mitochondrial carrier protein
  misc_feature (129)..(224): Pfam Name: Mito_carr Pfam Description: Mitochondrial carrier protein
  misc_feature (5)..(124): Pfam Name: Mito_carr Pfam Description: Mitochondrial carrier protein
MGVKGFVEGGIASIVAGCSTHPLDLIKVRMQLQGEAAAAAPPQPAMRPALAVPAGGQTVALPQEVPVAPPRKPGPLSVGAQILRSEGAAGLFSGVSATMLRQTLYSTTRMGLYDILKTKWTQDNGGVLPLHRKIAAGLIAGGVGAAVGNPADVAMVRMQADGRLPLAERRNYRSVGDAIGRMARDEGVRSLWRGSSLTVNRAMIVTASQLATYDQAKEAILARRGPGADGLATHVAASFTAGLVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 17732 - DNA, 1816 bp, Panicum virgatum
  misc_feature: Ceres CLONE 1794458
  misc_feature: Encodes the peptide sequence at SEQ ID NO. 17733
aaaaacgctgtgcaaccaaatcagtcggctttgttttccagctcgttgcccgcggctcaggcaggtgcgcgagtgcgggagcagagcagcaatggcggggcggcggcggctgtggaccctggtgctcgtgagcgtggcggcactgctggagcgcgcggacgaggcgctgctgccggcggtgtacagggaggtgggagcggcgctgggcgcgtcgcccaccgctctgggctacctcacgatgtgccgcgcgctcgtgcagaccttgtgctacccgctcgcgacgtgggccgcggcgcgctacgaccgcgcgcgcgtcgttgccgcgggggccttcctctgggccgccgccaccttgctcgtcggcgcatcgggctccttcctacagatggcgctggcgaggggctccaacggcgtcgggctggcggtcgcggtgccggcgatctattccctggtggccgactgcaccgacgacaccacgcgcggctgggcgttcgggtgggtggtgatggcgcagagcctaggcttcatcgccgggagctccatcgccttgctgctcgcgcccacaagcttactcggcgtctctggctggcggctcgcgttcttcgcggtcgcgctcatcagccttctcatcggcgccctggtgtggctgtttgccgccgacccccgccccgtcgtcgccaaggacgaagcggccccagcggcgacgcttgccgacctcgtccgagaagccagggacgtgctgagggtgccgacgtttcagctcatcgtggcgatgggcgtggtcgggtcgttgccgttcgcggccttcagcttcatcaccatgtggctggagctcatcgggttctcgcacgggcagaccagcctgatcatcagccttgccagcatcgctaactttctcggcatcctgttcgcggggttcctcggggatgccgtggcgcggcgattccccagcaccggacgggtcgcggtggcgcaggcggtcaacacggtgtcggtcccgctggcagccgccctgctgctcgcgttccccggcgacccctcggcggcggtcccgtacgccgccgtgtgcttcgccttcggcttcaccatttcctggaccccggtgtccaccaccaatcctatcttcgcagagatcgtgccggagaaggcgaggacgatggtgtacgcgctggacaagtgcttcgagtcggtgctgggatcgttcgggtcgcccctggtgggcatcctggcggagcgcgtgttcgggtaccagccgggcacgcccggcaagagcgcggaggccgaccgcaagaacgccgacgcgctgagcagggccatcttctcggagatcgccggacctttcatcatctgctgcctcacgtacaccgcgatgtactggacctaccccgccgacagacggcgggcccagatggcggctttgcaggcggcgtcggaggatcaggacgacgactgcgaagcaagtgtggttgcgcatgctgcagcagctgatggcttggaccaggctctactactacccgggacaagtagcaaatcatgaagaagaggctctctacttgcctggctataactaatgggcagattcggcctagcatggaaggatttcaaatacttgtactgtactagctaaatgcctgtgccttgcaatgggcattttaattttactagaacatatagttggttgaactgatactgctagaggtaatatggtcttgttgaaccatagaggcggtttcctgtcaaccactcaagtagcatgtatcaatgccttggtttgatcatcttggcaccaataatgaagcatgctgtaatttagctt

SEQ ID NO: 17733 - protein, 481 aa, Panicum virgatum
  misc_feature: Ceres CLONE 1794458
  misc_feature (13)..(373): Pfam Name: MFS_1 Pfam Description: Major Facilitator Superfamily
MAGRRRLWTLVLVSVAALLERADEALLPAVYREVGAALGASPTALGYLTMCRALVQTLCYPLATWAAARYDRARVVAAGAFLWAAATLLVGASGSFLQMALARGSNGVGLAVAVPAIYSLVADCTDDTTRGWAFGWVVMAQSLGFIAGSSIALLLAPTSLLGVSGWRLAFFAVALISLLIGALVWLFAADPRPVVAKDEAAPAATLADLVREARDVLRVPTFQLIVAMGVVGSLPFAAFSFITMWLELIGFSHGQTSLIISLASIANFLGILFAGFLGDAVARRFPSTGRVAVAQAVNTVSVPLAAALLLAFPGDPSAAVPYAAVCFAFGFTISWTPVSTTNPIFAEIVPEKARTMVYALDKCFESVLGSFGSPLVGILAERVFGYQPGTPGKSAEADRKNADALSRAIFSEIAGPFIICCLTYTAMYWTYPADRRRAQMAALQAASEDQDDDCEASVVAHAAAADGLDQALLLPGTSSKS

SEQ ID NO: 17734 - DNA, 2147 bp, Panicum virgatum
  misc_feature: Ceres CLONE 1794461
  misc_feature: Encodes the peptide sequence at SEQ ID NO. 17735
gccaccaccaagtgcccatgctccgcttggctgcttcagctcccggtgaagccgccgccgcgcgattggtcccgcgaggctgatcggccaggactctcggatggctccggcgtccgcgatggagctggaagcgccgccacaggtagcggcggcggccaaggagatcaagtcgccggaggtgctgtcgtcgccgcaccgcaagaagctgggcgcgcacttcctcgagagcgacgagcgccgcttctccggcggcgccaggacgcccctgggcggcgggtacgagctgccgccgccctccgcggccggcacgacgccggtcaacctccgcggcgagccgatcgcggtcctgtcgcggaccggcgggtgggtggccgccttcttcatcttcggcaacgagatagcggagcgcatggcctacttcggcctctccgtcaacatggtggtcttcatgttcaaggtcatgcaccgccccttcaccacctccgccaacgccgtcaacaacttcctcggcatctcccaggcctcctccgtgctgggcggcttcctcgccgacgcctacctcggccgctactggaccatcgccatcttcaccaccatgtacctgctcggcctcgtcgcgctcaccgtcagcgccagcgtgccggcgctcgcgccctcccagcagggctgcgacgagctcgccatgctgctgggcgcctgcgcgcccgccgcgccctggcagatggcctacctccaggcggcactctacgtcacggcgctcggcgccgccgggatccggccctgcgtctcctctttcggcgccgaccagttcgacgagcggagccccgggtacaagcgccgcctcgaccgcttcttcaacctcttctacctcgccgtcacgctcggcgccgtcgccgccttcacggcggtcgtgtacatctagatgcaccgcggctgggccgccgcgttcggcgcgctggcgctcgccatgggcgcctccaacgcgctcttcttcacgggcacgccactgtaccgccaccgcgtgccggggggcagcccgctgacgcgggtggcgcgggtgctcgtcgccgccttccggaagcggaacgccgccttcgacagcggcggcttcgtcggcctctacgaggtcgccggcgccaagtccgccatccggggcagcgccaagatcgaccacaccgacgacttcaggtggctcgacaaggcggcgctgcagctggagggcgacgtcctcgccgccggcgagcccgacccgtggcggctctgcacggtgacgcaggtggaggaggtgaagatcctgctgcggctgctgccggtgccggcgtgcacggtgatgctcagcgtggtgctcaccgagttcctcaccctgtcggtgcagcaggcgtacacgctcaacacccgcgtggcggcgctgcacctcccggtgacgtgcatgccggtgttcccctgcctggccatcttcctcatcctcgcgctctactaccacaccttcgcgccgctggcgcgccgcctcacgggccacccgcacggcgcctcccagctccagcgcgtcggcctggggctcttcttctccgtcctctccgtcgcctgggcggggctcttcgagcgctaccgccgcggctacgccgtccgccacggctacctcggcctcttcctctcgccgatgccggacctcagcgcctactggctgctcatccagtactgcctcatcggcgtcgccgaggtgttctgcctcgtcgcgctcctcgagttcctctaccaagaggcgcccgacgccatgcgcagcgtcgcctctgcgtacgccgctgtcgccggcggcctcgggtgcttcctggcctcggcgctcaacaccgccgtcgacgccgcgaccagggacgacggcgccggccggccgtcgtggctggcgcagaacatcaacgtcggcaggttcgactacctctactggctgctcgccgtgctcagcaccatcaaccagctcgtcttcgtgtacgtcgccaagcggtacaagtacagggtcaggatcgacgcgcaggccacaggtgtgaataagcagtagctattggcgcgagaaggagatttgaatttaaagatgtggattttgcttcactggatttgctgtaccaatgcattaccaggaataccagtacttc

SEQ ID NO: 17735 - protein, 376 aa, Panicum virgatum
  misc_feature: Ceres CLONE 1794461
  misc_feature (1)..(297): Pfam Name: PTR2 Pfam Description: POT family
MHRGWAAAFGALALAMGASNALFFTGTPLYRHRVPGGSPLTRVARVLVAAFRKRNAAFDSGGFVGLYEVAGAKSAIRGSAKIDHTDDFRWLDKAALQLEGDVLAAGEPDPWRLCTVTQVEEVKILLRLLPVPACTVMLSVVLTEFLTLSVQQAYTLNTRVAALHLPVTCMPVFPCLAIFLILALYYHTFAPLARRLTGHPHGASQLQRVGLGLFFSVLSVAWAGLFERYRRGYAVRHGYLGLFLSPMPDLSAYWLLIQYCLIGVAEVFCLVALLEFLYQEAPDAMRSVASAYAAVAGGLGCFLASALNTAVDAATRDDGAGRPSWLAQNINVGRFDYLYWLLAVLSTINQLVFVYVAKRYKYRVRIDAQATGVNKQ

SEQ ID NO: 17736 - DNA, 2110 bp, Panicum virgatum
  misc_feature: Ceres CLONE 1794473
  misc_feature: Encodes the peptide sequence at SEQ ID NO. 17737
attttccacggctccgaccaacccccatgccctccaaaccctagcccacggtccctgccccctggtggcgatgccggatctgagcaccgtctgcctccctcctttccccgaacttcccgtcgacgccgcgggggacctcgccgacgaccacgccggggatgccgccgccgccgccgccgcatcgatcgacgcggcgcccgcgtccgcgtcttcgtctgcctctgtggaggacagtggaggtggcggccccctcatgctcccagtggaatgccggtggagcggccgtgtccgcaccttcgagatgtcgggcgcaggcggtgcggtcgcctgccccgccgcgcggcgcggcggcggcgtggggaagaagccgtccgttgctccgtcacccggaccatcgcggacgcaggctccagcaccgggtaagacgctcgaggaacgcatgagcgagtgggcagctaggaaggcagcggccggcgtccctgcccaccactgcgtgctgcctttcctcaccggcgcgccaaaggcggtcgaatgctgtttgtgctccaggattatttatgctggagaaaaaataaattgttctgttagtcgctgtcaagaggtctttcatcttaactgtgttgtgaaaggcacttcaaacttcactgccgaaagcttcaggtgtcctcaacatgcctgtatggtttgtaagcaaaagatgttcttttggcgctgcgggcgttgtacagttgcagcacagacaaaatgtgcaccatggccagtgattcatcaaaaagacgatcaaggaagtgcaatttgctggaggcatccttctgactggcttctgaaaaatgagaattctgactttaccaacagcatagaggaagtgtttcaccggctaccccttccatatgttaatgaagacttcgatattgattcaaccattagggattttgctgaggctgtttacaagccacccccctatacgtccatcaggcgcaatgtatatttgataaaaaagaagcgcattggtgttcgtgcggatactgggtgcacgaactgccgagctgattctacttgcaaagaagactgtgaatgcaggggtctttcgataagttgttccaagaattgccgctgctcagatctctgtacgaacaggccattccgcaaggataagaaaattaaaattgtgaagacagagcgttgtggatggggtgctgttgcattggagccattggagaaaggtgattttgtaattgagtatgttggtgaagtcattgacgatatgatatgtgaacaaaggctttgggatataagaagtcgcggtgacaaaaacttctacatgtgtgaaatcagcaaagattttacaatagatgcaacatttaaaggaaatgcatcgcgatttctaaaccacagttgtgagcccaactgtaaactcgaaaaatggcaggttgaaggtgagactagagttggtgtctttgcctctcgttccatcaaagttggagagcccttaacttatgactacaggtttgtgcattttggagagaaagtggagtgccactgtgaggcaccaaactgccagggatacctgggcaaccaaataaagaacccaactcaaaacactcttacaattaaagacgagcaagagaagtcacgcgaacattcgccaatacaacacggcagctctgtttcaatattgcactcaatgtctcatttgttaccttggaccaacccgaactgtatagaggtctcttttaacctgagaagcaaaagcaaaataacccggatatgctgggtcggcaagaggaagagaacatctctcgtggcatcgtacaacaagaatgccaacgtcactgagtgaagctccttctgaaacagcagcataggcttatcctgtacaataatttcatggtacattctttatatgcaattggttgaaaacaattctttcacattggtcatatgtgttgttgttacctgcaacattctttattcaatctcatagggaattcagtctgttcacagttgccagtttgctgaaaccttgtactcagattttctgatgcaacttgtggttgtggctctctatccttgtatatgagatgatgttgcaaaacttgaatcccttctc

SEQ ID NO: 17737 - protein, 589 aa, Panicum virgatum
  misc_feature: Ceres CLONE 1794473
  misc_feature (356)..(485): Pfam Name: SET Pfam Description: SET domain
  misc_feature: SWISSPROT Homolog: EC 2.1.1.43 Histone-lysine N-methyltransferase
MPDLSTVCLPPFPELPVDAAGDLADDHAGDAAAAAAASIDAAPASASSSASVEDSGGGGPLMLPVECRWSGRVRTFEMSGAGGAVACPAARRGGGVGKKPSVAPSPGPSRTQAPAPGKTLEERMSEWAARKAAAGVPAHHCVLPFLTGAPKAVECCLCSRIIYAGEKINCSVSRCQEVFHLNCVVKGTSNFTAESFRCPQHACMVCKQKMFFWRCGRCTVAAQTKCAPWPVIHQKDDQGSAICWRHPSDWLLKNENSDFTNSIEEVFHRLPLPYVNEDFDIDSTIRDFAEAVYKPPPYTSIRRNVYLIKKKRIGVRADTGCTNCRADSTCKEDCECRGLSISCSKNCRCSDLCTNRPFRKDKKIKIVKTERCGWGAVALEPLEKGDFVIEYVGEVIDDMICEQRLWDIRSRGDKNFYMCEISKDFTIDATFKGNASRFLNHSCEPNCKLEKWQVEGETRVGVFASRSIKVGEPLTYDYRFVHFGEKVECHCEAPNCQGYLGNQIKNPTQNTLTIKDEQEKSREHSPIQHGSSVSILHSMSHLLPWTNPNCIEVSFNLRSKSKITRICWVGKRKRTSLVASYNKNANVTE

SEQ ID NO: 17738 - DNA, 1551 bp, Panicum virgatum
  misc_feature: Ceres CLONE 1794489
  misc_feature: Encodes the peptide sequence at SEQ ID NO. 17739
aactcatgtcgaggagctcgccgctcactcccgaggggagagaaaccgcccaaatggcgtgcgtcgccgcgctcctcgcttccccggcgctcctccccttcccctccaccgcctcatccacggccacgtcctcctgctcccgccccgccgtcgtcgcccgcgcgccgcgccagcagccgcgagggcgacgcgcgctccggcgcttcgatgaggtggaaggggtgtcgaagaagcggcgcggcatcggaggaggagccagcggcgctgcggggtcgcaggcatcgtcgccgcgcagggacagggggctcgccgtcgacttcaaggagtcgcaggttgctgagtttgaagatcttgaagaggacaaattccttaatgttgttgtcaaggttgctggtgacacattgcttggtttatatgagaaagagagattaggtctctcacaatatgcggacgagtctgaagaagagacatattgggaaaccttggatgctgatttgcgctactggaccagatcactgcgcccagtgcagtggtatcctggtcacattgcaaaaacggagaaggaattgaaggaacagttaaggctcatggatgttgtcatagagatccgtgatgctaggattcccttgtccaccagccaccctaagatggactcctggctaggcaaccggagaaggatcatagtcttgaatcgtgaggacatgatctcaactgaggacaggaatgcatgggctacttactttgctaatcagggcaccgaagttgtcttcgccaatgggcagctgggcatgggtacaatgaaattaggtaggatggcaaaatcagtagcatctggtgtgaacacaaagcgaaaggaaaagggactacttcctcgtccggttcgagctggaatagttggatatccaaatgttggcaaatcttccttgattaatcgcttgctgaaacgaagaatgtgcccagcagcacctagaccaggtgtcacaagagagcttaagtgggttcatttcggaacagacctagagttgctagattcacctggaattttgcctatgcgaattagtgaccagacagctgcaattaagcttgctatatgtgatgatatcggagaaaggtcatatgatttccctgatgtggccgcaattcttgtacaaatgttgataagacaccctgcagtaggttcagaagcgctttgaaggcgatataggattgatgtagacaacgactgtggtaaaatgtttgtcacaaagctctctattcacttgttcaatggagacacgaaccaagcagctttccgcatattgtcagattataggaaaggcaaatttggttgggtggcgctcgagacctccagcatagcaatggagatatcagataattttagatgctagagatgtgcttgttcatagtacaacacaatgtagtgttctctgtcgctttgtggcacaattgtaggacagtttttcctgcccttgtatacaatgaattaaagactagacatctaaagaagcaacatatcagaaatgctgctgctgttacttggcagtccagagc

SEQ ID NO: 17739 - protein, 379 aa, Panicum virgatum
  misc_feature: Ceres CLONE 1794489
  misc_feature (276)..(356): Pfam Name: MMR_HSR1 Pfam Description: GTPase of unknown function
MACVAALLASPALLPFPSTASSTATSSCSRPAVVARAPRQQPRGRRALRRFDEVEGVSKKRRGIGGGASGAAGSQASSPRRDRGLAVDFKESQVAEFEDLEEDKFLNVVVKVAGDTLLGLYEKERLGLSQYADESEEETYWETLDADLRYWTRSLRPVQWYPGHIAKTEKELKEQLRLMDVVIEIRDARIPLSTSHPKMDSWLGNRRRIIVLNREDMISTEDRNAWATYFANQGTEVVFANGQLGMGTMKLGRMAKSVASGVNTKRKEKGLLPRPVRAGIVGYPNVGKSSLINRLLKRRMCPAAPRPGVTRELKWVHFGTDLELLDSPGILPMRISDQTAAIKLAICDDIGERSYDFPDVAAILVQMLIRHPAVGSEAL

SEQ ID NO: 17740 - DNA, 2472 bp, Panicum virgatum
  misc_feature: Ceres CLONE 1794495
  misc_feature: Encodes the peptide sequence at SEQ ID NO. 17741
gggcaaagcaagctagcgcggcccccagattctctcgcgcctccactttaccttctccttctggccttccccgcgccatggcccacgaacgggagccgctcctgcagcagccgcagagcggcggcggcggcggcaatgccgccggtgccaagggctcgtcctcggcgcccgccgccgctccgctgccgtcgctggccaggaccgtgctcaagttcctgatgtgggcggtgttcctctcctgggccgcggggatcttcttctacccgaccaagcccgcgcaggccgtgttcaagaagtgggttgggctcaccagggactccacgggcatcgccggtagcatttttctgaccttcagcgcacccatcctgataattgcgcttctggcatatgtgtacatctccttcttcccgagtgatcatatggagaagaggaagctgaggtcattgagtttccggctctggacattccctgttcttgtcgatggcccttttggagttgtttctgcagttgaattcatcggaattgtcctatttatcgtttatgttgtctactcaatgacctactatgctttggagagtgtgagccttgtctcaaaatttgatacaccatcaaagactgatagtgagttgatactgcatgtcatcggtcttcgcttaggatcagttgggctgttctgcatgttgttcctgttcctgccagttgcaaggggctcagttcttcttcggcttatcgacattccgtttgagcatgctactagataccacgtctggctcggacatctcacgatggctctctttacattgcatggcttgtgctatgtgatcgaatggtccatgcaagggctcctacttaaaaagatggcaggatggaaggaagttggaattgcaaacttccctggcgtgatcagcttggcagctggcctacttatgtgggtgacctcacttcacccagtgaggaagaagttctttgagctcttcttctacacccaccaactctacgtcatctttgtcgtgttcttggcattacacgtcggcgacttcatcttcagcatttcagctggggccgtcttcctcttcatgctcgatcgcttcctaaggttttggcagtcaagggccaaagttgacatcatttcagctgcctgccgcccatgcgggacagtggagctagtcttctcaaaaccagcaagtctccgctacaatgctctcagtttcatcttcattcaagtgcgcgagttgtcgttcttgcagtggcatccattcagcgtatcttcgagtccaatggatgggaggtaccacatgtcggttctcataaaagtactgggcacatggactgagaagctgaggagcatcatcaccgatgtccaggagcagaacaggggtgactctgagttgcaatgtggtcgcataacagcctgtgtggaagggccgtatggacatgaatctccctatcacttgatgtacgagaatctcatcctggtggcaggaggaattggaatatcgccattcttggcgatcttgagtgacataatccacaggatcgaggagggcaagcaatgcatgcccaagaacgtgctggtcctgtggtcagtgaagaagtccaaggagctttctctcttgttggccgtcgatgcgcagaccatcagttcatctgtctctgacaagttgcgcttggatatccaggcattcgtgacccaagaaacccaggctccattggaggatggcatcgttggcgatgaccagaaagtccctggcatgttcgtcaaaaacaggacgaccatgtccgggctggtcggcaccggggacaacttctgggcggccatgtacttcctggcgtcgacactcgggttcctcctggcgtacgccctggtgcaggtgtactacgtgaagccccacaacgtggtggcgtggtggtacctgggcctcctgttcatgctgtgcatggccgccggcgtcgccctccccggcggcctcgtcgtgctcctgtggcacctgtccgagaagcggaggctcgaggacgagaagtgggacgccgccgcctcccagtcgccgcgggcagccgcgcccgcggcaggtggtgacgccgccgccgccgacgccgacgccgcccccggcgtcggcctcgccgccctgcggacgacccggtacgggtgccggccagacttcgaagcggagttcgcggcgttcgcggagcgcgccggcgacgcggcggacgtgggcgtgctggtgtgcggtccacaggggttgcaaacgagcgtggcgagggagtgccgggcgcggaacctccgccgcggcggcggggcgggcaagagcggcagccgcgcggtcttccacttcaacagccacagcttcgacctctgattacacacgcgccgataggaatataggataggcccgtgaagcacacatgcatgctgcctctgtaattatgctgtatactccctccgtttttaaatatatgacactattgactttt

SEQ ID NO: 17741 - protein, 759 aa, Panicum virgatum
  misc_feature: Ceres CLONE 1794495
  misc_feature (193)..(315): Pfam Name: Ferric_reduct Pfam Description: Ferric reductase like transmembrane component
  misc_feature (345)..(455): Pfam Name: FAD_binding_8 Pfam Description: FAD-binding domain
  misc_feature (461)..(731): Pfam Name: NAD_binding_6 Pfam Description: Ferric reductase NAD binding domain
  misc_feature: SWISSPROT Homolog: EC 1.6.3.1 NAD(P)H oxidase
MAHEREPLLQQPQSGGGGGNAAGAKGSSSAPAAAPLPSLARTVLKFLMWAVFLSWAAGIFFYPTKPAQAVFKKWVGLTRDSTGIAGSIFLTFSAPILIIALLAYVYISFFPSDHMEKRKLRSLSFRLWTFPVLVDGPFGVVSAVEFIGIVLFIVYVVYSMTYYALESVSLVSKFDTPSKTDSELILHVIGLRLGSVGLFCMLFLFLPVARGSVLLRLIDIPFEHATRYHVWLGHLTMALFTLHGLCYVIEWSMQGLLLKKMAGWKEVGIANFPGVISLAAGLLMWVTSLHPVRKKFFELFFYTHQLYVIFVVFLALHVGDFIFSISAGAVFLFMLDRFLRFWQSRAKVDIISAACRPCGTVELVFSKPASLRYNALSFIFIQVRELSFLQWHPFSVSSSPMDGRYHMSVLIKVLGTWTEKLRSIITDVQEQNRGDSELQCGRITACVEGPYGHESPYHLMYENLILVAGGIGISPFLAILSDIIHRIEEGKQCMPKNVLVLWSVKKSKELSLLLAVDAQTISSSVSDKLRLDIQAFVTQETQAPLEDGIVGDDQKVPGMFVKNRTTMSGLVGTGDNFWAAMYFLASTLGFLLAYALVQVYYVKPHNVVAWWYLGLLFMLCMAAGVALPGGLVVLLWHLSEKRRLEDEKWDAAASQSPRAAAPAAGGDAAAADADAAPGVGLAALRTTRYGCRPDFEAEFAAFAERAGDAADVGVLVCGPQGLQTSVARECRARNLRRGGGAGKSGSRAVFHFNSHSFDL

SEQ ID NO: 17742 - DNA, 615 bp, Panicum virgatum
  misc_feature: Ceres CLONE 1794501-R
  misc_feature: Encodes the peptide sequence at SEQ ID NO. 17743
ggagacaatgccaaatttatcctgatccaatatattcgttatttctccatttaagaagtcatgaatcctctcctctttccatttaaccgatgcaatttgcagtgcacgcactgtagttaatcccatcttaggtctgagttgtcttgatttgctacatatgtttgtgacttgtgaagattactgaggaaccgggtgtcagcccaacaggcaagagagaggaagaaggcttatctgactgacctagaggtgaaggtaaaggacctggagaagaataactcagagatggaagagaagctctccaccctccagaatgagaaccagatgctccgacagatactgaagaacaccactgtaagcagaagaggcccaggcagcactgctggtggagagggccaatagcacagaagatgaggacaaatagtgatgcttttatgccaaaaaaatatatatacttatgtggaatggatttggtcagggcgttttctggccgaagaagagaaccccaaaaaaaaacggggtgaagaaattgtgcagacggtcatataatatctcactgtattaccatccgtatccgatgtacagacggttcagtggaaaaaacttgaggaatgcttg

SEQ ID NO: 17743 - protein, 38 aa, Panicum virgatum
  misc_feature: Ceres CLONE 1794501-R
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Functional homolog of the protein sequence given in SEQ ID NO 50426
  misc_feature: Useful for making plants with modulated light quality sensitivity
MEEKLSTLQNENQMLRQILKNTTVSRRGPGSTAGGEGQ

SEQ ID NO: 17744 - DNA, 697 bp, Panicum virgatum
  misc_feature: Ceres CLONE 1794501
agggaaggatcccagcaggctcccatcagagcagaggagataggtaaggagaagcagggtgagcgcagcggcgcagggaggcggagaggaggggccgagaatgcaggagcaggcggcgagctcgcggccgtccaggtccagcagcgagaggtcctccagctccgcgcaccacatcgacatggaggtcaaggaagggatggagagcgacgaggagataaggagagtgccggagctgggcctggagctccccggcggcgcttccacgtcggggagggaggccggagctggcgccggcggcccggagcgcgcccagtcgtccacggcgcaggccagctcgcgccgccgcgtgcgcagccccgccgacaaggagcacaagcgcctcaaaaggtgtgagatttgctctaatcctagtaatagtaatagcatacagcatcatctaagaattccagttaacaaaaaaggcatcacctgcgacttcagttcaaaagaaaaaaaaacacttgcaaggcatcaacctgtgttgaagtataattaatcaggaatacccataccatgttatgctgctacgcgtccggtcttttttttttctttttttgcagatggtaagggatcagtttattgggagtgctggcccgtctgttgacagaataaaatgtctttggtgatgtttcttgtatgctagccatgcatgtttttg

SEQ ID NO: 17745 - DNA, 1914 bp, Panicum virgatum
  misc_feature: Ceres CLONE 1794503
  misc_feature: Encodes the peptide sequence at SEQ ID NO. 17746
gaaaaattgaacacaccgaaagctccgggacgggaagacgacttggtgctcgtgctgccgcgagatctaaccaaaccccgcgccctcctcaccgtccggcgagccccgaccctgcagatcaccggcgctcgagtggtacccagacgcgcgcggtggaaccggcgccgagataagggcggcgccagacgctcgggccgcgggcgacgatgccggtggcggcgtcggccatctacttcctcaacctccgtggggacgtcctcatcaaccgcctctaccgcgacgatgtcgggggaaatatggttgatgcgttcaggatgcatattatgcaaacaaaagaacttggcacatgtcctgttcggcaaataggaggctgttccttcctttacatgaggatcagtaatgtttatattgtgattgtggttagcagcaatgctaatgttgcttgtgctttcaagtttgtagtcgaggcagtggctctctttaagtcctactttggtggagcttttgatgaagatgccataaggaataactttgttttaatatacgaacttcttgatgagattatggattttggttatcctcaaaatctgtcacctgaaatcttgaagctgtatataactcaagaaggtgtccggtcaccattttcctcaaaggcctcagacaagcctgttccaaatgcgacccttcaagtcactggtgctgttggttggagaagagagggtcttatgtacaagaagaatgaggttttcttggacatagttgagagtgtaaaccttctcatgtcttcgaaagggagtgttctgcgatgtgatgtgacaggaaagattcttatgaagtgcttcctttctggaatgcctgatctgaagctgggattaaatgacaagattgggcttgaaaaggaagcccaactgaagtccaggcctacaaaaagtggaaagaccatagaacttgatgatgtcacgttccatcagtgtgtcaacttaacaagatttaactcagaaaagacagtcagctttgtgccaccagatggtgaatttgaattgatgaagtaccgaatcacagagggtgtaaaccttccattccgtgttcttccgacaattaaggaattgggtcgaacgcggatggagattaatgtgaaagtcaagagtgtttttggtgctaagatgttcgcactaggtgtcgttgtcaaagtaccagttccaaagcagacagcgaagactagcttccaaacaacatcaggcaaagcgaaatacaatgcttcgattgattcactggtgtggaagatcaggaaattccctggacagactgaggcaactatgagtgcagaggttgagttgatctctaccatgggtgaaaagaagtcatggaacagaccacctattcagatggaattccaggttccaatgttcactgcttctggtctacgtgttcggttccttaaggtctgggagaagagcggttacaacactgttgagtgggttcgctacatcacgagagcaggatcatacgagataaggtgttagtgacagataaatctttcaagctccatcgagcagttatttcaatgatccacagaggtctctgtacggtgtcatgcatgattataaagcgcgtatactgtgatgactatcttcaaacctcgtacttcagcagagggggcaggccagggcagaccagacagttttcctttatgtccttctattcactgtagtctgggatatctattctcccctcgtgccctgtttgtttggtagggagtatttttgtttgtatatttggcgccagcgttccttgttgatcaatatacaccccttatcagtttgtattatttttcgccttaaatggatgagtggtttcacttggcataacagtgtacaaacatttgatgcataagattcggtataattgcagagc

SEQ ID NO: 17746 - protein, 438 aa, Panicum virgatum
  misc_feature: Ceres CLONE 1794503
  misc_feature (166)..(438): Pfam Name: Adap_comp_sub Pfam Description: Adaptor complexes medium subunit family
MPVAASAIYFLNLRGDVLINRLYRDDVGGNMVDAFRMHIMQTKELGTCPVRQIGGCSFLYMRISNVYIVIVVSSNANVACAFKFVVEAVALFKSYFGGAFDEDAIRNNFVLIYELLDEIMDFGYPQNLSPEILKLYITQEGVRSPFSSKASDKPVPNATLQVTGAVGWRREGLMYKKNEVFLDIVESVNLLMSSKGSVLRCDVTGKILMKCFLSGMPDLKLGLNDKIGLEKEAQLKSRPTKSGKTIELDDVTFHQCVNLTRFNSEKTVSFVPPDGEFELMKYRITEGVNLPFRVLPTIKELGRTRMEINVKVKSVFGAKMFALGVVVKVPVPKQTAKTSFQTTSGKAKYNASIDSLVWKIRKFPGQTEATMSAEVELISTMGEKKSWNRPPIQMEFQVPMFTASGLRVRFLKVWEKSGYNTVEWVRYITRAGSYEIRC

SEQ ID NO: 17747 - DNA, 1839 bp, Panicum virgatum
  misc_feature: Ceres CLONE 1794504
  misc_feature: Encodes the peptide sequence at SEQ ID NO. 17748
agcgtcagccaagggcagccagccatgaacgcggcggcctccttcgtcgccgtggcgctggccctggcggccctcgtccccgtctcgctgctgctcctgaaccggctcctctacggcaagctgccgccgggcccccgcccccgccccgtggtgggcaacctcttcgacgtgcagccggtgcgctgccgctgctaccaggagtgggcgcggcggtacgggcccatcatgacggtgtggctggggccggagccgacggtggtggtgtcgacggcggagctcgccagggaggtgctcaagacctacgaccagagcctcgccgaccgcaagcgcgaccgctcctcggagcgcttcagccgcggcggcaaggacctgatctgggccgactacggcccgcactacatcaaggtgcgcaagctctgcaacctcgagctcttcacgccgcgccgcctcgaggcgctcaggcccatccgcgaggacgaggtcaccgccatggtcgagtccgtgcacagggccgtcaccgcgccgggcaatgaagggaagccgttggtggtgaagaaccacctctcgatggtggccttcaacaacatcacgcggctggccttcgggaagcggttcgtgaacgcggccggcgagctggacgagcaagggcgcgagttcaagggcatcatcaacgacgggatcaagatcggcgggtccctctccatcgccaagtacatcccgtggctgagttggctggccccggccgacgaccaggtcttcaaagcccacggcgaccggcgcgaccgcctcaccgtgaggatcatggacgagcaggccagggccctcaagcagcgcggcggcgcccagcagcacttcatcgacgcgctcttcaccctcagggagcagtacgacctcagcgacgacaccgtcatcggcctcctctgggacatgatcgccgccggcacggacacgacggtgatcgcagtggagtgggcgatggcggagctggtgcggaacccccgggtgcaggagaaggcgcaggaggagctggaccgcgtcgtcggccgcgaccgggtcctgctggagacggacttccccaacctgccctacctgcaggcgctcgtcaaggagtcgctccggctgcacccgccgacgccgctcatgctcccgcacaaggccagcgccggcgtcaagatcgccggctacgacgtgcccaagggcgccaacatcatcgtcaacgtgtgggcgctggcgcgcaaccccgaggtctgggaggacccgctcgcgttccggccggagcgcttcctccgggagaacatcgacatcaagggcgccgacttccgcgtgctcccgttcggcgccggccggcgggtgtgccccggcgcgcagctcgggatcaacctggtggcgtccatgctcgggcatatgctgcaccacttcagctggtcgctgccggaggggacccggcccgaggacgtggagatgatggagacgcccgggctcgtcaccttcatggccacgccgctcaaggccgtcgccacgccgcgcctcgacaaggaggagctctacaggcgtgtgccgtccgagatgtgagcgcctgcatatgctggcgcgccgtctgcattttcccggtgtgtactgctcttgtggacgggatcgatcggaagatgatgatgccgtcgttgcaaatttgtgcgacccgttcgttattattatctcttttctggcgttcttctaattatatgcatgaacgagcatttgtgtgtacttcttcagaccttgcacgcctcgccgatattattatctgtttgtcaggcaggcaggaattcataattaatttgggcaccaagaaatccgctc

SEQ ID NO: 17748 - protein, 515 aa, Panicum virgatum
  misc_feature: Ceres CLONE 1794504
  misc_feature (34)..(498): Pfam Name: p450 Pfam Description: Cytochrome P450
  misc_feature: SWISSPROT Homolog: EC 1.14.13.21 Flavonoid 3'-monooxygenase
  misc_feature: Functional homolog of the protein sequence given in SEQ ID NO 50286
  misc_feature: Useful for making plants with altered carbohydrate content
  misc_feature: Functional homolog of the protein sequence given in SEQ ID NO 50781
  misc_feature: Useful for making plants with altered lignin content
  misc_feature: The sequence is a functional homolog of SEQ ID NO 4 in US patent 7071376
  misc_feature: The sequence is a functional homolog of SEQ ID NO 6 in US patent 7071376
  misc_feature: Functional homolog of the protein sequence given in SEQ ID NO 50288
  misc_feature: Useful for making plants with altered cell wall content and/or composition
MNAAASFVAVALALAALVPVSLLLLNRLLYGKLPPGPRPRPVVGNLFDVQPVRCRCYQEWARRYGPIMTVWLGPEPTVVVSTAELAREVLKTYDQSLADRKRDRSSERFSRGGKDLIWADYGPHYIKVRKLCNLELFTPRRLEALRPIREDEVTAMVESVHRAVTAPGNEGKPLVVKNHLSMVAFNNITRLAFGKRFVNAAGELDEQGREFKGIINDGIKIGGSLSIAKYIPWLSWLAPADDQVFKAHGDRRDRLTVRIMDEQARALKQRGGAQQHFIDALFTLREQYDLSDDTVIGLLWDMIAAGTDTTVIAVEWAMAELVRNPRVQEKAQEELDRVVGRDRVLLETDFPNLPYLQALVKESLRLHPPTPLMLPHKASAGVKIAGYDVPKGANIIVNVWALARNPEVWEDPLAFRPERFLRENIDIKGADFRVLPFGAGRRVCPGAQLGINLVASMLGHMLHHFSWSLPEGTRPEDVEMMETPGLVTFMATPLKAVATPRLDKEELYRRVPSEM

SEQ ID NO: 17749 - DNA, 838 bp, Panicum virgatum
  misc_feature: Ceres CLONE 1794514
  misc_feature: Encodes the peptide sequence at SEQ ID NO. 17750
accagacgaattactaccaaacgccacaagaatttctcagaactttgaagtcatgcctcctcatgttgagagcagttcttctgacgatgatggacagacaacaaggctatttcatagacgcggatcagtgcataagctactcggtcgacggaaagttgcggacatcctgctatggagggacaaaaacctatctgcagggatcctcgcaggggcaacattggtctggttcctgttcgacgtagttaattacaatgtagtaactctcctttgtcacatggcactccttgggatgcttcttctcttcatttggtcgaatgccgcacctctctttgacaggcggcctccacagatcccagaggccattgtttctgaaaaagcattcagagaaattgcacagactgcccagtacaaactggctcactttgtatcaatcctatacgacattgcatgcgggaaggatcttaagaagtttctcatggtgattgggtctttgtgggtactggcagtagttggagatacttgcagcttcaccacactgttatatgttggctttttgtgtgctcttactttaccgccattatatgaaagatacgaaacagaagtggaccatcttgtagccaaagggggtgaagacctcaagaaattctacgagaaggttgactccaatgtcctcaacaagataccaagaggcccagtcaaaacaaaagttcgctaagatgttcttcgaatttccctaagttgtcaggacacgcaaatagtcccatactcccatatatatatgtaaaaaatagtaagttagtaaccagttactggatttaacttcaaaataatttatggt

SEQ ID NO: 17750 - protein, 220 aa, Panicum virgatum
  misc_feature: Ceres CLONE 1794514
  misc_feature (35)..(218): Pfam Name: Reticulon Pfam Description: Reticulon
MPPHVESSSSDDDGQTTRLFHRRGSVHKLLGRRKVADILLWRDKNLSAGILAGATLVWFLFDVVNYNVVTLLCHMALLGMLLLFIWSNAAPLFDRRPPQIPEAIVSEKAFREIAQTAQYKLAHFVSILYDIACGKDLKKFLMVIGSLWVLAVVGDTCSFTTLLYVGFLCALTLPPLYERYETEVDHLVAKGGEDLKKFYEKVDSNVLNKIPRGPVKTKVR

SEQ ID NO: 17751 - DNA, 1754 bp, Panicum virgatum
  misc_feature: Ceres CLONE 1794515
  misc_feature: Encodes the peptide sequence at SEQ ID NO. 17752
ggccccaaccccaaggaacaagaggggtctccaggtcagtttcgtcgcccctcctcgtctcctgagattgccggtggattcgcgagggattagggtctggatagcgcgaatcgccaccattcttcatttcttctgctctgcggcgattgatttctggctgcctgtaccaggcagagcatgcgccacgtccgggtgtcctcccaccaggcccccgtccacaagctcggccacgcgcagatggcgctcacgcccaagttccgcctcgccaccgccgcccccgcgccgccctcgcccacggaggcccagcagccggcctgggagacgccgctgatcccggggctccccgacgacgccgcgctcggctgcctcctccgcctccccgtcgaggcgcacgcggcctgccgcctcgtgtgccgccgctggcgccgccacctcgccgacaaggcgcgcttcttcgcgcagcggcgggcgctgggcctccgcaccccctggctcttcaccctcgccttccaccgctgcacgggcaagatccagtggaaggtgctcgacctcggccacctcacctggcacgccatccccaccatgccgtgccgggaccgggcgtgcccccgggggttcggctgcgtcgccatccccagcgacggcacgctcctcgtctgcggcggcctcgtctccgacatggactgcccgctgcacctggtgctcaagtatgacatctacaggaacaggtggaccgtcatgacgaggatgctcgccgcccgctccttctctgccggcggcgtgatcgatggccgggtttatgtcgccggaggctatagcaccaaccagtttgagctcaattccgcggaggttcttgatccggacaagggcgtttggcagccaatcgctagtatgggcatcaacatggcctcctcggactctgctgtcatcagtggtaggctctatgtcactgaaggttgcgcgtggccgttcttctcgtcgccgagaggacaggtttatgatccgaagatcgaccggtgggaggcaatgccggttggaatgcgcgaaggttggacgggacagagtgtggtcatcgatgggcatctgtttgtcatttcagagtatgagaggatgaaggttaagatctatgatccgcagacggattcatgggactcggtcagtggtcctccgatgcccgagcggattatgaagcccttctccgtcagttgtctggacagcaagattgtcgttgttggccgaggtctccatgtagcgattgggtatgttgagaagcaacctgctgctggtggcaattctggtagcaggagttcaagctactccatttgttggcaagatgtggatgttcctaaggaattcagtgatctgacaccttcgagcagccagattctgcatgcttaatttatcttcgagcccgccgtggtgattcatctgcaaaagtaccccagctgatcaaccttctccggtactgtctatgactgatctgatcaactccttaaattgcccctttgagctgtacaattgttgtgttctgtatagtaggctcttttccagtcagatctctatgatctggagctgttgtaccttgttgtaaagaaataaatcgagtttctctagaacagagacaaattaagaccccgttgtaagtatatgcttgtcagttttttttttgagattatatgcttgtcagttcttgaacaggaagttctatttggctgtgtttagatgaggtgaaaaggggagaaaaaaatcacatc

SEQ ID NO: 17752 - protein, 386 aa, Panicum virgatum
  misc_feature: Ceres CLONE 1794515
  misc_feature (125)..(172): Pfam Name: Kelch_1 Pfam Description: Kelch motif
  misc_feature (174)..(220): Pfam Name: Kelch_1 Pfam Description: Kelch motif
  misc_feature (30)..(77): Pfam Name: F-box Pfam Description: F-box domain
MALTPKFRLATAAPAPPSPTEAQQPAWETPLIPGLPDDAALGCLLRLPVEAHAACRLVCRRWRRHLADKARFFAQRRALGLRTPWLFTLAFHRCTGKIQWKVLDLGHLTWHAIPTMPCRDRACPRGFGCVAIPSDGTLLVCGGLVSDMDCPLHLVLKYDIYRNRWTVMTRMLAARSFSAGGVIDGRVYVAGGYSTNQFELNSAEVLDPDKGVWQPIASMGINMASSDSAVISGRLYVTEGCAWPFFSSPRGQVYDPKIDRWEAMPVGMREGWTGQSVVIDGHLFVISEYERMKVKIYDPQTDSWDSVSGPPMPERIMKPFSVSCLDSKIVVVGRGLHVAIGYVEKQPAAGGNSGSRSSSYSICWQDVDVPKEFSDLTPSSSQILHA

SEQ ID NO: 17753 - DNA, 635 bp, Panicum virgatum
  misc_feature: Ceres CLONE 1794533
  misc_feature: Encodes the peptide sequence at SEQ ID NO. 17754
aaacaaaacgcccccgcttggctgctgagcttcttcttccgcaaggaggaaaaaaaggatccagaggccagggttcgtttcttaccggaccgtgtcgcgagtcccgatggcggagccggcggagccggcgaagcccgaggtgacggaggaggctaagatggacctgctcgaggacgacgacgagttcgaggagttcgagatcgaccaagagtgggacgacaaggaagaaggcaacgaagcacttcagcaatgggaggatgactgggatgatgatgacgtcaatgatgacttctcgctgcagttgaggaaggagctggagagcaatgcgccgaagaactagccagcgtatgcagccttgtattgagttggagagtggtgtgatggtgtccaaggactagttagcttatgcagccttgtatccattattgtcagataggaactgctgtacggtgaccatggttgggaaactgctactgttgttccgttctcgtccttgttggcatggtcactgatgttgtcgttccgtttgcttttaatggatcatttccctgtttccgactactaataactgatgaaccttggttaaaaggcagcaatgagaattgtatgctacatgttacgctgttcgcttatac

SEQ ID NO: 17754 - protein, 77 aa, Panicum virgatum
  misc_feature: Ceres CLONE 1794533
  misc_feature (11)..(73): Pfam Name: DSS1_SEM1 Pfam Description: DSS1/SEM1 family
MAEPAEPAKPEVTEEAKMDLLEDDDEFEEFEIDQEWDDKEEGNEALQQWEDDWDDDDVNDDFSLQLRKELESNAPKN

SEQ ID NO: 17755 - DNA, 2590 bp, Panicum virgatum
  misc_feature: Ceres CLONE 1794546
  misc_feature: Encodes the peptide sequence at SEQ ID NO. 17756
acccagagctctgtagaagaagcggcgagggggcgaaccggagccactcagccgccacctcaccgcgccaccgactgcgtgaatcccctccccacgccgctcctgctcgccgccgcccgctgctctcgccatttcagctgcagcgctcgccgccgccgcagggccgcagcgcctctcctcctccgcccgcctgccggctgccttccggatgagaagcggcgcaaccggggcggcggaagcgtggtcggcgtgaggcttcgtcggagtccgtgaacgcgccgacaaggatcctggagatcaagcgcatgggttccttggaggcccggtaccggccggccggggcagctgaggacacggctaagagaaggactcagaaaagcaaaagtttcaaagaggttgaaaaatttgatgtttttgttctggagaaaagctcgggatgcaaattcagatccttgcaacttttgctctttgctatcatgtctgcggcatttctaacactcctatacacgccgtctgtgtatgaacatcagctacagtcaagctctagacttgtcaatgggtggatatgggataagagaagttctgatcctcgatatgtgtctactgccaacattcaatgggaagatgtatataaaagtattcaaaatctgaatggtggtgaacaaaagctcaaagttgcactcctgaattttaacagaactgagtttggcacttggacagatatgctcccagaaagtgatttttcagtcgtaagactagagcatgccaatgaaaccattacctggcagactctctatcctgaatggatagatgaggaggaagaaacagagataccatcttgcccttcgcttccagatccaaattttccaagatcgacacactttgatgttgttgctgttaagcttccctgtactcgtgtggcgggttggtcaagagatgttgcacggctgcatttgcagttatcagcagcaaaaatagcagcgaccacggcaagaggcaatggtggagtccatgtgctctttgtgactgattgcttcccggttccaaatctcttctcttgcaagaacctggtgaaacgtgaaggcaatgcttggctgtacaaacctgatgtgaaggctctacaggagaaactcaggctacctgttggttcctgtgagcttgctgttccactgaacgcaaaagcacgactttacacagtggacagacgcagagaagcatatgctacaatactgcattcagcaagtgaatatgtttgtggtgcaatcacagcagctcaaagcattcgccaagcaggatctacaagagaccttgttattcttgttgatgagaccataagtgatcaccaccgcaaggggctggaatctgcggggtggaaggtcagaataatagagaggatccggaaccctaaggctgaacgagatgcctacaatgaatggaactacagcaaattccggctatggcagcttacagattatgacaaggttatattcattgatgctgatctccttatcctgaggaatatagatttcttgtttgcaatgccggaaatcactgcaactggcaacaatgcaacactcttcaactctggagtgatggtcattgagccctcgaactgcacgttccagttactgatggagcacatcaatgagataacatcgtacaatggtggtgaccagggctatctgaatgagatattcacatggtggcatcgcattccaaaacacatgaacttcttgaagcatttctgggagggcgatgaagaggcagtgaaggcgaagaagactaggttgtttggggctaacccgccaatcctctatgtccttcactacttgggccggaagccatggctgtgcttccgggactacgactgcaactggaatgtagaaattctgcgggagtttgcgagtgatgttgcacatgctcgctggtggaaggtgcacaacaagatgccgaagaagcttcagagctattgccttctgaggtcaaggctgaaggccgggttggagtgggagcggcggcaggctgagaaagcaaacttcactgacgggcactggaaaaggaacataactgatccaaggctgaaaacctgctttgagaagttctgcttctgggagagcatgctgtggcattggggtgagaacaagaccaactcgacaaagaacaacccggcgcctgctccgcctactgcgagcctgtcgagctcatgagatctgtagatagctttgttgagagagtagtatacccagatacaaaacttctgaagctccatacatacatagcaacaactttgtgaaggtagctatgtaggcctcttcggctcttcccgaatgactctatacctctgttggccaatcactccagcgtcctcccgctgctttttgatggctggcaaatttttttggtttcttctgctaataattcgtcagtataggctgttttcctttctggcttagagtcctgtccggggtcttgttgcttcatgttccatcggctattgctgtgctgcagtacgcctggtttgttgatgtatggtggttgaacagtttcagtgatcaatctggagtgatgcaacatgagattgctgaccagc

SEQ ID NO: 17756 - protein, 633 aa, Panicum virgatum
  misc_feature: Ceres CLONE 1794546
  misc_feature (306)..(518): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Functional homolog of the protein sequence given in SEQ ID NO 50565
  misc_feature: Useful for making plants with altered carbohydrate content
  misc_feature: Functional homolog of the protein sequence given in SEQ ID NO 50566
  misc_feature: Useful for making plants with altered cell wall content and/or composition
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIQWEDVYKSIQNLNGGEQKLKVALLNFNRTEFGTWTDMLPESDFSVVRLEHANETITWQTLYPEWIDEEEETEIPSCPSLPDPNFPRSTHFDVVAVKLPCTRVAGWSRDVARLHLQLSAAKIAATTARGNGGVHVLFVTDCFPVPNLFSCKNLVKREGNAWLYKPDVKALQEKLRLPVGSCELAVPLNAKARLYTVDRRREAYATILHSASEYVCGAITAAQSIRQAGSTRDLVILVDETISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEAVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKTNSTKNNPAPAPPTASLSSS

SEQ ID NO: 17757 - DNA, 2514 bp, Panicum virgatum
  misc_feature: Ceres CLONE 1794568
  misc_feature: Encodes the peptide sequence at SEQ ID NO. 17758
caatgcgtggagctcgccgccgccccctgcctcgtcgccttccactggagctcgtggccgccgccgccccctggagctcatggccaccgtgctggagcttgcggactccgcgctcgccgccgcccctagagttcgcggcctccgcggccgccgcccctagagttcgcggcctccgcggccgccgcccctggctcgccgcttcctccgctcggtctcgagccggtgggtgtctactctgcctctctagtcaagtcatattattgtttgaacatagccaagtcttctgggtccatttaatcaaatggacttggaaaaaaaattgcgcagcgagtcataccaagtcatccaaactggggcatttgctacaggcctacagctagcgctggatttgtatatatacagggatgaatgtgcatccatcagactcatcagatacaaggtgtgctctccttcaatttgttctccctccctccctgtttgctagttgcagcagccagcaggatcagcaatggcattcaacgatgatgacaagcctcctacttccaacaccgggagcaccaagggtctggtgagcatcaagccggtgaagtacttcaaggacgatgcggcgctgacggcggacacggtgacggcggaggtggagatcaacgcgacatcctccaccaccgtgagggaggggctggacctggtggccgtgctcgacgtcagcggcagcatgcgcggggacaagatcgcgagcctgaagaaagccatgacgttcgtgatcatgaagctcaccccggtggaccgcctctccatcgtcaccttctccaacgacgccgccaggctgaccccgctgcgctccatgaccccggccgcccagaccgagctcaaggctgtcgtcgacggcctggcggccggcggctggaccaacatccaggccggccttgagaccgggctggccgtgatcgccggccgcgtcaacaccaaggcccgcaccgccaacatcttcctcatgtcggacggggagcagaagcccggcgacgccaggcaggtcgaccccggccaggtggccatctacacgtttggcttcggcaaggacacgaaccacctgctgatgagcgacattgccaagagatcgccgggcgggaccttcagctccgtgccggacgggtccacggtgactctgcccttctcgcagctgctggctggtctcctcaccgtggtggcgcaggacgtggagctcaccctgactcccaagaccgacgacggcgacgtggacacaatagtggtggctcccggcaccgactacaagacgaccacagacgccgccaccggcgtggtcaccatcgcgttcggcaccctcttcgccggagaagggcgcagggttgtcatcaccctcacgctcaaggacgtgagcgccaccaacaatgaggagtacgacgcgcccttagccgaggcccagcacagctacaccgcccagggaagaccaagggaccctcagcttccacaggacatccagatcaggcgcaccccgactccatcccaagcccctggcgcgagcagcaaggcgcggcaggtgcaggccgagatcgccaggaggaaccacgccgaggccatcaggcaggcgaggctgctggcggacaaaggcgaccctgaaagcctggacgaggcgcggtacaagctggtggacgcgcagaacgcattggaggacatcgtgctggacagcctcgccgacggccagaagctggtggactcgctccgggccgagctggtgcagctgatcaagctcatggagaccaaggagctctacgaggcgcagggccgcccctacgccctggcctccgagaccagccacggccgccagcgctactgcgccaggggcggcgacgaagacagcgacgtccgcctcttcgccacgccgcgcatggacacctaccgcgagcaggccaagaatttcgagaaggaccccacggcgccggtgcccaccgccgacgaggacgtcaagaaggaggtcgccgccaacccgctcgccgccatctccaacgatctcgcctactacctccgcaatgctatcgaagcgctgcgggccatcgagaggatcatcgccccaagcgcctagggatcggagttaccatttcctgtccatccgatcacgcgcgcgtacccgtttcctttaatttcttgctacagtacctgtttccaataagcgcgcgcgatatatacccggtgtgtaaacgtattgttgtttcctctccagttcacatcatttgaattccaaaacagctttgcttcaaataaatcttactccatactgattccatgcatgctctattactggatactacctccgtcccaaattacaattcatatattaacttttctagatacatatattttactatacatctaaatgtacactatgtttagatatatagcaaaaatcatgtatctaaaaaagccaaaataaatagtaatttgggatggagtggtaaccataaaggaatcagaaagtggtggtgtctattacatttc

SEQ ID NO: 17758 - protein, 530 aa, Panicum virgatum
  misc_feature: Ceres CLONE 1794568
  misc_feature (59)..(225): Pfam Name: VWA Pfam Description: von Willebrand factor type A domain
  misc_feature: SWISSPROT Homolog: EC 6.6.1.1 Magnesium chelatase
MAFNDDDKPPTSNTGSTKGLVSIKPVKYFKDDAALTADTVTAEVEINATSSTTVREGLDLVAVLDVSGSMRGDKIASLKKAMTFVIMKLTPVDRLSIVTFSNDAARLTPLRSMTPAAQTELKAVVDGLAAGGWTNIQAGLETGLAVIAGRVNTKARTANIFLMSDGEQKPGDARQVDPGQVAIYTFGFGKDTNHLLMSDIAKRSPGGTFSSVPDGSTVTLPFSQLLAGLLTVVAQDVELTLTPKTDDGDVDTIVVAPGTDYKTTTDAATGVVTIAFGTLFAGEGRRVVITLTLKDVSATNNEEYDAPLAEAQHSYTAQGRPRDPQLPQDIQIRRTPTPSQAPGASSKARQVQAEIARRNHAEAIRQARLLADKGDPESLDEARYKLVDAQNALEDIVLDSLADGQKLVDSLRAELVQLIKLMETKELYEAQGRPYALASETSHGRQRYCARGGDEDSDVRLFATPRMDTYREQAKNFEKDPTAPVPTADEDVKKEVAANPLAAISNDLAYYLRNAIEALRAIERIIAPSA

SEQ ID NO: 17759 - DNA, 714 bp, Panicum virgatum
  misc_feature: Ceres CLONE 1794569
  misc_feature: Encodes the peptide sequence at SEQ ID NO. 17760
accactataccgcaactccacccaaaaccataaaaaccagtgcagcaacaatgagagataaaccttccagactctgaattttcagcatgttggcgccagcatcagcccaggtgcctcacaccatacgaccaattgcaaactgctttgggcttcatcgacgatctgtgctgaatttggaccgatatcacagatggcgggggactggaaagaagatgatcctttccactcgtggtgtgctcgaatccagcaatggtgcaccgtctggtggccttgtgaagaaaagaaagattgtggagcacattattctgcttcgagccaagccaaacatctcagacgctgaagagaaagatatgctggattatctatatacatcacaataccagatgagagggatactcacaatctcgttgggccgcatagaggagccaaatagcgagaactttacgcatgctgtcttcatgcgttttcagcagaaagaagacattgcgaagttccagagtagtgcctactattccaaaattcttgatgaccacgtaaaacctgtttcctatgtacgcctcagcatatttcgagtctgaggtggaagatgacattattcccctctttcgtaggggagaggtatctcaagctgccttattctgggcgcaaattggtaccattctttactatgtaaaatacccattgcatttcaacagaaaagctggtccttgtgtc

SEQ ID NO: 17760 - protein, 163 aa, Panicum virgatum
  misc_feature: Ceres CLONE 1794569
  misc_feature (69)..(163): Pfam Name: Dabb Pfam Description: Stress responsive A/B Barrel Domain
MLAPASAQVPHTIRPIANCFGLHRRSVLNLDRYHRWRGTGKKMILSTRGVLESSNGAPSGGLVKKRKIVEHIILLRAKPNISDAEEKDMLDYLYTSQYQMRGILTISLGRIEEPNSENFTHAVFMRFQQKEDIAKFQSSAYYSKILDDHVKPVSYVRLSIFRV

SEQ ID NO: 17761 - DNA, 649 bp, Panicum virgatum
  misc_feature: Ceres CLONE 1794569-R
aaactgtaatacatgcaaggttccttttggatcctagtgctaataggtgaaagtgatgctaagcactagctcatccaaatgggactgctaatggggtgagctaaactttagccaagactcaaaaactttagcgtatatacgagtgatatgtgctaaagtttagcactcaactttagatcatccaaatagatcctaagatagatgtttacctaccaaattacatgagctactgtttcagttttactctttgtttttgccatctccatagctgcttgattgtttgccttgtgagttgcagatgtgggcatcaaagttccatccgattgtggagaaatccctccagatacatttcaccgtcgaccccgtggggaaccagctgatgtagaccagtcatgcctcagcactcttcaccgatcttgctgggagttgaactccatctctgctcattctggttgaaaaggatggaagtgttttactgtagtttgcgcactccgtcccaaagtgtcactgcaaattgtgctccagctccacaacttgttgttcaatatatataaataggagaagcgtgcttcttaacagagaatgaacactgttttttatgaatggacctcgacagtcaactgataacttgatcgaagttatcggtatc

SEQ ID NO: 17762 - DNA, 1974 bp, Panicum virgatum
  misc_feature: Ceres CLONE 1794576
  misc_feature: Encodes the peptide sequence at SEQ ID NO. 17763
atgattcccggagcataactcccggccccatcctcccactcgccctgtcgcccaacccctgcaaccacacgcgcatcaccccacccccatggcgtccctcgacctcgccgagagcctcctccccggcggggccggggattccgccgccaccgcctcctccgactcgcacgacgagtacgagaagcgcgcctacgactctgacgacaaggtctccatctccatctcggactccgacgccgaagccgacggcggcggcgcggcgtcgcgcccgcccttctcgtggcggaagctctggcgcttcacgggaccgggcttcctcatgtgcatcgcgttcctgggcccgggaaacctggagggggacctgcaggcgggcgccgccgcggggtaccagctgctgtggctgctcctgtgggcgacggtcatgggcgcgctgattcagctgctctccgcgcggctcggggtggccacgaggaagcacctcgccgagctctgccgcgaggagtacccgccctgggccacgcgcgcgctctgggccatgaccgagctcgcgctcgtcggcgccgacatacaggaggtgattggcagcgcgattgccatcaagatcctgtcggggggcactgtgccgctctggggaggcgtcgtcatcaccgcgctcgattgcttcatctttctcttcctggagaattatggtgtgagaaaactggaagcattttttgctgtattaattgcaaccatggctctgtcatttgcggttatgtttggtgaaacgaagcctagtggaaaggaacttctgattggtttggtggttccaaagttgagctcaaagacaattaagcaggcggttggaattgtgggctgcatcatcatgcctcacaatgttttcttgcattcagcactagtgcagtccaggaagattgacacgaacaagaaatcccgtgttcaagaagcagtctactactacaacattgagtcaattcttgcactcattgtgtccttctttattaatatctgtgtcacaacggtttttgccaaaggattttatgggaccgaacaggctgataatataggtcttgagaatgctgggcagtacttacaggaaaagtatggaactgcattcttccccatcctctatatctgggctattggactgttagcatctggacagagtagcacaattactggcacatacgctggccaatttgttatgggaggttttctcaatcttcgattgaagaaatggctacgagcaatgattactcggagtttcgccataattccaactatgattgtggctctgttttttgatacagaagatcctacgatggatgttctgaatgaagcactcaatgttcttcagtccatacagattccatttgcactaattcctctcatcaccctcgtttcaaagcaacaggtcatggggtcattcgtagttggtcccatcaccaaagtgattagctggattgttacggtctttctgatgcttatcaatggatatcttatagtgtcattctacattactgatatccggggtgcagtgcttcgctcaagcttgtgtgttgtgctggttgtttaccttgcattcatcatctacctaattgtgcgaaatacttcgatgtattctcgcctttgctcatcaatgccaaagaggtcatgagtgtttcaacttgtcattcgccaccatgatggactggaatcgtggcctacaccagaagaaagttgccgctccatgtaaaagatggtaccgctgcccatttgtactcgctccagagaagtctttatctgcatatcccttgtattgtatttatgggatatctggtagtaggcttctcccttaggatggattaaggcaccggcgctctcatatttgagggtacacgcagtagatagatttatatttgtttcccatttatggagatgatcatggtgatgtgaacaacactattgacataatgacattgcctgattatgccc

SEQ ID NO: 17763 - protein, 522 aa, Panicum virgatum
  misc_feature: Ceres CLONE 1794576
  misc_feature (88)..(451): Pfam Name: Nramp Pfam Description: Natural resistance-associated macrophage protein
MASLDLAESLLPGGAGDSAATASSDSHDEYEKRAYDSDDKVSISISDSDAEADGGGAASRPPFSWRKLWRFTGPGFLMCIAFLGPGNLEGDLQAGAAAGYQLLWLLLWATVMGALIQLLSARLGVATRKHLAELCREEYPPWATRALWAMTELALVGADIQEVIGSAIAIKILSGGTVPLWGGVVITALDCFIFLFLENYGVRKLEAFFAVLIATMALSFAVMFGETKPSGKELLIGLVVPKLSSKTIKQAVGIVGCIIMPHNVFLHSALVQSRKIDTNKKSRVQEAVYYYNIESILALIVSFFINICVTTVFAKGFYGTEQADNIGLENAGQYLQEKYGTAFFPILYIWAIGLLASGQSSTITGTYAGQFVMGGFLNLRLKKWLRAMITRSFAIIPTMIVALFFDTEDPTMDVLNEALNVLQSIQIPFALIPLITLVSKQQVMGSFVVGPITKVISWIVTVFLMLINGYLIVSFYITDIRGAVLRSSLCVVLVVYLAFIIYLIVRNTSMYSRLCSSMPKRS

SEQ ID NO: 17764 - DNA, 704 bp, Panicum virgatum
  misc_feature: Ceres CLONE 1794586
  misc_feature: Encodes the peptide sequence at SEQ ID NO. 17765
accggacacagacaaatcatagtataaccttaattagcttgtgcgcactacacaagccacgtatatactgtacctctctagatggagtcgcagcgagatgatgtggcgatgaggtggtgcgtggtgaccggcggccgggggttcatggcgaggcacctggtggccgcgttgctccgctccggcgagtggcgcgtgcgggtcaccgacctcgcccccaccatcgtgctcggccccggcgagaatgagggcctcctcggtgacgccctgcgtgatggccgtgccgtctatgcctcggttgatgtttgcaacttggatcaagttatcaaagcttttgatggggtagatgttgtattccacactgctgctgcagatcctagcaagaacaacttgcaacttcattacaaggtcaacgtggagggtacaaagagcgtaattgatgcatgtaagatctgcaaggtgaaaaggcttatacacaccagttctagtgctgttgtgttcgacggagttcatgaacttttgaacgtgaatgaatcattgccatacccagataagtttcccgatgcatatgcacaaacaaaggcagaagcagagaagttagttatgaaggccaatggaaccaatgaccttctaacatgttgcatacgtcctagtagcatttttgggcctggtgatttgattttaccaactctggatcgatatggacg

SEQ ID NO: 17765 - protein, 207 aa, Panicum virgatum
  misc_feature: Ceres CLONE 1794586
  misc_feature (14)..(205): Pfam Name: 3Beta_HSD Pfam Description: 3-beta hydroxysteroid dehydrogenase/isomerase family
  misc_feature: SWISSPROT Homolog: EC 1.1.1.170 Sterol-4-alpha-carboxylate 3-dehydrogenase (decarboxylating)
MESQRDDVAMRWCVVTGGRGFMARHLVAALLRSGEWRVRVTDLAPTIVLGPGENEGLLGDALRDGRAVYASVDVCNLDQVIKAFDGVDVVFHTAAADPSKNNLQLHYKVNVEGTKSVIDACKICKVKRLIHTSSSAVVFDGVHELLNVNESLPYPDKFPDAYAQTKAEAEKLVMKANGTNDLLTCCIRPSSIFGPGDLILPTLDRYG

SEQ ID NO: 17766 - DNA, 718 bp, Panicum virgatum
  misc_feature: Ceres CLONE 1794590
  misc_feature: Encodes the peptide sequence at SEQ ID NO. 17767
acagaggccggccacctcccacccacccacgtattagcgcctcctccctcccgcgcgcgcgtgcgggagctgctgcgaccaggaccagcaggagagcatggagccgaggccgccctgccaccgccttcgccgcgccctctagccagccagctggccggccggccgacccagccctgtcggttccccgccatggcagccaccgtcctcgtcccgccggcgcactgccaccgcgccacggcggcggcggcgacgagcgccgccatctcgcattgtgccctccctcccgcgcgccggcgccggggatcgcgcgccgtgagggcggcggcggctcccgagcagagccagagcggcgtgtccctcgcgggagcctccggctccgggcacgggagcgcgggcgacgacgccaaggccgcgctgcgccgagccctggaaggcgcggacagagggatattcgggatgacgtccgtccggcggtcggaggtccaccgcctggtggagctgctcgaggcccgaaaccccacgccggagcccaccgccgagctgcgggagaaggtggacgggtgctggaagctcatctacagcaccatctccatcctggggaagaagaggaccaagctggggctcagggatttcatcagcctaggggacttcctccagataattgacgtcaaagaggtcagtcaaggctacctgcagtggaatcgtcgtgctgacggct

SEQ ID NO: 17767 - protein, 176 aa, Panicum virgatum
  misc_feature: Ceres CLONE 1794590
  misc_feature (70)..(176): Pfam Name: PAP_fibrillin Pfam Description: PAP_fibrillin
MAATVLVPPAHCHRATAAAATSAAISHCALPPARRRRGSRAVRAAAAPEQSQSGVSLAGASGSGHGSAGDDAKAALRRALEGADRGIFGMTSVRRSEVHRLVELLEARNPTPEPTAELREKVDGCWKLIYSTISILGKKRTKLGLRDFISLGDFLQIIDVKEVSQGYLQWNRRADG

SEQ ID NO: 17768 - DNA, 731 bp, Panicum virgatum
  misc_feature: Ceres CLONE 1794593
  misc_feature: Encodes the peptide sequence at SEQ ID NO. 17769
aaattctctttcccccatctcttcttctccacagtccacactgttcacctcgtctcccccctctcctcgatccccaaatcccgaattgaccagcccaaatcggcgcccgcatggagtggacggccccgaagcccgccgcttcgccctcctcgcctcccctgctctgggactggggcaaccacgccgccgcgggctcgggctgctccggcgacgcgccagcgcggcgcggcgggaaggagcgggaggcgaagcgtaccaagggcgaggaaggcgggggagcggaagttaggtgccaggtcgaggggtgcgggctggagctcggcacggccaaggactaccaccggaagcaccgcgtctgcgaggcccacaccaagtgcccccgcgtcgtcgtcgccggccaggagcgccgcttctgccagcagtgcagcaggttccatgctctgtccgagtttgatcagaagaagaggagctgcaggaggcgtctgtctgatcacaatgcccgccggcggaagcctcagccagatgcatacgcctttgcctctgcgaggctgccttcatcattgtttgatgataggcggcaaataagttttgtctggaatagagctcctcttagccatgtaagacctttcacttctccatgtgacagctcatctgacttcaagctctcacatgccaaagaaataagtgagctatcaacaaaagttgggacgataactggacaagttcatttt

SEQ ID NO: 17769 - protein, 206 aa, Panicum virgatum
  misc_feature: Ceres CLONE 1794593
  misc_feature (60)..(138): Pfam Name: SBP Pfam Description: SBP domain
  misc_feature: Functional homolog of the protein sequence given in SEQ ID NO 50782
  misc_feature: Useful for making plants with altered terpenoid content
  misc_feature: Useful for making plants with modulated flowering time
MEWTAPKPAASPSSPPLLWDWGNHAAAGSGCSGDAPARRGGKEREAKRTKGEEGGGAEVRCQVEGCGLELGTAKDYHRKHRVCEAHTKCPRVVVAGQERRFCQQCSRFHALSEFDQKKRSCRRRLSDHNARRRKPQPDAYAFASARLPSSLFDDRRQISFVWNRAPLSHVRPFTSPCDSSSDFKLSHAKEISELSTKVGTITGQVH

SEQ ID NO: 17770 - DNA, 703 bp, Panicum virgatum
  misc_feature: Ceres CLONE 1794604
  misc_feature: Encodes the peptide sequence at SEQ ID NO. 17771
caattcagcagcagcagcagcagcagcacgaggcgcctctgcgaattccgacagcgagagcgggaagaggaaactcgaaacccggcgagcggcatggccaccggcgaggagcacgtggcggcggcggcggcggcggcggcggtcgatgagacgccggagaagaaggaggccggcgtaaccgagctccccgcgccctccggctggacgaagaagcttgccccaattagaggtggaaagtttgaggttatttttgtttccccaactggtgaggagatcaagaccaagagacagctgacccagtacctgaaagctcatcctggaggccctgcatcttcggagttcgattgggaaaccagtgatactcctagacgatcagcacgcataagcgagaaagtcaaggcaactgagagcccagaaggtgagaagaccccaaaacgtggaagatcaagctctaagaggggcaaaaaggagaaaaaagaagatgcagatgcagtggatgccaatgaaactgtagaccgtggcactttggaaggcattgatgtggagatgaaggatgctgaaaacgccatagaagagaagaaagaggaggtccccagtgcagatattgacgagaagactgaaggagttgaagagaagaaagaggaggcccctggtgcagatgccacagagaagactgaacaaggcgctgaaggccaggagcagg

SEQ ID NO: 17771 - protein, 203 aa, Panicum virgatum
  misc_feature: Ceres CLONE 1794604
  misc_feature (23)..(93): Pfam Name: MBD Pfam Description: Methyl-CpG binding domain
  misc_feature: Functional homolog of the protein sequence given in SEQ ID NO 50783
  misc_feature: Useful for making plants with modulated drought sensitivity
MATGEEHVAAAAAAAAVDETPEKKEAGVTELPAPSGWTKKLAPIRGGKFEVIFVSPTGEEIKTKRQLTQYLKAHPGGPASSEFDWETSDTPRRSARISEKVKATESPEGEKTPKRGRSSSKRGKKEKKEDADAVDANETVDRGTLEGIDVEMKDAENAIEEKKEEVPSADIDEKTEGVEEKKEEAPGADATEKTEQGAEGQEQ

SEQ ID NO: 17772 - DNA, 720 bp, Panicum virgatum
  misc_feature: Ceres CLONE 1794614
  misc_feature: Encodes the peptide sequence at SEQ ID NO. 17773
agacagcaaccaccaggagagagaaggggaagggcggcgagggaggcctccgtctcgtgtcccttcctcctcctctcctctctctccgattctccatccatctattcccctcgcgcggtcgcattgttcttgatccgatccggttccggcctcgccgaagaacaaggttggaaggaagagaaaaataaaggctagggatccatgggatgcttttcatgctgctccgtggcagacgacgatgttggcaggaggaagaaagacgatgactatgtccctatccctgctcaagtcagtaacaatggacctagccgtcccccagccccaacctatgccacccccacaggaagagctcagccaattgcagtgccggccattcccctggaagagatgaaggaaatcacaaagaacttcagcaatgatgctcttatcggagagggctcgtacgccagagtctactttggggttctcaaagacggcacaaaatctgcagtgaagaagcttgactccagcaaacagcctgatcaagaattccttgtgcaggtttcagccgtctcaagactgaagcatgagaatgttcttcaacttgtcggattctgtgctgaaggaaacatccgagttcttgcttacgagtatgcaacaaggggctcattgcatgatatcctccatgggaaaaagggtgtcaagggagcccagccagggccacccctgtcatggatgcag

SEQ ID NO: 17773 - protein, 172 aa, Panicum virgatum
  misc_feature: Ceres CLONE 1794614
  misc_feature: SWISSPROT Homolog: EC 2.7.11.1 Non-specific serine/threonine protein kinase
MGCFSCCSVADDDVGRRKKDDDYVPIPAQVSNNGPSRPPAPTYATPTGRAQPIAVPAIPLEEMKEITKNFSNDALIGEGSYARVYFGVLKDGTKSAVKKLDSSKQPDQEFLVQVSAVSRLKHENVLQLVGFCAEGNIRVLAYEYATRGSLHDILHGKKGVKGAQPGPPLSWM

SEQ ID NO: 17774 - DNA, 725 bp, Panicum virgatum
  misc_feature: Ceres CLONE 1794626
  misc_feature: Encodes the peptide sequence at SEQ ID NO. 17775
acccaccccatccaaggcatcagccatggcgccgctctcgatgtccacctcccacctcctcatcaccgcctccctcccaaagcccaagccttcctccctccgcccgccgcgcctccctctcgccaagcccctccccgcgacgctcctcgctctcgccgcggcgcccgcccttgccgctgatgcgccggcgcctccccaggccccggcccccgcgcccgcgcccgagctccaggccgaggcccccaccccgaccgccaacccctttgccaactccctcctcacggcccccaagccctccgcctccgccgacctccccgagggcgcgcagtggcgctacagcgagttcctctccgccgtcaagcgtggtaaggtcgagcgcgtccgcttctccaaggacggcgggctgctccagctcaccgccgtcgacggccgccgcgccaccgtcgtcgtccccaacgaccccgacctcatcgacatcctcgccactaacggcgtcgacatctccgtctccgagggcgaggccgccgggcccggggggttcctcgccttcgtcggcaacctcctattccccttcatcgccttcgcggggctcttcttcctcttccgccgcgcgcagggcgggccgggcgcgggccccggcgggctcggcgggcccatggactttggacgctccaagagcaagttccaggaggtgcctgagaccggagtaactttcctcgacgtcg

SEQ ID NO: 17775 - protein, 233 aa, Panicum virgatum
  misc_feature: Ceres CLONE 1794626
  misc_feature (100)..(233): Pfam Name: FtsH_ext Pfam Description: FtsH Extracellular
MAPLSMSTSHLLITASLPKPKPSSLRPPRLPLAKPLPATLLALAAAPALAADAPAPPQAPAPAPAPELQAEAPTPTANPFANSLLTAPKPSASADLPEGAQWRYSEFLSAVKRGKVERVRFSKDGGLLQLTAVDGRRATVVVPNDPDLIDILATNGVDISVSEGEAAGPGGFLAFVGNLLFPFIAFAGLFFLFRRAQGGPGAGPGGLGGPMDFGRSKSKFQEVPETGVTFLDV

SEQ ID NO: 17776 - DNA, 689 bp, Panicum virgatum
  misc_feature: Ceres CLONE 1794654
  misc_feature: Encodes the peptide sequence at SEQ ID NO. 17777
gtctcaatccctcaccagtcaccccccccccctccacttcctcctccccagaccccagcctctgctcgtgccgccgccggccatggcctgcctcaccgacctcgtcaacctcaacctctcggacaccacggagaagatcatcgccgagtacatatggatcggtggatctggcatggatctcaggagcaaggccaggaccctctccggaccggtgaccgatcccagcaagctgcccaagtggaactacgacggctccagcaccggccaggcccccggcgaggacagcgaggtcatcctgtacccgcaggctatcttcaaggacccattcaggaagggcaacaacatccttgtcatgtgcgattgctacaccccagctggcgagccaattcccactaacaagaggcacagcgccgccaagatcttcagcaaccctgaggttgccgctgaggagccctggtatggtattgaacaggagtacaccctccttcagaaggacaccaactggccccttgggtggcctgttggtggcttccctggccctcagggtccttactactgcggtatcggcgccgacaagtctttcgggcgcgacatagttgactcacactacaaggcttgcctgtatgccggtatcaacatcagtggcatcaacggggaggtcatgccaggacagtgggagttccagttgg

SEQ ID NO: 17777 - protein, 202 aa, Panicum virgatum
  misc_feature: Ceres CLONE 1794654
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MACLTDLVNLNLSDTTEKIIAEYIWIGGSGMDLRSKARTLSGPVTDPSKLPKWNYDGSSTGQAPGEDSEVILYPQAIFKDPFRKGNNILVMCDCYTPAGEPIPTNKRHSAAKIFSNPEVAAEEPWYGIEQEYTLLQKDTNWPLGWPVGGFPGPQGPYYCGIGADKSFGRDIVDSHYKACLYAGINISGINGEVMPGQWEFQL

SEQ ID NO: 17778 - DNA, 2464 bp, Panicum virgatum
  misc_feature: Ceres CLONE 1794659
  misc_feature: Encodes the peptide sequence at SEQ ID NO. 17779
caaaaataaaatccaaacagtctagggttttgcgtactagttatgcccaggccgcgacgcgacgcgccgccccttccccttcttcccctgcgcctcgcccgccgacttcgtccccaccccctcgcggcggcgagccggagcgtctcggctgttgccgcccggggcccgcggagctccgtcgccttggcgccatccgccccgcgggccgtggaggcggctccatcggctttggcggcggccgtggcggcggaaccggaaccctagcggctgacgagagactgactaggagttcatcgaagtaaattgttcatcagtttgttcttaatataaataagtgagcctacatggctatggtcccaagtgattcatcacataatggagttgtggacaatagccccaatggcaggaccctgggtaggcgtgaggaagccaggaaacttggcccgtcatggtatttcagtagaaaggaaatagaagaaaattctccatccaggagggatggcattgatttgaagagagagaatggccttcgaaagtcgtattgcaattttctacaagagttgggcatgaagcttaaagtgcctcaagtgtccattgctacagctatggtattctgtcatcgtttttaccttcgccaatcccttgcaaaaaatgatagacggataattgccacagtttgtatgttcttggctggaaaagttgaagaaacacctagaccattgaaggatgtcattgtggtttcttacgagcttattcataagaaggatcctaatgctgttcagagaatcaagcagcagaaggaaatatacgataaacaaaaagaacttattttacttggggagcgagttgtacttgtaacacttgggtttgacctgaatattcatcatgcttacaagcccttggttgaagcaataaggaaattcaaagttgttcaaaaaagtgcacttcctcaggttgcctggaatttcgtaaatgatgggctgcgtacttcgctttgcctgcaattcgagcctcatcatattgcagcaggtgctatctttttggctgctaaatttctcaaaatgaagcttccagctgagggtgataaagtttggtggcaggattttgatgtcacgccacgtcagcttgaagaggtaaacaatcaaatgttggagttgtatgagcaaaaccgtacaccacaggcacaaccatcacagggaagtgaagctgaagggtgttctgctggtgtgcgcaatcaacattcatctgtaaaatctgaaggaaactccaaggaaccatctgccaaactgtcaaatttgccgcattcttccttgacaggtgctccaggtcaccatgatgctggacacttgaattcagacaagcatatttctggctataaaatgcttcaaaacgacaatggtaaccatggtggcagcaaagataggagcagcaagagtggaagtaaatctgatgctggtatggacaggtcgcatcatgacaaaaaatcctccccaggacatcattattccaagtccagtcgtgagttctgtaatcaaatggaagaacaaaagccacatcgatcacatgataattctaatgaaacaagacacggtgttcttggtggcaatgaagctcctggtgtgtcatcatcaaggatggatgcgatgaataaaattgacaaggataaggtaaaagcagcattggagaagcgaagaaaatcaaaaggtggagttgctgcaaatgtaaatgtgatggatgatgatgatctacttgagagagagctagaacatggtgttgaactggctgttgaggacgagaagatcaagcaggaagagcagactttgtcccatgatagcatgcctccagcggatcttcaacatgttgaccatgtaatggagaatggttaccatggtgagaagagcgtgccaacgactgctgaagatggggagtttccaagggacagtaaagaacaacaccctcaatcatttgataaacgaaccgatggttctgagcacaagtcccagcaggttgatcacacattgaagcacaagggccacgatgatgctctgcttgctggaagacatgagcaggatggacgagacaactttaaaaggcctaagcttgaaggcgtagttgataatgaagtgtgattgtggaccagtttgcttgaaacgggtaactacatgcaatttggcacggaattcattatatgatacacatgttcctgggcatgtgttcaccagtgcctgaggatgttgcattgggatgctaaaactgccgtgctgtggaacatcaagatgtccatagtttttgtgcgtatttgcccccccgtaactgatggcagtttaaaactgttcctagatctgcaccatggagcatcttgaaagccgtgctagcaataccaatgttccaacgaacattggaatatatgcactgaaacacacgataacaattgcattcatttcttcgatgtgatgtttcagtt

SEQ ID NO: 17779 - protein, 594 aa, Panicum virgatum
  misc_feature: Ceres CLONE 1794659
  misc_feature (34)..(178): Pfam Name: Cyclin_N Pfam Description: Cyclin, N-terminal domain
MAMVPSDSSHNGVVDNSPNGRTLGRREEARKLGPSWYFSRKEIEENSPSRRDGIDLKRENGLRKSYCNFLQELGMKLKVPQVSIATAMVFCHRFYLRQSLAKNDRRIIATVCMFLAGKVEETPRPLKDVIVVSYELIHKKDPNAVQRIKQQKEIYDKQKELILLGERVVLVTLGFDLNIHHAYKPLVEAIRKFKVVQKSALPQVAWNFVNDGLRTSLCLQFEPHHIAAGAIFLAAKFLKMKLPAEGDKVWWQDFDVTPRQLEEVNNQMLELYEQNRTPQAQPSQGSEAEGCSAGVRNQHSSVKSEGNSKEPSAKLSNLPHSSLTGAPGHHDAGHLNSDKHISGYKMLQNDNGNHGGSKDRSSKSGSKSDAGMDRSHHDKKSSPGHHYSKSSREFCNQMEEQKPHRSHDNSNETRHGVLGGNEAPGVSSSRMDAMNKIDKDKVKAALEKRRKSKGGVAANVNVMDDDDLLERELEHGVELAVEDEKIKQEEQTLSHDSMPPADLQHVDHVMENGYHGEKSVPTTAEDGEFPRDSKEQHPQSFDKRTDGSEHKSQQVDHTLKHKGHDDALLAGRHEQDGRDNFKRPKLEGVVDNEV

SEQ ID NO: 17780 - DNA, 704 bp, Panicum virgatum
  misc_feature: Ceres CLONE 1794660
  misc_feature: Encodes the peptide sequence at SEQ ID NO. 17781
gtccagctccgtaaccaccggacagagcagagcacgctccatgaggaccaccaccaccaccaggaccgcgctgccgctcctggcgctggctgcggcgctctgcctcagcctcgcgctgctgctccccggcgcggccgcggcgaacaaggcccggccccggccgcggcagggtgactacctgaagcgcctgcgccggtcgccggcgtccgcgcgccagtcgctggcggtcgcgctgccgtcgccgccgacggccagagcgcagcggcacgcggcgccggtcgtggccgggcgcaaggaggacgaccgcgtggaccggctgccggggcagcccgagggcgtggacttcgcgcagtacgccggatacgtgacggtggacgcggcggccgggcgcgcgctgttctactacctcgccgaggccgccggcaacgtgccggcggcgtcgcggccgctgctcctgtggctgaacggcgggcccgggtgctcgtcgctggggtacggcgccatggaggagctgggcccgttccgcgtgaagagcgacggcaagacgctgtaccggaacccgtacgcgtggaacaacgcggcgaacgtgctgttcctggagagccccgccggcgtggggttctcctactccaacacgacggcggactacagccggttcggcgataacaagaccgccgaggacgcgctcctgttcctgctcaact

SEQ ID NO: 17781 - protein, 221 aa, Panicum virgatum
  misc_feature: Ceres CLONE 1794660
  misc_feature (94)..(221): Pfam Name: Peptidase_S10 Pfam Description: Serine carboxypeptidase
  misc_feature: SWISSPROT Homolog: EC 3.4.16.6 Carboxypeptidase D
MRTTTTTRTALPLLALAAALCLSLALLLPGAAAANKARPRPRQGDYLKRLRRSPASARQSLAVALPSPPTARAQRHAAPVVAGRKEDDRVDRLPGQPEGVDFAQYAGYVTVDAAAGRALFYYLAEAAGNVPAASRPLLLWLNGGPGCSSLGYGAMEELGPFRVKSDGKTLYRNPYAWNNAANVLFLESPAGVGFSYSNTTADYSRFGDNKTAEDALLFLLN

SEQ ID NO: 17782 - DNA, 649 bp, Panicum virgatum
  misc_feature: Ceres CLONE 1794660-R
  misc_feature: Encodes the peptide sequence at SEQ ID NO. 17783
acgtcacccgcctcgaccacccctggtcagcctgcagtgaggtcttgaggcgctggacagacagcgccacaacggtcttgcctatcatcacggagctcctgaacaacaacatcagggtctgggtgtacagcggtgacaccgatgggagagtgccggtcacttccagcagatactctgtcaaccagctccagctcccagttgctgcaaaatggaggccatggttcagcagcactcagggaactggagaggtgggtggctacgttgtggagtacaagggcaaggcgaagggcagcctcagcctggcaaccgtgagaggagccggccatgaggtccccagctaccagccgaagcgagcgctggtgctcgttcagagtttccttgcaggcaaaccgctccctgactgcaagaagtgcgaacagtcttagcattctgaagtataaagagtgcatcagcagcaacacgatatgtatccattccattcagcatgagagaagaaagagaaaaataatcatgttagacgatagaaatatacccacctcctagatcatgtaactgcaggtctgcaaagacttatatagtcacatagagaaatctctacacaaatgaaacctatcaaatctgaaaagtaaccaccagaaagttacgatac

SEQ ID NO: 17783 - protein, 140 aa, Panicum virgatum
  misc_feature: Ceres CLONE 1794660-R
  misc_feature (1)..(128): Pfam Name: Peptidase_S10 Pfam Description: Serine carboxypeptidase
  misc_feature: SWISSPROT Homolog: EC 3.4.16.6 Carboxypeptidase D
VTRLDHPWSACSEVLRRWTDSATTVLPIITELLNNNIRVWVYSGDTDGRVPVTSSRYSVNQLQLPVAAKWRPWFSSTQGTGEVGGYVVEYKGKAKGSLSLATVRGAGHEVPSYQPKRALVLVQSFLAGKPLPDCKKCEQS

SEQ ID NO: 17784 - DNA, 1592 bp, Panicum virgatum
  misc_feature: Ceres CLONE 1794669
  misc_feature: Encodes the peptide sequence at SEQ ID NO. 17785
ggcggggtgcggtcaaacacaccgacttcggctcacatatccgcgccggcacggcggtgcagcaccgcgccaccgcctctcggagaatcgaagccgtctgggcggggcgcgatggatctgctgaagcgggagctggagaagaagcggaaggcggcgtcggccgacttcggcgggaagagcttcgtgcggcggtcggagctggagcagaagcagctccagaagcgccgcgacgagcaacgccagctcctcgccaaggccggcgcatctgcgccgccccccgattccgccgcaggcgcagcgggctccgaccccagcaaccccgacgccgcggcccaggcggcggcggggaaccctaaccctagctcctccacctccgcggcggcggcctccgtcccgcccgccctcgcgccgaagaagaccacgcaggaggaggcgctgctatccgaggagcgccgcatcgacgagctcgacctcccgcggcacgaggtggtgcggcgcctccgcgtgctgcgcgagcccgtcacgctcttcggggaggacgacgacgcccgcctcgcgcgcttcaagctcattctcaagtccggcgtcatagatgacatcgatgacatcgacatgaccgaggggcagaccaacgacttcctccgcgacatgatcgagatgcgcaagcggcaaaagtcagggagggatacctacgccaagggcaaggggaagcgggtcggtggcggtgatggtggtgacggaggacctgctggggacagtgcagatgatggggacggcaagggtagcggggatgatgccgaagcagacaaggactccaagaggatgaggaccaagtttaaggagctttgcaacgaagacaagattttggtgttcttcaagaagctgcttaacgagtggaaccaggagctggatgagatgtcagagctggagaagcggactgcaaaagggaagtcaatggttgcaacatttaagcagtgtgcgcggtatctcagccccctgttcgagttctgcaggaagaaggttcttcctgatgacatccgtcaagcattgctcgttattgttgaatgctgtatgaagcgtgactatttagcagcaatggaccaatacatcaagctggccattgagaacgcaccatggcccattggagtcactatggttggtatccatgagcgttctgcccgtgaaaagatctacacaaacagtgttgcccatatcatgaatgacgagaccactcgcaagtaccttcagtcgatcaagaggctaatgaccctttgccagcggcgttatcctgcgctaccctcgaaatcagtggagttcaacagcctggcaaatggaagtgacctgcaggcgcttttatcggaggagaatggttcgggaaaagcttctgaggaaaggctccggttgatgcctgcatcgaaagagtgatgctttgatacgctagcttggatcaaaaatatagttagagatgtttgtgtaatatcaacctcagttttcccctgccatttctttttctgtattgttccaatgaagggaacagcagcggaattatggatgttaatgaagttacttaaaaatatatcatgtttaccact

SEQ ID NO: 17785 - protein, 437 aa, Panicum virgatum
  misc_feature: Ceres CLONE 1794669
  misc_feature (251)..(395): Pfam Name: Prp18 Pfam Description: Prp18 domain
  misc_feature (126)..(155): Pfam Name: PRP4 Pfam Description: pre-mRNA processing factor 4 (PRP4) like
MDLLKRELEKKRKAASADFGGKSFVRRSELEQKQLQKRRDEQRQLLAKAGASAPPPDSAAGAAGSDPSNPDAAAQAAAGNPNPSSSTSAAAASVPPALAPKKTTQEEALLSEERRIDELDLPRHEVVRRLRVLREPVTLFGEDDDARLARFKLILKSGVIDDIDDIDMTEGQTNDFLRDMIEMRKRQKSGRDTYAKGKGKRVGGGDGGDGGPAGDSADDGDGKGSGDDAEADKDSKRMRTKFKELCNEDKILVFFKKLLNEWNQELDEMSELEKRTAKGKSMVATFKQCARYLSPLFEFCRKKVLPDDIRQALLVIVECCMKRDYLAAMDQYIKLAIENAPWPIGVTMVGIHERSAREKIYTNSVAHIMNDETTRKYLQSIKRLMTLCQRRYPALPSKSVEFNSLANGSDLQALLSEENGSGKASEERLRLMPASKE

SEQ ID NO: 17786 - DNA, 2426 bp, Panicum virgatum
  misc_feature: Ceres CLONE 1794674
  misc_feature: Encodes the peptide sequence at SEQ ID NO. 17787
gcactccgcccactcgagcctggcgcgtgtcgccgcgtcgtcgtcttcgttctgagctcttctgtctccccaaccaaatctctcccaggtgctgctgcgcagctgaagaattccatccccaattgcgtctccacttccaccaccgcttaccgaatcccttagtccgccgcccttattctctgtcccaaagcagccgccgcttcccgccacttggacgcgcgccctcgtgatcccgaccgaccgagcgagggaggcgagctcgccgtctcggtctcaggttgcgccgtgcggcgtgcggccgtgctgcttgtttcgctctctaggagcgaggggtggagagagagggggtcttcgcgctttcttgcggggctgtccggctgtgggtcaaaagcgcggcgctttccgctccaccttcccacagcggaatcaaatctctcaactcccttcgatggcccctgattcggttcgtggtatcggggcatgagcttgctcagagagatcccccttttggtttggcgtcagggcgctgggtggtagcgcggtgtctttcttggtgcgtttcacatgtctgagacctttgatttctctccacttcgtgagtgattctgcagctgccgctgctgctgttaggtgtccgcggcccgcgggtcgtgatggggtgaacggaagcgttcgtcgcagggctgggttattacgcctgtgagcctgtctgcttccccgcaccttgttcttgtgcccatacttcttgcttttgtcacgcctgaaccgtgtcttcttgcagtacctgaggcttgacaattggcaagtaccaagtagctacctgtgtttacataagataaaccatttctggttccaaagcacaaggtgtactgtgtgccaatatttgatacacagtttctgcttcttgctgaggtgatactcttggcttgctctgttgatgcggctgccatgaaccacgggatgttgaattctgtcaaggtggagagccgatcatcggcagtcactgccaatggccagcctaagccaatggatgcgctccatgatggcggcccacctccgttcctcaccaagacatacgacatggttgatgacccaaccacagatgctgttgtgtcgtggagcgccaccaacaatagcttcatagtttgggatcctcatatctttgggacagtgctgctgccaaggtacttcaagcacaacaacttctccagcttcgttcggcagctgaacacttatggcttcagaaaggtggatcctgacagatgggaatttgctaatgagggctttctgaggggtcagaggcacctgctcaaaaacattaggcgtcggaaacctccacactcatctccaaatcagcaatctcttggctcttatcttgaggtagggcactttggatatgatgaagagattgatcagctgaagagggacaagcagctgttgatggctgaagtagtgaaactgaggcaggagcagcaaaatacaaagtcggatctacaggccatggaagagaaattaaaagatacggagcagaagcaacagcagatgatggcattcatggcacgagtaatgcagaaccctgagttcatgcatcaactgatatcccagcgcgagatgaggaaggggctggaggatgccatctcaaagaaaagaaggcgccgcattgatcagggacctgaagctgatagcatgggcaatggttctagtctggaacaagggtcgcaggcagtgtttgaaccacaggagccggtggaatcacatgccaacggtgttccatctgatctggaaagttcatctgttgaggcaaagggatttgaggttcaacaaggtgtttcttccggtggctctgagcatctgaaacgcaggccaagtggtgagttaaatgatgatttctgggaggaccttttgcatgaggggggacttggtgcagaggctggtaatgcagttggtcaggatgacatgaacatgtagcctcggaaggtagcatacctcaaagaaaacagcataaacacagacattagcagctcttgttttatcacaatggctcggggtatattaccatccattatgcatgttatatcagtgttctagacctgattggatctccttcggtctatgaaatgctatatcgatcacaattggtaatacctggatgcagaatggaagtacctggattaatatgttgctatggtcttttctcaagggtcctggctgaccctgttgccgtcactgtttgaacagagaccatggtcatgttgctgtcaggctagtgtttcggttttaactaatggtagggtacaaccgagtggcctggcttgtatagcttgtatatgtaaagtgttccttctatttctgctgatctgtagtgacctgttatgtaagaaactattacacctcggaatttatcatttcactgtacattgcatcat

SEQ ID NO: 17787 - protein, 339 aa, Panicum virgatum
  misc_feature: Ceres CLONE 1794674
  misc_feature (36)..(203): Pfam Name: HSF_DNA-bind Pfam Description: HSF-type DNA-binding
  misc_feature: The sequence is a functional homolog of SEQ ID NO 1685 in the 10/412,699 US patent application
  misc_feature: The sequence is a functional homolog of SEQ ID NO 1687 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1686 in the 10/412,699 US patent application
  misc_feature: Functional homolog of the protein sequence given in SEQ ID NO 50697
  misc_feature: Useful for making plants with modulated biomass
  misc_feature: Useful for making plants with modulated heat sensitivity
  misc_feature: The sequence is a functional homolog of SEQ ID NO 142 in the 10/666,642 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 1688 in the 10/412,699 US patent application
  misc_feature: The sequence is a functional homolog of SEQ ID NO 378 in the 10/374,780 US patent application
  misc_feature: The sequence is a functional homolog of SEQ ID NO 80 in the 10/225,066 US patent application
  misc_feature: The sequence is a functional homolog of SEQ ID NO 950 in the 10/412,699 US patent application
  misc_feature: The sequence is a functional homolog of SEQ ID NO 404 in the 11/479,226 US patent application
  misc_feature: The sequence is a functional homolog of SEQ ID NO 832 in the 11/435,388 US patent application
MNHGMLNSVKVESRSSAVTANGQPKPMDALHDGGPPPFLTKTYDMVDDPTTDAVVSWSATNNSFIVWDPHIFGTVLLPRYFKHNNFSSFVRQLNTYGFRKVDPDRWEFANEGFLRGQRHLLKNIRRRKPPHSSPNQQSLGSYLEVGHFGYDEEIDQLKRDKQLLMAEVVKLRQEQQNTKSDLQAMEEKLKDTEQKQQQMMAFMARVMQNPEFMHQLISQREMRKGLEDAISKKRRRRIDQGPEADSMGNGSSLEQGSQAVFEPQEPVESHANGVPSDLESSSVEAKGFEVQQGVSSGGSEHLKRRPSGELNDDFWEDLLHEGGLGAEAGNAVGQDDMNM

SEQ ID NO: 17788 - DNA, 1632 bp, Panicum virgatum
  misc_feature: Ceres CLONE 1794676
  misc_feature: Encodes the peptide sequence at SEQ ID NO. 17789
ggcacatccaaagctcccctccaccgatcttctcgtcgcgctcgcctccgattcgatccggttcttccaacccgcggtgagtcgcccccccccccctccgatcgcgagcttgcttccggatccgccgctgtcgggctccaggctcgagtctgatccccgcggcgccgggttttctctcggtgcgtgcgtgcagggagtgatggcgaccaagaggagcgtgggcaccctcggggaggcggatctgaaggggaagaaggtgttcgtgcgcgccgacctcaacgtgccgctcgacgacgcccagaagatcaccgacgacactcgcatccgcgcgtccgtccccaccatcaagttcctcctcgagaagggcgccaaggtcgtcctcgccagccacctgggtcgtccaaaaggtgtcaccccgaagtacagcttgaagcctcttgttccacgcttgtctgagctccttggtgtcgatgtggtgatggccaatgattgcattggtgaggaggttgagaaattagctgctgctttgccggaaggtggagttctgctccttgagaatgtcagattctacaaggaggaagaaaagaatgaccccgagtttgctaagaagctagcatctgttgctgacctttatgtaaatgacgcttttggcacggctcacagagcccatgcttcaacagaaggagttaccaagtttttgaagcctgctgttgctggtttcctcatgcagaaggaacttgactatcttgttggagctgttgccaacccaaagaagccatttgctgccattgttggtggatcaaaggtctccaccaagattggggtcattgagtctctgctggcgaaggtcgatatcctcattcttggtggtggtatgatctacacattctacaaggcacagggatatgctgttggaaagtctcttgtcgaggaagacaaacttgagcttgcaacctcacttattgaaaaggcgaaggcaaagggtgtttctcttttgcttcccactgatattgtagtagctgacaagtttgcacccaatgctgagagcaagattgttccagccactgctatccctgatgattggatgggtcttgatattggccctgatgccatcaaaaccttcaatgctgcgttggacaccacccagactattatttggaacggtccgatgggcgtgtttgagtttgagaagtttgctgcaggcactgatgccattgcgaagaagttggctgagctcacaacctcaaagggtgtcaccaccatcattggaggtggtgactctgttgctgctgttgagaaggctgggctggctgacaagatgagccacatttctaccggtggtggtgcgagcttggagctgttggaaggcaagccgctcccaggtgtccttgcccttgacgatgcgtaagctatggagctaagtcagctgcccttgtcagccttggtgtcattttgttttggaccatggtgtaacattgaaagttatggacatgagatagaggcttgtcatcgtgttttgctagatgagtcgagaataagtttagacttccttgctggtgcgagtgaagtgatcggaatttggaaaattggaactaacaaactcccatggatgtgtatgatattttgttttgc

SEQ ID NO: 17789 - protein, 402 aa, Panicum virgatum
  misc_feature: Ceres CLONE 1794676
  misc_feature (3)..(399): Pfam Name: PGK Pfam Description: Phosphoglycerate kinase
  misc_feature: SWISSPROT Homolog: EC 2.7.2.3 Phosphoglycerate kinase
MATKRSVGTLGEADLKGKKVFVRADLNVPLDDAQKITDDTRIRASVPTIKFLLEKGAKVVLASHLGRPKGVTPKYSLKPLVPRLSELLGVDVVMANDCIGEEVEKLAAALPEGGVLLLENVRFYKEEEKNDPEFAKKLASVADLYVNDAFGTAHRAHASTEGVTKFLKPAVAGFLMQKELDYLVGAVANPKKPFAAIVGGSKVSTKIGVIESLLAKVDILILGGGMIYTFYKAQGYAVGKSLVEEDKLELATSLIEKAKAKGVSLLLPTDIVVADKFAPNAESKIVPATAIPDDWMGLDIGPDAIKTFNAALDTTQTIIWNGPMGVFEFEKFAAGTDAIAKKLAELTTSKGVTTIIGGGDSVAAVEKAGLADKMSHISTGGGASLELLEGKPLPGVLALDDA

SEQ ID NO: 17790 - DNA, 2396 bp, Panicum virgatum
  misc_feature: Ceres CLONE 1794680
  misc_feature: Encodes the peptide sequence at SEQ ID NO. 17791
aatggaatctcccaatttcttaaggacttcgatctcctgcaacaactttttttttacctcacggtgttcttgtttatagtccagttgtacccgatgtctccagctaacctccattcatatcttgatgctgagcggtgtttcttttggaagcaattgggcaccgctcggcagccaattttttcttgacattttctgtctagtttttttttggcaattttttgttttagattgtaccaataggttgaagcaaacctttgatctgatatctttgcaaataacctgacactctcttgatttttaaagaccttttggatcgatacaggcgcacctacctcgcccagctccgatcttgttgctttccatatagcttaggattcaagaaaccccaaatctgtgcttggagcatccaccacccagattcagcatggagagattcggcaaaacccggtgaggaatccgagctttaccgcgcaatctccctaccggccattggagatctcgcgcgggagcacgagcgaccaagaaaatgtcgccgcagccgccccccgacctcgccgaggacaaggagagggagacaaatgtcctcatcgaggcggccccggggtcgccggcgaaggcggctgaggacgacggcgccggcaggcagctgtcgccggccgcgtggctccggatgctggccagggagctgcactggagcttcgtgctcggcgtggcggccacgtacggcgtcagccaggggctcgggggcggcatcagccgcgtcgcgtccgactactactggaaggacgtgcagcgggtgcagccatcggtggcgcaggtgtaccagggcatcacgtccatcccctggatggtcaagccgctctggagcctgctcaccgacgtgctccccgtcgccggataccgccggcggccgtacttcattcttgcaggcttcatcggagttattgcaatgcttataatctctctccacaacaagcttcatgcactgttcgccttgttggcattgatggccggaagtgctagtgtggcaatagccgatgtcactatagatgcttgtgtggcggaaaacagtatattgtaccctcatcttgctgctgacatgataagcttaaatggattctgttcatctgttggaggtcttattggattctcaataagtggttttcttgttcatgcgataggggctcaaggtgccctcggcctgttaactataccctccgccttggtcattttatctggaatgctgctaaaggagatccatacccccaactttccttacgggcaggctcataagaagtttgtagaagcaagtgggaaaatgttaacaaccctaaaatgtcctgaagtatggcggccatgtgtatacatgtatgtgtcgcttgctttgagtgtggacatccaagaaggaatgttctactggtacactgaccgaaaggcaggactgtcttttcatgagggatttattggctttatgtttgccgttgggtcagttggttctcttgttggggttatactttatcaaaatattctcaaggaccactcatttcgcagcctgcttttttcgagccagttgatgttaagcttgtcaggaatgctggatctgatcttggttcttcgtctaaatctgaaaatggggatacctgattactacttcgccgtgattgatgagggggtctccaaaatgatcaaccgtgtcaagtggatgcctcttctggtgcttagctcaaagctttgccccactggcatcgagggcacattctacgcgttgcttatgtccattgacaatattggtggattaactggacaatgggttggtggactgctccttcatttgttgagaatcacaagaacagaattcaataacctctgggctgctatcatgattcgaaatgtgatgaggctactaccgttggctctgttgttcttggtgccaagtagcgatccaaactccactcttcttccatctgatttgctgaatgatgaagacgatggtgaaggtcaccgaatgcagaatattgagttaaccttgcttactgtggacaggggcacttcacctgacaaatctccccaagagcacgggaagaaccaggagagccttgatgtagagcaggatggcgacggagtttcactgcttgccaacaggggttgatactggatgcatacgaagaattttctttgtatacgagcaaatagttgaaatttagggggggaaatctagacatttcatcaaaggcattcattagatatccatgtcgttaaattcattcatttacagtagtgtagcgaagttagcgaagtctcgagagacatataccacagacacttcggagttttgttctccatttctctgaacctccacatatgttacagcatttgaatcaagttttaccaagtgc

SEQ ID NO: 17791 - protein, 540 aa, Panicum virgatum
  misc_feature: Ceres CLONE 1794680
  misc_feature (70)..(482): Pfam Name: BT1 Pfam Description: BT1 family
MSPQPPPDLAEDKERETNVLIEAAPGSPAKAAEDDGAGRQLSPAAWLRMLARELHWSFVLGVAATYGVSQGLGGGISRVASDYYWKDVQRVQPSVAQVYQGITSIPWMVKPLWSLLTDVLPVAGYRRRPYFILAGFIGVIAMLIISLHNKLHALFALLALMAGSASVAIADVTIDACVAENSILYPHLAADMISLNGFCSSVGGLIGFSISGFLVHAIGAQGALGLLTIPSALVILSGMLLKEIHTPNFPYGQAHKKFVEASGKMLTTLKCPEVWRPCVYMYVSLALSVDIQEGMFYWYTDRKAGLSFHEGFIGFMFAVGSVGSLVGVILYQNILKDHSFRSLLFSSQLMLSLSGMLDLILVLRLNLKMGIPDYYFAVIDEGVSKMINRVKWMPLLVLSSKLCPTGIEGTFYALLMSIDNIGGLTGQWVGGLLLHLLRITRTEFNNLWAAIMIRNVMRLLPLALLFLVPSSDPNSTLLPSDLLNDEDDGEGHRMQNIELTLLTVDRGTSPDKSPQEHGKNQESLDVEQDGDGVSLLANRG

SEQ ID NO: 17792 - DNA, 1191 bp, Panicum virgatum
  misc_feature: Ceres CLONE 1794681
  misc_feature: Encodes the peptide sequence at SEQ ID NO. 17793
cccatgaacacagacgccttcccggcctagcctcccaccaaccacagcgaaacagaaccctgttcactctgtgtctccccccttctctgaaagcacgaggcctccgtacgtgctccacacgcttctcaggtctctctctctccctctctcaactcccgtcgctcgagctgtccgtggcgggcggagagcgcgagccgccaccgtacggtcgggagagggggcggagggagaggtggaggaggaggagggaggagagcgcgggcgagatggccgcggccgggctgggcgtgaaggcggcgccgttcacgtacgcggcgcacgcgctggccgcggcggcggcggcgctggtgctggtgtggtgcgtccacttccgcggcggcctcgcgctcgaggcccagaacaagaacctcatcttcaacgttcaccctgtgctgatgctgattggatacattatcctcggcagtgaagccattatgatctacaaggtgttcccaaaactgaaccacgacaccgccaagctgacgcacctgatcctccacgccatcgcgactgtgctcggcgccttcgggatctactgcgccttcaagttccacaacgacagtgggatcgccaacctctacagcctgcactcctggctcggcatcgggacgatctccctgtacggcatccagtgggtattcggattcgtgaccttcttcttccccagcgcggcgctgagcgtgaggcgcagcgcactgccgtggcacgcgctgttcgggctcttcgtctacgtgctggcgctggcgaccgcggagctcgggttcctggagaagctcaccttcctggagaccggggggctcgacaagtacggcgccgaggcgttcctggtgaacttcacggcgctcgtcgtcgtgctgttcggcgcctccgtagtcatcgccgccgtcacgccggcgcacgttgaggcaccgcagggctacgagtcgattccggtcaactaaagaggagttactgaagggaaatattcagaagagtgccgctgtgttcagtttgaaccatggcattagccgactggctaaagtctgaaaaacatccggatttatgtgtaaatctggagtacttgataattggacgcgcattttttttctttttcgttcagtgagatgataatttgaacattcttctggtcctcgggggtactccctccgttcc

SEQ ID NO: 17793 - protein, 237 aa, Panicum virgatum
  misc_feature: Ceres CLONE 1794681
  misc_feature (14)..(232): Pfam Name: Cytochrom_B561 Pfam Description: Cytochrome b561
MAAAGLGVKAAPFTYAAHALAAAAAALVLVWCVHFRGGLALEAQNKNLIFNVHPVLMLIGYIILGSEAIMIYKVFPKLNHDTAKLTHLILHAIATVLGAFGIYCAFKFHNDSGIANLYSLHSWLGIGTISLYGIQWVFGFVTFFFPSAALSVRRSALPWHALFGLFVYVLALATAELGFLEKLTFLETGGLDKYGAEAFLVNFTALVVVLFGASVVIAAVTPAHVEAPQGYESIPVN

SEQ ID NO: 17794 - DNA, 1451 bp, Panicum virgatum
  misc_feature: Ceres CLONE 1794696
  misc_feature: Encodes the peptide sequence at SEQ ID NO. 17795
gaattccgattccccaacgcccatatatatccctgacggagcccctccgcctcctgaactcggtcgtctcttctcatcatcgcccctgctcctcctcccaccttcctcctttcgccgcctgccgggccgccacatcctcctccccgcttcgaacgaccgcgccgcggaacccatctcctggcctctcgtccaccgaggcgcgtcgcgtcgaattccttgcctcccagtcgtcgctggtggtgctggacttgcgcgggcgggcggcagatccacccgagctcggattgatttcgtccttcgctgctgtagtgtcagcaactgaatcaaaaacacttttcatggaagctgggagaatggatcagccttgcatggctgctatcaatagccagcctttggtggctgatgttgaggcagtgaagaaagcaagtggggacatgcctgcaacaatgggaagtggatgcttcgactgcaacatctgccttgattttgcagcagaacctgtggttaccctctgtggtcacctttactgctggccttgcatctatgagtggctgcgccctggggtggagtcaactgccagtgacaacagcagttcagcaaggcggcagtgccccgtatgtaaggcaacactctccccggatacactagtaccactgtacggccgtggagggagctcaaagaaatcgctgaacctgtccatcccgcgccgtcccacggtgcaccgggagactgttgagcatcataacacactgagcaacgtcaatgaccagcagcaccaccagagcatggaaaccaaccctccgcatcagccattgcggcacgcacactaccatcccagttccactgggttcgacttcatctaccctccggcaccactaggacgtggcttgatccactcaactgccggaggggtgctcggagggatggcagaggctgtgctcccgttggtgctcggtggccagctgccagcaagcttgtactatacaagcccttaccatgtcgcggcacagaacgtgaaccccaggctgaggcggcatcagatggagattgagaggtccctccaccagatctggttcttcctcttcgtgtttgtggtgctgtgcttgctcttgttctgagacaagactgtgccctgtgcacctctctgtagatatcgaaagtgggagaggggatactaaaggatgatgcgtatagtgaagagggtaatgggttgtcgataagcatgtgcgtaagcatgctgataatagagttgtattatgatgagacatggaggtaaaatgcagatttcatacttctcgtcttgatgtcaggagctgttgcttctttcttgcttgcctggccggcctgtcaccatcggctggttaggttgcctactcatcatgttgttcattggttggtgtcactgccaagggcaattggatctgtatataaataaaaaatgatgtttggct

SEQ ID NO: 17795 - protein, 254 aa, Panicum virgatum
  misc_feature: Ceres CLONE 1794696
  misc_feature (39)..(89): Pfam Name: zf-C3HC4 Pfam Description: Zinc finger, C3HC4 type (RING finger)
MDQPCMAAINSQPLVADVEAVKKASGDMPATMGSGCFDCNICLDFAAEPVVTLCGHLYCWPCIYEWLRPGVESTASDNSSSARRQCPVCKATLSPDTLVPLYGRGGSSKKSLNLSIPRRPTVHRETVEHHNTLSNVNDQQHHQSMETNPPHQPLRHAHYHPSSTGFDFIYPPAPLGRGLIHSTAGGVLGGMAEAVLPLVLGGQLPASLYYTSPYHVAAQNVNPRLRRHQMEIERSLHQIWFFLFVFVVLCLLLF

SEQ ID NO: 17796 - DNA, 1504 bp, Panicum virgatum
  misc_feature: Ceres CLONE 1794701
  misc_feature: Encodes the peptide sequence at SEQ ID NO. 17797
agacccacctcctcctcctctctccactctcctcgccccctctccctctcctcctcgcggtgacgctgcggctgtggtgcggcccgggctgcatggacgagcaggggttcggcggcttcggcgggggcagcggggcggcggtgcggggccaggggcgggaggtgatggcggcgctcctgcagcatcagcaccaccaccaccagcggcggcggcagctggaggtcgaggaggaggcggaggaggaggaggcgcggcgccagatgttcgccggggtggcggcgttcccggcggcggcgctggggctgggccacgcccagcaggcggactacggggaggaggcgggcggggtcggggacagcgacgccggcgggtcggagcccgagccggcgcggcagcgcggggggtccggcagcaagcggagccgcgccgccgaggtgcacaacctctccgagaagaggaggaggagcaagatcaacgagaagatgaaggcgctgcagagcctgataccgaactccaacaagactgacaaggcatccatgcttgacgaggccattgagtatctgaagcagctgcagctccaagtgcagacgctgtctatgagaaatggtgtttacttgaacccaccatatctatctggtgcgcttgagcctgcacaagcatcacaaatgtttgctgcacttggtggggccaacatcacagcatcaagctctggggcagtgatgccacctgtaaaccaaagttcaggagctcatcaggcattcgacccattaaatcctccacaaaatcaaccactatctttcgtcttaccaagtgttcctgacaaaaccattccagaacgtcaatttcacttggagtcatcacagccccaccttcgaacatttcggatgcctgaatcttctgagatgatgctccggggggagacaatggcaaagcatcagctaacttcagctcaagaaagagttagtctgccaggaaatgatatgaaacccattaggcaagaatcatcaattgcaagcgctgatcattttgatggttgctcacataacaaagagtgattacatgatatggtactaaaaaaatgcaggacatgtgtagcttaggaaatggccactgatgaaactgaagtgaggactgaagacgggatgagcgagatagttcagtaacccaagctgacgcgcacgcttccaaagttatttaccaccgttactgcaacagtaactttattttttgaagcagcttgaatgcttcaccaagcagttagcagggcagtatttgatagtagaaaccatgtcgtactgttgcacatttcttggtctacgggaaactagcaggtcactgagactgatgtgttttttctaccagcagcgcacgccaagctgcgtgtaagctagatcaaagatgtgaggctggttagccagctccagcttcagagttgtgctactagaccaaatattctgaatatagcctgctgaaagcagtccgagacctaaaaggcttcatgctt

SEQ ID NO: 17797 - protein, 320 aa, Panicum virgatum
  misc_feature: Ceres CLONE 1794701
  misc_feature (112)..(161): Pfam Name: HLH Pfam Description: Helix-loop-helix DNA-binding domain
  misc_feature: The sequence is a functional homolog of SEQ ID NO 1246 in the 10/412,699 US patent application
  misc_feature: The sequence is a functional homolog of SEQ ID NO 967 in the 10/374,780 US patent application
  misc_feature: The sequence is a functional homolog of SEQ ID NO 1245 in the 10/412,699 US patent application
  misc_feature: The sequence is a functional homolog of SEQ ID NO 966 in the 10/374,780 US patent application
MDEQGFGGFGGGSGAAVRGQGREVMAALLQHQHHHHQRRRQLEVEEEAEEEEARRQMFAGVAAFPAAALGLGHAQQADYGEEAGGVGDSDAGGSEPEPARQRGGSGSKRSRAAEVHNLSEKRRRSKINEKMKALQSLIPNSNKTDKASMLDEAIEYLKQLQLQVQTLSMRNGVYLNPPYLSGALEPAQASQMFAALGGANITASSSGAVMPPVNQSSGAHQAFDPLNPPQNQPLSFVLPSVPDKTIPERQFHLESSQPHLRTFRMPESSEMMLRGETMAKHQLTSAQERVSLPGNDMKPIRQESSIASADHFDGCSHNKE

SEQ ID NO: 17798 - DNA, 2722 bp, Panicum virgatum
  misc_feature: Ceres CLONE 1794713
  misc_feature: Encodes the peptide sequence at SEQ ID NO. 17799
ttctcctcccccacccccgcgccgagccacctcgcagatgacggccgccgccgccggcgccccctccacccgatgaccccgctgccctccctcctgctgctcctcctcctcctcattgcggccgcgccgtccccggccccggcctccgcggccacgctcgccgtctcgcccgccggcgtcgtctgcggcgtcgccaaggagaaccgcaccctcgtctgcgcgcccgtgtccgccgcgtcctccaacgcctccgccgcggtcgctccgttcctcgccttcgccgaggtctccgcggggcggggcttcgtctgcgggctccaggtcggcggcgccgcgctcttctgctggccgcccgcggccgccccgcgctgggaccagctccgccgcgtctacaacgggtccgccacgttcacggacctcgccgtcggcgcggaccacgtcgcggcctacgacgccgccgcgggtaggatccaatggtggcgcgacggcgggcggttccccgcgccggtcgatgggaacttcagttccctggtctccggcgacgggttctcctgcgcgctcgagggcaacgcctccgcggccgtccgctgctggggcccgcgaagtagcgccgtgcaggcggccttcgccaacgccacctccgtccgctacctcgccgcggggggcgcgcgcgcctgcggcgtcctggcctcgggcgcggtgctctgctcgggatccgactccgccaacgcctccgccgcgctgccgggggagctcgcgccgtacggcctggccgtcggggactcccacgcgtgcggcctcctccgccacaaccgcaccgccgtgtgctggagcctcgggggccccaccaccaccgtgtacttcccggccgccggcaccgggacccagttccagttcctcgtcgcgggcggcaacctcacctgcggcgtggtcagcatcgacttcagcgtcatctgctggtccttggactccgcggccgcccacgtgccgctgccgctgatcctcccgggcgtctgcgtccaagacgagcgctcctgcggcgggtgccgtttcatggcgcagacgcagcagttctgcgggggctccggcgggatctgcgacagcctctgcgacgactcgccggcgcccccgccgcggacacccgttgcccctaccccctcgtcgcctccgccgccggggtcgtcgggcaggcgcgtgtccaaggcctggatcgccttctgcgtggtcggcgcggtgggcggcttcgcggggctctgctccgttgtctactgcctcgtcttcggcttctgcagcaacaagagggtgcacaactccgtgcagcccaacatcaccggcgctggcgcgggcgccgacaacaacaacaccagcaacaacaataacggcggcggcggcgcggccggcagcccgtatgggtcgccgaacgggtcgcgcgcgcgcgggctgttccggcggcagctgtcgcgggtgatgacgcggcagcgcagcgggccgtcgtcgttcaaggagcccgcggaggagttcacgttcgcgcagctggaggcggccaccaaggggttcgcgctggagacgaagatcggggagggcagcttcggcaccgtgtaccgcggcaagctccccgacgggcgtgaggtggccatcaagcgcggcgagtcgggtccccgcgcgcggcggctccaggagaaggagagcgcgttccggtcggagctggcgttcctgtcgcggctccaccacaagcacctcgtcggcctggtgggctactgcgaggagcacgacgagcggctgctggtgtacgagtacatgaagaacggcgcgctctacgaccacctccacccaaggcctggggcggcggcggcgccgtcgccggtggcgtcgtcgtggaagctgcggatcaagatcctgctggacgcctcccgcggcatcgagtacctgcactcgtacgccgtgccgcccatcatccaccgcgacatcaagtcgtccaacatcctgctggacgccgggtggacggcgcgcgtgtccgacttcgggctctcgctcatggggccgccggagtcggaggagcagccggggtcagggtcgcagcgccacctgacgcaggtgaaggccgccggcacggtggggtacatggacccggagtactacgggctccaccacctgacggtgaagagcgacgtgtacggcttcggcgtggtgatgctggaggcgctcacggggcggcgcgccatcttcaaggaggccgagggcgggagccccgtcagcgtggtggaccacgccgtgccgagcatcctcgccggcgagctgagcagggtgctggacccgcgcgccccggagcccgccgcgcacgaggccgaggccgtggagctggtggcctacaccgcggtacactgcgtccggctcgagggcaaggaccggccggccatggcggacatcgtggccaacctggagacggcggtcgcgctctgcgagggcagcgaccgcggaggcgccgggttcgggaacagctcctccagcgccagcctctccgtcacctccatggaccggtccggggcgctggtctgacgggattcgaaaatttttctccatttctcgctgctcagagagagagtggctccgattcaaagctgtgattagcccgggcgggaaggatgatgttcaaattcgttgcatagttaattctttctttcttcttctttgctgttggtgaatgtacatggatattcttccg

SEQ ID NO: 17799 - protein, 827 aa, Panicum virgatum
  misc_feature: Ceres CLONE 1794713
  misc_feature (495)..(789): Pfam Name: Pkinase Pfam Description: Protein kinase domain
  misc_feature: SWISSPROT Homolog: EC 2.7.11.1 Non-specific serine/threonine protein kinase
MTPLPSLLLLLLLLIAAAPSPAPASAATLAVSPAGVVCGVAKENRTLVCAPVSAASSNASAAVAPFLAFAEVSAGRGFVCGLQVGGAALFCWPPAAAPRWDQLRRVYNGSATFTDLAVGADHVAAYDAAAGRIQWWRDGGRFPAPVDGNFSSLVSGDGFSCALEGNASAAVRCWGPRSSAVQAAFANATSVRYLAAGGARACGVLASGAVLCSGSDSANASAALPGELAPYGLAVGDSHACGLLRHNRTAVCWSLGGPTTTVYFPAAGTGTQFQFLVAGGNLTCGVVSIDFSVICWSLDSAAAHVPLPLILPGVCVQDERSCGGCRFMAQTQQFCGGSGGICDSLCDDSPAPPPRTPVAPTPSSPPPPGSSGRRVSKAWIAFCVVGAVGGFAGLCSVVYCLVFGFCSNKRVHNSVQPNITGAGAGADNNNTSNNNNGGGGAAGSPYGSPNGSRARGLFRRQLSRVMTRQRSGPSSFKEPAEEFTFAQLEAATKGFALETKIGEGSFGTVYRGKLPDGREVAIKRGESGPRARRLQEKESAFRSELAFLSRLHHKHLVGLVGYCEEHDERLLVYEYMKNGALYDHLHPRPGAAAAPSPVASSWKLRIKILLDASRGIEYLHSYAVPPIIHRDIKSSNILLDAGWTARVSDFGLSLMGPPESEEQPGSGSQRHLTQVKAAGTVGYMDPEYYGLHHLTVKSDVYGFGVVMLEALTGRRAIFKEAEGGSPVSVVDHAVPSILAGELSRVLDPRAPEPAAHEAEAVELVAYTAVHCVRLEGKDRPAMADIVANLETAVALCEGSDRGGAGFGNSSSSASLSVTSMDRSGALV

SEQ ID NO: 17800 - DNA, 2672 bp, Panicum virgatum
  misc_feature: Ceres CLONE 1794714
  misc_feature: Encodes the peptide sequence at SEQ ID NO. 17801
gatcgcatcgcgcggcggcctcctcgccctcagctgcctggcacgccttggctcccgactcccgtcgccgccgtcccagcggagctgggcaggtacaccttcaacgcacgctacaggatagattcctttggccgaattgtggaagccttatacactgttatacaaggcagctgcattgaagatgtctgagttccttgacctagaggcacaagatgggataaggatgccctggaatgttattccaggcacaaagcaggaggctttgaactgtgtgattcctgtttctgctatctatacacctctgaagtcaattcctgatattccggttctcccatattcaccccttcgctgtcgcatgtgtcgttccatcctcaatcctttctccatagttgactatgttgctaagatctgggtctgtccattctgctttcagcgcaatcaattccctcaacactactcctcgatctcagaaaataatctccctgcagaactctttcctcagtataccaccgttgagtacatatcatcaaccgaaactggtcctgtagtgccaccggttttcatttttgttgtagatacttgcatgattgaagaagaaatcggttatttgaagtctgcattggcacaagttgttgagctattgccagataattcccttgttggattcattacttttggaacgtatgtgcaggttcatgaattgggttttggcttgttgcctaagtcatatgtgttcaagggaacaaaggaggtcaccaaggaacaaatattggaacaaatgtgcttctttgcagggaagaaaatgcccacaactggggtgattgctggtaccagagatggtctttcatccgagagcatctctaggttcctgctgcctgcttctgaatgcgagtttgtgttgaactcagttatagaagaaatgcaaaaggacccttggcctgtaccagctgatcagcgggcatcaaggtgcactggagttgccttaagtgttgcagccaatctccttggggtttgtgtccctggatcaggtgctaggataatggcatttgttggtggtccatctacagaaggccctggttctattgtatccaaatccttatctgagccaattcgttcacacaaggaccttgataaagactcggcaccactatacgacaaagctgttaagttctacgatcaaatagcaaagcagcttgtgcaccaagggcatgtgctggatttgtttgcctgtgcagtcgatcaggtaggagtagctgaaatgaaggttgcaattgagaagactgggggaatggttgtgcttgctgaaagttttggccattctgttttcaaggactcacttcgccacatttttcagtcagcagatgtcaaccttggtctatcattcaatggtattcttgaaattaattgttcaaaggatgtcaaggttcaaggcatcattggaccttgtacttccctggagaagaaaagtcctttgttgtcagacactgttattggtcaaggaaacactagcgcttggaaaatgtgcggtcttgacaaaaaaacatcactttgctttgtatatgacattgcaaaaaaagatggccaagattcaattggtcaatcaacaagcaatcagttctactttcaattcttaacctactatcagcacaatgagggtatgatgcgattaagatcaaccacaatatccagaagatgggtctctggcaccgataatgtggaggagttagtagctggctttgatcaagaagctgctgctgcagtcatggcacgcttggtgtcatttaagatggaaactgaggttgattttgacccagtaagatggcttgatcgagctttgatacgtatatgttctaaatttggagactatcagaaggaaacaccctcgtccttcagtttatccccgcgtctatcaatatttcctcagtttattttcaatttgaggcgttctcagtttgttcaggttttcaataacagtcctgatgaaactgcatattttaggatgatgttggacagagagaatgtagccaatgcagttgtgatgattcagccttcacttttatcttattcatttcagtcaggaccagagccagttctcttggatgtaactgcaattgcttctgacaagatccttttgttggattcttattttactgttgtcatattccatggggtaaccattgcccagtggcgaaaagctggttaccaagatcaagaaggtcatgaggcgtttgcccagttgttaaaagctccacacgaggaagctaattcaataataaaggaacggtttcctgtgccccgtttggtagtctgtgatcaatatggatctcaggctcgatttttactggcgaagctaaatccatcagtgacatataactcagataatcccgcccctggtggagatgtcatcttcacagatgatgtgagcttccaggttttcatggaccatctccagcggctatcagtccaatagcacatggatctctgtagagcagtgcatagagcaattttgtaccaccattgatcacttctgctgcacagtaaggagaatcctttttgtttgtaatgtcttacaagctggtttttaattatacacctttttttccctttattagtgcattgttgaatggcaaagtgcactttcagtaagatggctacatttctatggatttacc

SEQ ID NO: 17801 - protein, 762 aa, Panicum virgatum
  misc_feature: Ceres CLONE 1794714
  misc_feature (122)..(390): Pfam Name: Sec23_trunk Pfam Description: Sec23/Sec24 trunk domain
  misc_feature (400)..(506): Pfam Name: Sec23_BS Pfam Description: Sec23/Sec24 beta-sandwich domain
  misc_feature (521)..(621): Pfam Name: Sec23_helical Pfam Description: Sec23/Sec24 helical domain
  misc_feature (630)..(720): Pfam Name: Gelsolin Pfam Description: Gelsolin repeat
  misc_feature (53)..(92): Pfam Name: zf-Sec23_Sec24 Pfam Description: Sec23/Sec24 zinc finger
MSEFLDLEAQDGIRMPWNVIPGTKQEALNCVIPVSAIYTPLKSIPDIPVLPYSPLRCRMCRSILNPFSIVDYVAKIWVCPFCFQRNQFPQHYSSISENNLPAELFPQYTTVEYISSTETGPVVPPVFIFVVDTCMIEEEIGYLKSALAQVVELLPDNSLVGFITFGTYVQVHELGFGLLPKSYVFKGTKEVTKEQILEQMCFFAGKKMPTTGVIAGTRDGLSSESISRFLLPASECEFVLNSVIEEMQKDPWPVPADQRASRCTGVALSVAANLLGVCVPGSGARIMAFVGGPSTEGPGSIVSKSLSEPIRSHKDLDKDSAPLYDKAVKFYDQIAKQLVHQGHVLDLFACAVDQVGVAEMKVAIEKTGGMVVLAESFGHSVFKDSLRHIFQSADVNLGLSFNGILEINCSKDVKVQGIIGPCTSLEKKSPLLSDTVIGQGNTSAWKMCGLDKKTSLCFVYDIAKKDGQDSIGQSTSNQFYFQFLTYYQHNEGMMRLRSTTISRRWVSGTDNVEELVAGFDQEAAAAVMARLVSFKMETEVDFDPVRWLDRALIRICSKFGDYQKETPSSFSLSPRLSIFPQFIFNLRRSQFVQVFNNSPDETAYFRMMLDRENVANAVVMIQPSLLSYSFQSGPEPVLLDVTAIASDKILLLDSYFTVVIFHGVTIAQWRKAGYQDQEGHEAFAQLLKAPHEEANSIIKERFPVPRLVVCDQYGSQARFLLAKLNPSVTYNSDNPAPGGDVIFTDDVSFQVFMDHLQRLSVQ

SEQ ID NO: 17802 - DNA, 704 bp, Panicum virgatum
  misc_feature: Ceres CLONE 1794719
  misc_feature: Encodes the peptide sequence at SEQ ID NO. 17803
agcctaaaaacttccaactctgccgagcgcctactagctcgcttgctcctccctgttgtccgcaggagcagagccaaaagccgtcagctcggggcgccgaggcggcaagaaccaccatcaagatcgacccctacctcaacactgatgctgggaccatgtctccatttgagcatggcgaggtctttgttttggatgatggtggagaggtggacctggaccttggaaattatgaacgttttctggatatcaaattgacccgtgacaacaatataaccacaggaaaaatctatcaggctgtcattaacaaagaaagaagaggtgactacctgggaaaaaccgtccaggttgtgccacatattacagatgaaatacaagattggattgaatgcgttgcaatgaatccagttgacggcaaagaaggacctcctgatgtttgtgtcattgaacttggcggcactataggggatattgagtcaatgcctttcattgaagcattaggtcaattttcatatcgtgttggacctggaaacttctgtttggttcatgtcagtcttgttcctgtcctaaatgtagttggtgaacagaaaacaaagcctacacaacatagtgttcgagggcttagaggacttgggttggcaccagatgttctagcatgtcgcagtactgagccattggaagagcatgtgaaagtcaagctctcacaa

SEQ ID NO: 17803 - protein, 233 aa, Panicum virgatum
  misc_feature: Ceres CLONE 1794719
  misc_feature (28)..(233): Pfam Name: CTP_synth_N Pfam Description: CTP synthase N-terminus
  misc_feature: SWISSPROT Homolog: EC 6.3.4.2 CTP synthase
PKNFQLCRAPTSSLAPPCCPQEQSQKPSARGAEAARTTIKIDPYLNTDAGTMSPFEHGEVFVLDDGGEVDLDLGNYERFLDIKLTRDNNITTGKIYQAVINKERRGDYLGKTVQVVPHITDEIQDWIECVAMNPVDGKEGPPDVCVIELGGTIGDIESMPFIEALGQFSYRVGPGNFCLVHVSLVPVLNVVGEQKTKPTQHSVRGLRGLGLAPDVLACRSTEPLEEHVKVKLS

SEQ ID NO: 17804 - DNA, 662 bp, Panicum virgatum
  misc_feature: Ceres CLONE 1794719-R
  misc_feature: Encodes the peptide sequence at SEQ ID NO. 17805
ttatttccatgtcaatggctgcaaatctgcaaggctgtaagaaaacagtatggtaatgccacctctgtagatgaaaggcatcgccacagatacgaggtgaaccctgatatggtcccagactttgagagggccgggcttcaatttgtgggcaaggatgaaagtggaagacgcatggagatcattgaactgccctctcacaagttcttcatcggcgcacaattccatcctgaatttaagtcaagaccaggaaagccgtctccacttttcttaggtctgatagcagcggcatctggacaactagaacctttgcttcaacgcagctgcagcaatctgacaaagacacatctgaacaacggtaaagtccagatacggaaactgtaccaaactgtacctatgaagagtccattaaacagcttggtaaatgggtactacccaaatggcacgggcattcacacctagaagcataaatactaagtcaagacttgattgatatttgctcctacagttttccttgtaccccttttcatcttcctttttggtttgtatttgtctctgatcaactgagaaggctaagattcggcaagcccggcccggccccggccccggccccagctccagcgacacacggttccgaaattttaacgaggaacgtcctccggtcc

SEQ ID NO: 17805 - protein, 152 aa, Panicum virgatum
  misc_feature: Ceres CLONE 1794719-R
  misc_feature: SWISSPROT Homolog: EC 6.3.4.2 CTP synthase
LFPCQWLQICKAVRKQYGNATSVDERHRHRYEVNPDMVPDFERAGLQFVGKDESGRRMEIIELPSHKFFIGAQFHPEFKSRPGKPSPLFLGLIAAASGQLEPLLQRSCSNLTKTHLNNGKVQIRKLYQTVPMKSPLNSLVNGYYPNGTGIHT

SEQ ID NO: 17806 - DNA, 1312 bp, Panicum virgatum
  misc_feature: Ceres CLONE 1794721
  misc_feature: Encodes the peptide sequence at SEQ ID NO. 17807
gacaacacccaaccaacaggcgcacgaacgggagccgtggctgcaaacgaaaagggtaacggaaagctctgctcgcatggacgactccgcagcggcggcgccggcgccagtgctgctggtgacgaacgacgacggcatcgacgcgccggggctccgcttcctcgtcgaccagctcgtcgccgcgcggcgctaccgcgtcctcgtctgcgcgcccgactcagacaaatcgggtgttagccactgcatcacatggcggaatgcactctgctgtaaacgtgttgatataagtggtgctacagcatttggagtttcaggaactcctgctgactgcgcctctttaggcatctctgggaagctctttgatggtgtggttcctgatctggtacttagtggaatcaacattggaaacaattgtggataccacgtcatttattctggaacagttgctggtgctagggaggcatttttatatgggattcctgcaatagctatgtcatatgattgggttgcgggtcagagcagtgtcaatgacctcaaggtgtctgtagaggtctgtatgcctctgataaataccatcgtgactgagatcaagaatggaacatatccccaaggatcattcttgaatgtagatgtaccaacagatgctgcacaccacaaggggtataaaattacgaaacaaggaaaatatatggcagccagagttagttgggagcaaactgtttacaagaagcctgctgtagaaagttaccagacagcaaacattgatgttgatgatgaaaaggacagtgaactagtcactccagcagagaatgacctactttttaagagagtgattgtagaaaaattttctgatgaagtggaaggagaggaggacacggaccgcaagtccctagttgatggatacattactgttactcctttgggcgctctttcccgcatggatccagatgccataccctacctcaaagcttgcgtgtcacgcctggatacttaccaggccggcccgacagacagaacctgctgatgcaatcgctggcggtgttgcgaataaatccacatcgatttgaggcattctgtttattgctaatgatgcactgccgcactatgtagtacagtatctgtggtgttcataactccgtgttttcaaaactgtggtattcattggtcttgtatttctatggttcctctttgtagcgattataatagcttgtcattatagcccctctgcggaagttactgtcagtttttaccaatccaggatgcgtagctcgggaataattttcttgggataaaatattgccaaaatacccct

SEQ ID NO: 17807 - protein, 315 aa, Panicum virgatum
  misc_feature: Ceres CLONE 1794721
  misc_feature (11)..(209): Pfam Name: SurE Pfam Description: Survival protein SurE
  misc_feature: SWISSPROT Homolog: EC 3.1.3.5 5'-nucleotidase
MDDSAAAAPAPVLLVTNDDGIDAPGLRFLVDQLVAARRYRVLVCAPDSDKSGVSHCITWRNALCCKRVDISGATAFGVSGTPADCASLGISGKLFDGVVPDLVLSGINIGNNCGYHVIYSGTVAGAREAFLYGIPAIAMSYDWVAGQSSVNDLKVSVEVCMPLINTIVTEIKNGTYPQGSFLNVDVPTDAAHHKGYKITKQGKYMAARVSWEQTVYKKPAVESYQTANIDVDDEKDSELVTPAENDLLFKRVIVEKFSDEVEGEEDTDRKSLVDGYITVTPLGALSRMDPDAIPYLKACVSRLDTYQAGPTDRTC

SEQ ID NO: 17808 - DNA, 1760 bp, Panicum virgatum
  misc_feature: Ceres CLONE 1794725
  misc_feature: Encodes the peptide sequence at SEQ ID NO. 17809
gtccagggaagctttcagtttccgcctttccccctttccggagcgggggctggtgctgcagcctgcaggtgaggcgaggaggctccgttcatctctatccacaacaaccgtagcagcagcagagtccgcctccgcggctccgccctaaccaacaaacagcagcgcatgcactcggccacctcagaccccacctcccttcccttccccgttgcgccgtcgtcgcatccggcgtttgtgctttgctggagttggagatgccatcgaccacctgtgcactccactgagcagggatcgagttgcccaaattgtggtgattgaagcgtcccaagttccaagcccatacaatgcagggcatctctatatgtggttcggttgcttcaccccatggagcaaattgcacaagggcttgtgttgcagggatcagtccgaggctgccatatgagattaatggagtaagccatggagctttctcatgccactggcgcatgcataaactccgcataaagaccaatggcagaagaattaatactacagtaagagctaatgccagatggttgtttggaggagatgggcgtagcagcgatgcaaggctggagcgcagtgagtctgctaatgaagatatcttgatcttctacttccagatggatttacagacccggatacaatatgcattgaatatagaacaatttgatgtggcaaaacaattgagggaaaaactcactgagattgaaacggaaataattaggcaacgtgaagctaaacgaggttcatcaaagactgaagctcaagacaaagctctgaatcttttacgtgtacgtgcagacttgcagaaagctattgacagtgaaaactatgctgtggcagctggtctgcgtgatgaaatcgccaaacttgaggccgaatctcttgcagtatctgctaaagctcttgcttatcaaaatgtgaagtatacgtttcgactagggcagaaagtacggcacaaggtacatggatatagaggggtgatatgtggcatggatcctgtatgctgtgaatccaagtcatggatggagacagcaaatgtggagaagctgtctaaaggtccaaatcaaccattttatcaggtcctggttgacgtatacgttgatccagaactacttgtcgcatatgtggcagaagaaaatctttcagcagctcaagaatcagagaaaggaaggtttgatcacccctacattgaatttctattctatggtgaggacacggctggggacttcatccccatcaaacaactccgtgagaagtatgaccagccccgctatgaagattctggagatgaaaatgacaacgatggcgacacaagtagctgaaggtcaagtgccttcatgtagctaaagttgttttggaaccattctgattcaccaccaactgagatgtgaattattgcggtatctggtataactgcaaatggcacatggtatgcaatacaaccatcagcgaaatgctcatcgtctgggatgtgcagtggataaactgcatatcacccttgcagattggaggttgcgcttttacagttataatctcaccaagcaatgaaacgatgcttgagataaaccggccttgcttttacgttatattgtcgacgggtgtcaaagcaaaaagggaaaataatccttgtgtacagttctcccatatcatctcattttctgtaccctcttacgggcagttgtgcatatgacatacttgcaacttcagttgagtttagacttagaataattttcgtg

SEQ ID NO: 17809 - protein, 333 aa, Panicum virgatum
  misc_feature: Ceres CLONE 1794725
  misc_feature (201)..(308): Pfam Name: YccV-like Pfam Description: Hemimethylated DNA-binding protein YccV like
MQGISICGSVASPHGANCTRACVAGISPRLPYEINGVSHGAFSCHWRMHKLRIKTNGRRINTTVRANARWLFGGDGRSSDARLERSESANEDILIFYFQMDLQTRIQYALNIEQFDVAKQLREKLTEIETEIIRQREAKRGSSKTEAQDKALNLLRVRADLQKAIDSENYAVAAGLRDEIAKLEAESLAVSAKALAYQNVKYTFRLGQKVRHKVHGYRGVICGMDPVCCESKSWMETANVEKLSKGPNQPFYQVLVDVYVDPELLVAYVAEENLSAAQESEKGRFDHPYIEFLFYGEDTAGDFIPIKQLREKYDQPRYEDSGDENDNDGDTSS

SEQ ID NO: 17810 - DNA, 1940 bp, Panicum virgatum
  misc_feature: Ceres CLONE 1794732
  misc_feature: Encodes the peptide sequence at SEQ ID NO. 17811
ccgtttgagttcaccctaagcatcgtcatcagtgccctcctctcctccctgctcgctgggaaaaaaccctcgcctcgcctctccgcgcccccctccccctagcgcgcagcgagcgatcgacggaccccccacccgccatggcgagcgacgacgaggaggaggagtgcggctacttctacgacgacgacgatgccgaggagaacgccgccgccggcctggagcaggccgccgcgccgccgccggagcgccgcgcggactactgggccattacacaggagtcccttcccactgcacagaaacaagatctttctacagtcatgaactttctcaatataaaacaacatcaagcacgagctctcctcatccaccaccggtggaggatggatggcatctatgatcacttagataaggggcgagagcgcatgctcagagatgcaggtattgtgctgcaggagaataatattatggcagcagctggctcaacaacaccatggagaagtgtgcactgcaatgtgtgttttgaggacatccccatgggtgtagtcttgaccatggactgtgggcattgcttctgcaatgattgttggacgcagcatttctattccgccgtagaaagcggtaagaagcagattaggtgcatgcaggtgaagtgcccggccttctgcgatgaggaccacgtgcggcgtctccttggccggaaataccccgaaatggccaagcgcttcaatcggttcctgctcgagtcctaccttgaggacaacgactctgtgaagtggtgccccagcgcaccaaactgtggccgcgcaatccgtgtgggcactggtgagcggtactgtgaggtggagtgcccctgcggcttaagcttctgctttaactgcacggcacatgcacattcgccgtgcccgtgcaccatatgggagaaatggaatgccaagtgtacggagggagagaacatcaagtggatcctcgctaacaccaagagctatcccaaatgctttaaggccatcgagaagaatggtggctgcaaccttgtccgctgcaactgcggccagtgtatgtgttggctctgcggtggagggaccggcttggatcacacgtggaccagcattgccggccacagctgcaaccgttacaaggaggagacccgcgggaagaccaaggacacgagcagggagcagatgcagcgatacaagcactactacgaccggttcaagatccacggcgactcgtacggcgtggagaagcagaagctggggccaaccgtgctggagcgggtgaggctgctggaggctgacctcaagcgcccgctgacgatccgcgacggggactggctgatccgggcgcaccggcgcctgctggtgtcgcggcaggtgctgtcgcggtcgtacgtgttcgcctactacatgttcggcggcgagctgctgatgcagccggccggccgggcgggcctggccgtggcgcggaacctgttcgaggaccagcagcagcagctggagcagcacgtggagcgcctgtccgagctgctcgcgggcgcggacgcggtggcgatgcccgaggcggagatcgtgcaggcgaagcagaaggccgtcacgctcgtcaagaccgtggagaggctgtgcggggagatgtacaagtgcatccaggacgagctgctcacgctgctcgtcgagccgatgaccatcgcggcgtaccggccggacggccccgacaaggccgaggagctcacggcgtgatcgagcggtcggcttgcgccacattttggcctctcgctggccggccagctcggtgcagcatatcggcagtagacgcgtttatatagcgtaaaatgatttaggctggttaacatagaaggccacacagtacttgaggtaaaaagaaaaagggtctgaccttagcagagtatctaatgctacaagcgaagcactcgtggattcgtccag

SEQ ID NO: 17811 - protein, 531 aa, Panicum virgatum
  misc_feature: Ceres CLONE 1794732
  misc_feature (194)..(257): Pfam Name: IBR Pfam Description: IBR domain
MASDDEEEECGYFYDDDDAEENAAAGLEQAAAPPPERRADYWAITQESLPTAQKQDLSTVMNFLNIKQHQARALLIHHRWRMDGIYDHLDKGRERMLRDAGIVLQENNIMAAAGSTTPWRSVHCNVCFEDIPMGVVLTMDCGHCFCNDCWTQHFYSAVESGKKQIRCMQVKCPAFCDEDHVRRLLGRKYPEMAKRFNRFLLESYLEDNDSVKWCPSAPNCGRAIRVGTGERYCEVECPCGLSFCFNCTAHAHSPCPCTIWEKWNAKCTEGENIKWILANTKSYPKCFKAIEKNGGCNLVRCNCGQCMCWLCGGGTGLDHTWTSIAGHSCNRYKEETRGKTKDTSREQMQRYKHYYDRFKIHGDSYGVEKQKLGPTVLERVRLLEADLKRPLTIRDGDWLIRAHRRLLVSRQVLSRSYVFAYYMFGGELLMQPAGRAGLAVARNLFEDQQQQLEQHVERLSELLAGADAVAMPEAEIVQAKQKAVTLVKTVERLCGEMYKCIQDELLTLLVEPMTIAAYRPDGPDKAEELTA

SEQ ID NO: 17812 - DNA, 1331 bp, Panicum virgatum
  misc_feature: Ceres CLONE 1794742
  misc_feature: Encodes the peptide sequence at SEQ ID NO. 17813
gagagaggagaggagaaagaaagggtagtgggaagggaggagagaggaggagccagggaaagctctcttcttcttcctcctcctcctcttcctctccaattccgtcccttgcctctgtcctcctcgcccggtttccccggttttttggaaggggaaagaggaggaggaaggatggggagggaggagaggttsccggtgtgggaggccgcgctcggcgcaggggtcgccgccgccttcgccgccgggctcgtcggagtctacctttccatgccggactccgactacagcttcctcaagttgccgcgcaacctcgaggaactccaaatcctcactggccatcttgagaactatactagtgactacaccctacaggtgttggtaggttattgcgctgtgtacatcttcatgcagaccttcatgattccagggacaatattcatgtcactgcttgccggtgctctatttgggcaactccggggcgtggccctggtggtctttgctgccactgctggtgcttcttcttgctatttcctctcgaagatgattgggaagccactggtgttctcactgtggccagataagctcagtttcttccagaaacaggttgctaaaagacgagagaagctgttgaattacatgcttttcctcagggtcaccccaacattgccaaataccttcatcaacttagcttcaccaatagtagatgtcccatatcatacattcctattgggaactctcattggtctcatcccagctgcttacgtgactgtgagagctggaattgctctaggagagttaacttcgctgagtgacctttatgacacccagtcaatagcgcttctattcctgatcggtgttgtttcagtcacgcctgcactgttgggcaaggacgaggcacaagaaaaaccatcggaaatggcagtaggcgcttcatgatcaccaaagcatcacacagtgtccacctcacctgtatatgtcagcatccagcaagtagtggctccattagttcgcatggctgcgcagcttggcgggaccccagcccaaagctcggccatcacccgcctacggaggaacctgtgttgccaccatcagaaacattatatggtggccattcaccacatcagaatgaatgaacctggaaagcagaatgcccgttagacaagctgctccaatgtgtaaacgagcagttttgctctgttcagatgggatgggacaatcttcgtagttcgatccttgtatattcgtagttcgatccttgtatatatattgaccagattcattcaatccatattcagtggttcaaagatgttgctttgtccagctgttgtgtt

SEQ ID NO: 17813 - protein, 254 aa, Panicum virgatum
  misc_feature: Ceres CLONE 1794742
  misc_feature (84)..(205): Pfam Name: SNARE_assoc Pfam Description: SNARE associated Golgi protein
  misc_feature (7)..(7): Xaa is any aa, unknown, or other
MGREERXPVWEAALGAGVAAAFAAGLVGVYLSMPDSDYSFLKLPRNLEELQILTGHLENYTSDYTLQVLVGYCAVYIFMQTFMIPGTIFMSLLAGALFGQLRGVALVVFAATAGASSCYFLSKMIGKPLVFSLWPDKLSFFQKQVAKRREKLLNYMLFLRVTPTLPNTFINLASPIVDVPYHTFLLGTLIGLIPAAYVTVRAGIALGELTSLSDLYDTQSIALLFLIGVVSVTPALLGKDEAQEKPSEMAVGAS

SEQ ID NO: 17814 - DNA, 1501 bp, Panicum virgatum
  misc_feature: Ceres CLONE 1794744
  misc_feature: Encodes the peptide sequence at SEQ ID NO. 17815
atttttctccacaaaaacccgcacaaaatctcatctgaggaaaaggggaatcggaccatcggaggatcggaagtgagctgaagccatggccgtggatccaagcatcgcggcggaggccgaggccgcagcgcgccggagcgaggaggcggcggaggccttcttccgcgccgcgccgccgctccgcgaccgcgaccgcgtcgccgccagcgtggccgacttcgtcgcccgccactccgcagggagcggcggtgcgggcgggcccgccgaaggcgccagggtgatctgcatcacctccggcggcaccacggtgcccctggagcagcgctgcgtgcgctacatcgacaacttcgcctccggccagcggagggcggccgccaccgagtattttctcaaggcgggctatgccgtcatcttcatctatcgccgtgggagcaagcagccttactgtagatttcttccagaggattcgtttctcgatctttttgagcttggtgaagactcagagatccaagttccccaatctcattccactgtggtcaaggcagctattagcaattatcgcaaggcaattggtgaaggcctgcttctgaaacttcccttcactacaattttcgagtaccttcagttactacagatggtagctacttcgatgaattgcttgggacaccatggaatgttctttcttgctgctgcagtttctgacttctatgttccatgggaaagtatggctaaacataaaatcgagtcagcagttggccctttgaacatgcaactcaaccaagtccctaagatgcttttcatcctcagaaaaatttgggccccttcagcattttgtgtatcattcaagctcgagaccgatccaaacattcttctacagaaggcggagatggctttgaagaagtacggtatgaacgtggtggttgcaaacgagcttgctaactacaaagatgtagtggtcatggtcacaagcagcgggaggacgaccgtgagcaggagcagcaaggaggaagacttggaggagcagctaaccgagctcctggtaaagatgcacttggagcacatcagacaacccggttcagaagaccgttaaacacatggtgggggcagagtatcgtctatttgagttacttctaccaagttgctgcagagaccacctggttcatcagatgctcagtgcgttttgcaccagatgaatgccaaagttagtaatggatcccaccaacgcagcaatgcctatagacgtttgaattcgaatgcaaagctagctgtaagctggcgttgtgatgccactgttctctatgtgggtgcaactggggccctatatgatgcacacaggatggagagagagagagagagaggctgactagagtttgccaaaaataacataggggccatgcttgccttagttttttttaaccctgatgagtcatgatcatgactcatgatacatcgatgcaacgtcctgtacctgtatgaaatatgaacttctacacctgcccgg

SEQ ID NO: 17815 - protein, 334 aa, Panicum virgatum
  misc_feature: Ceres CLONE 1794744
  misc_feature (60)..(307): Pfam Name: DFP Pfam Description: DNA / pantothenate metabolism flavoprotein
  misc_feature: SWISSPROT Homolog: EC 6.3.2.5 Phosphopantothenate--cysteine ligase
MAVDPSIAAEAEAAARRSEEAAEAFFRAAPPLRDRDRVAASVADFVARHSAGSGGAGGPAEGARVICITSGGTTVPLEQRCVRYIDNFASGQRRAAATEYFLKAGYAVIFIYRRGSKQPYCRFLPEDSFLDLFELGEDSEIQVPQSHSTVVKAAISNYRKAIGEGLLLKLPFTTIFEYLQLLQMVATSMNCLGHHGMFFLAAAVSDFYVPWESMAKHKIESAVGPLNMQLNQVPKMLFILRKIWAPSAFCVSFKLETDPNILLQKAEMALKKYGMNVVVANELANYKDVVVMVTSSGRTTVSRSSKEEDLEEQLTELLVKMHLEHIRQPGSEDR

SEQ ID NO: 17816 - DNA, 1817 bp, Panicum virgatum
  misc_feature: Ceres CLONE 1794747
  misc_feature: Encodes the peptide sequence at SEQ ID NO. 17817
aaaagagaaaataaaaggaagggaaggccgaagccaaaacaaggtaggcggcttcccgacgaaacctcccgttcctccgcgacccctccgccgccgtccgatctcccccacatcgccgccggtaccgccgcctcctccttatcttcttcctcctctgccttgtgcgcctccccttcctccccccatccaatcattgctcgagcgctccccccctgcgaatccgcaccagctcggcttaagcttcacctcgctgatttggtgctttgctgattaggtgctctgtcaatcagtccaatcccgtcgggagagcaggcggttcaagcggttgcccccaacaattcgggggttccgggatctcggttcctgatcggtaggtgggcgggcgggcgtcggatccagcggccgtcatcatggttgtcgatacggtcagcgcgagcacctcaattgttgcgccccacctgttcgaccagaggtccaggggcccccaccgccccctccgccggacgttccatgtcgtcgcctgccgccccctggccaccgccttcgcgggccgccgcctcgtggcccgggtcaccaggcagccgtcgccgcggctcgcggactggccggtcaaggcgctggccatgggggtgaccaaggaggccagcccgcgcagggagtaccggggcatccccggggacggcggcgacatgggggatgctggggtcaccaacccggccccatcctggcccccgcggaacagggcggatgaccccaagctgcacaaccccctgctccgcctcgagcggatgggctgcgggtggctcggcgtcgtcttcgagtgggagggggtcatcgtcgaggatgatgccgaattggaaaggcaggcatggttgaccctggcacaggaggaggggaagtcgccgcctccggctttcctgttgaggagagtcgaagggatgaagaacgagcaggcgatttctgaggttctctgctggtcccgggacccctcggagctcaggcgattggcctcacgaaaggaggagatacacagcagctttcgaggtggctctttgtaccagatgaggaacggttcgcgggagttcatgagcacgctggccaattacaagatccctatcgctgtggccaccacacgcccacggaaggttattgaagaagccatcgaagctgttggcgcgcggaatttctttgatgctgtcgtggcagcggaggatgtctatcgagggaagcctgaccctgaaatgtttctgtacgctgctcagctcctaagcctcatcccggagaggtgcatcgtgttcgggaactccaactctgtggtggaagccgctcatgatgctcgcatgaagtgtgtcgcggtcgcaagcaagcacagaatctatgagcttagcgctgcagatcttgtggtgaagcaactggatgagctatctgttgttgacttgaagaacctcactgatatcgagtctccagagtttggcatggaacctgaaccagagatggaggaagaagcatccacaccatcatcatcagtgggtgtagatttattctggtaagaggccagattgtacatttgattgattcctctcctgcacagcatgtattattgtcaactgttgtagcgatcaggaagaagggcttatcatccttctaatcagtagaatgtgatatgtaaaaatgttgtttagagctcacacactgtatatatactcagaaagaaagcagggaactaaatatatcgatcaggccatttggaactgcagttcctgaaactatgtataacaccacagcaattctattatgaaatcggtgttccaggtgct

SEQ ID NO: 17817 - protein, 379 aa, Panicum virgatum
  misc_feature: Ceres CLONE 1794747
  misc_feature (131)..(319): Pfam Name: Hydrolase Pfam Description: haloacid dehalogenase-like hydrolase
  misc_feature: SWISSPROT Homolog: EC 5.4.2.6 Beta-phosphoglucomutase
MVVDTVSASTSIVAPHLFDQRSRGPHRPLRRTFHVVACRPLATAFAGRRLVARVTRQPSPRLADWPVKALAMGVTKEASPRREYRGIPGDGGDMGDAGVTNPAPSWPPRNRADDPKLHNPLLRLERMGCGWLGVVFEWEGVIVEDDAELERQAWLTLAQEEGKSPPPAFLLRRVEGMKNEQAISEVLCWSRDPSELRRLASRKEEIHSSFRGGSLYQMRNGSREFMSTLANYKIPIAVATTRPRKVIEEAIEAVGARNFFDAVVAAEDVYRGKPDPEMFLYAAQLLSLIPERCIVFGNSNSVVEAAHDARMKCVAVASKHRIYELSAADLVVKQLDELSVVDLKNLTDIESPEFGMEPEPEMEEEASTPSSSVGVDLFW

SEQ ID NO: 17818 - DNA, 633 bp, Panicum virgatum
  misc_feature: Ceres CLONE 1794769-R
  misc_feature: Encodes the peptide sequence at SEQ ID NO. 17819
cctgaacgagcgggagatggcgcgcgcggcggcggcggccgggttcgaggtgcgcgtggcggagcccgaccagcacacggacatggcgacgttcgcgcggctggtgaactcggcggacgtgatggtgggcgtgcacggcgccgggctgaccaacatggtgttcctgccccgcggcgccgtgctgatccaggtggtgcccttcggcgggctggagtggctcaccggcgtcacgttcaaggacccggcggcggacatggaggtgagctacatggactacaacgtgaggctggaggagagctcgctgatcgaccagtacccgaggaaccgccaggtgctcaccgacccctacgccgtgcacaagcagggctgggacgcgctcaagacggcctacctggacaagcagaacatccggatggacctcgacaggttcaaggccacgctgcaggaggccatgagccggctgccatgaccaccggctccgtccgggaggaggtagataggttggtgtatctatctatcggacggacacacctgcgcctgccttgtggtcgctcgctcaacttcgacttcttttttttttcgagcttcgatcgatcctttttagcaagattcattggatccattgttttgtcg

SEQ ID NO: 17819 - protein, 155 aa, Panicum virgatum
  misc_feature: Ceres CLONE 1794769-R
  misc_feature: Functional homolog of the protein sequence given in SEQ ID NO 50315
  misc_feature: Useful for making plants with altered carbohydrate content
LNEREMARAAAAAGFEVRVAEPDQHTDMATFARLVNSADVMVGVHGAGLTNMVFLPRGAVLIQVVPFGGLEWLTGVTFKDPAADMEVSYMDYNVRLEESSLIDQYPRNRQVLTDPYAVHKQGWDALKTAYLDKQNIRMDLDRFKATLQEAMSRLP

SEQ ID NO: 17820 - DNA, 577 bp, Panicum virgatum
  misc_feature: Ceres CLONE 1794769
aaagcatctcgagccttccttccttgtcctcgcccccgttcccattccctgccggtgccagctcgcccgcccaccctttcttcttcggcttaggagagagagcagcaggtcggagggggcagcgaaaggcggccgcttcgggcgcggcgcgccagatctgggccgggtgggggctccggccggcaggcggcggctgcggcgggaggaggaggacggcgagatgaagccgtcgctgcggagccggcaggagccgcggcgggtcagcaacggcgtcatcatcggcgccatgctgctctcgctctgcgtcctcagcatcgtcaaggccagatactgcgccacccccttcggtacgccctccctgtcctccagcatcacatcatcccgtcccctctcgatccggccgtgtggtggggaagcggctccctttgctgacgtttcgctcttgtggccgtgcgcgcaggcaaggcggaggaccagctccaggagcagatgaacgccagcatccggatggagacggaggagtcgccggccaggacgcccggagagggggagaggagggaaaaaagaaggtgtccag

SEQ ID NO: 17821 - DNA, 1216 bp, Panicum virgatum
  misc_feature: Ceres CLONE 1794771
  misc_feature: Encodes the peptide sequence at SEQ ID NO. 17822
caccaagcacacaaattcagacactactccaaggagcgagctaccaagtgcagcagcagtgtgttcagtgttcctacactttggcactcggtgctctctagtctctacgagccgatgacgggacagacggagattccggtgatcgacctcgccggcctcaccgccggcggcgaggagaggtcgcgcaccatggcgcgcctccacgaggcctgcagggactggggcttcttctgggtggagaaccacggcgtggacgcggcgctcatggacgaggtcaagcgcttcgtctacgcgcactacgaggagcacctcgaggccaggttccacgcctccgacctggccaagaacctgccggcggccggcgacgaggagccctccgacaaggtggactgggaggccacctacttcatccagcaccgcccccggaacaccaccgccgacttcccggagatctcgccgccggccagggcggcgctggacgcgtacgtcgcccaggtggtgtccctcgcggagcgcctggccgagtgcgtgggcctcaacctgggcctccccgccggccacgtcgccgccgcattcgcgccgccgttcgtgggcaccaagttcgccatgtacccgccctgcccgcgcccgggccgtgtgtggggcctgcgcgcgcacaccgacgccggcggcatcatcctgctcctccaggacgacgccgtgggcgggctcgagttcctccggggcggagccgagtgggtccccgtggggcccaccaggggcgcccgcctcttcgtcaacatcggggaccaggtcgaggtcgtcagcggcggggcctaccggagcgtcgtgcaccgcgtcgcggcggggagcgaggggcggcggctgtccgtggccacgttctacaaccccgggcccgacgccgtggtggcgccggcggtgaggggggacgacgacgcggcggcggcggcctcctacccggggccctacaggttcggggactacctcgagtactaccagggcaccaagttcggcgacaaggacgccaggttccaggccgtcaagaagctgctcggttgagccaccaggcagagcttggagatcccgcgtttcgattcttggcgctgttgcttgttgatgattgatgatccatggcttgcgttggggttgcattgcgtgtttgctttagcaaatctttttacgtgatgggtagtaattattaattgtacgcattcgg

SEQ ID NO: 17822 - protein, 314 aa, Panicum virgatum
  misc_feature: Ceres CLONE 1794771
  misc_feature (157)..(259): Pfam Name: 2OG-FeII_Oxy Pfam Description: 2OG-Fe(II) oxygenase superfamily
  misc_feature: SWISSPROT Homolog: EC 1.14.17.4 Aminocyclopropanecarboxylate oxidase
MTGQTEIPVIDLAGLTAGGEERSRTMARLHEACRDWGFFWVENHGVDAALMDEVKRFVYAHYEEHLEARFHASDLAKNLPAAGDEEPSDKVDWEATYFIQHRPRNTTADFPEISPPARAALDAYVAQVVSLAERLAECVGLNLGLPAGHVAAAFAPPFVGTKFAMYPPCPRPGRVWGLRAHTDAGGIILLLQDDAVGGLEFLRGGAEWVPVGPTRGARLFVNIGDQVEVVSGGAYRSVVHRVAAGSEGRRLSVATFYNPGPDAVVAPAVRGDDDAAAAASYPGPYRFGDYLEYYQGTKFGDKDARFQAVKKLLG

SEQ ID NO: 17823 - DNA, 163 bp, Panicum virgatum
  misc_feature: Ceres CLONE 1794771-R
gagaatgagatatagggctcagaccttgccaggccaatggccgtttcttgtttgtctttagtcttaggatgagttgatttggcatacatacctcatatggttgttatgtatggcatatctatggttttgtttgatgagatcgtcataattattccgttgtctc

SEQ ID NO: 17824 - DNA, 505 bp, Panicum virgatum
  misc_feature: Ceres CLONE 1794780
  misc_feature: Encodes the peptide sequence at SEQ ID NO. 17825
ccagaggcccagtcaaagcctactctcctttctctctctagtctctctgcccatctctctccccgcaggctgctgctccgtgctccctccccagagagagagaaaccctagctcgcggctcgccggatggatcctcagcagccggaaccggtcagctacctctgcggagattgtggagccgagaacacgctgaagccgggtgatgtgatccagtgccgcgagtgcggctaccgcatcctctacaagaagcggacccgccgaattgtccaatatgaagcgcgctgaagaaaagggagccatgttggttgtgcctcaagcagtgtaacaggccgcctgggggaatgaatgactcgtggtgattcgtatggtaactcgtgtgtactaggttgtaacggtgcactgtactgcacctggaagcgttgaaacactcggaaatgtggatgggtgtcagatatatcctataagtattgaaatagtatgattgcttggaacctaataagtacct

SEQ ID NO: 17825 - protein, 52 aa, Panicum virgatum
  misc_feature: Ceres CLONE 1794780
  misc_feature (11)..(42): Pfam Name: DNA_RNApol_7kD Pfam Description: DNA directed RNA polymerase, 7 kDa subunit
MDPQQPEPVSYLCGDCGAENTLKPGDVIQCRECGYRILYKKRTRRIVQYEAR

SEQ ID NO: 17826 - DNA, 476 bp, Panicum virgatum
  misc_feature: Ceres CLONE 1794786
  misc_feature: Encodes the peptide sequence at SEQ ID NO. 17827
aaggagcggctggcgaaggtgtacgaggtcaaggaccccaactgcatcttcgtcttcaagttccgcacccacttcggaggcggcaagtccaccggcttcggtctcatctacgacaacctcgaggccgccaagaagttcgagcccaagtatcgcctcatcaggaatggtcttgctaccaaagtagagaaatctcgtaagcagatgaaggagcggaagaacagggcaaagaagatccgtggtgtgaagaagacaaaggctggcgatgccaagaagaagtaaggctggaaacttgccttgccgtcttgatcttgtctgcctcgggcttgttgaggacggtgtccttttggcaatgctgaatgtttaattagacctagaaaggattttgccagaattatgttgaggctctcgtagtactttgtagtcagttttgaggaacattgtcaggcactagcatatatacttgatcgtcattgctt

SEQ ID NO: 17827 - protein, 92 aa, Panicum virgatum
  misc_feature: Ceres CLONE 1794786
  misc_feature (1)..(66): Pfam Name: Ribosomal_S24e Pfam Description: Ribosomal protein S24e
KERLAKVYEVKDPNCIFVFKFRTHFGGGKSTGFGLIYDNLEAAKKFEPKYRLIRNGLATKVEKSRKQMKERKNRAKKIRGVKKTKAGDAKKK

SEQ ID NO: 17828 - DNA, 554 bp, Panicum virgatum
  misc_feature: Ceres CLONE 1794793
  misc_feature: Encodes the peptide sequence at SEQ ID NO. 17829
agccagccgatggcctcctccgccatggagctctccctcctgaaccccgccgcaatgcgccaccgcgccgccaggccctcttccgccggcctgccgctggcccgccgctccgcggtccgcttccgcgcgtcggcctccgccgcgccgcccaagccctcgggccccaagaagcggggcaagacggagatccaggagacgctgctcacgccgcggttctacaccaccgacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaagatggacggcccgctccgccagatattcgtcgagttcctcgagcgctcctgcaccgcggagttctccgggttcctcctctacaaggagctcgggcgcaggctcaagaaaaccaacccggtggtggctgagatcttctcgctcatgtccagggacgaggcgcgccatgctgggttcttgaa

SEQ ID NO: 17829 - protein, 181 aa, Panicum virgatum
  misc_feature: Ceres CLONE 1794793
  misc_feature: SWISSPROT Homolog: EC 1.14.13.81 Magnesium-protoporphyrin IX monomethyl ester (oxidative) cyclase
MASSAMELSLLNPAAMRHRAARPSSAGLPLARRSAVRFRASASAAPPKPSGPKKRGKTEIQETLLTPRFYTTDFDEMERLFNAEINKQLNQAEFDALLQEFKTDYNQTHFVRNPEFKAAADKMDGPLRQIFVEFLERSCTAEFSGFLLYKELGRRLKKTNPVVAEIFSLMSRDEARHAGFL

SEQ ID NO: 17830 - DNA, 699 bp, Panicum virgatum
  misc_feature: Ceres CLONE 1794798
  misc_feature: Encodes the peptide sequence at SEQ ID NO. 17831
attccctctccgccccgttccacctgccgccgccgccgccttcgggaatccagatggcgtccgcggccgcgcacccgacctcgctctccatcgcggcccgcgcggccaccagggccgccgccgccgccgccgccgccgccaccccgctgcgcagggggggcctcgcggcggcgtgccagccggcgcggtcgctggcgttcacggcggccgacgcgcggctcgcggtccacgtcgcgtcgcggtgccgccaggcgtcgtccgcgcgcgggacccgcgccgtggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgcgccgccgtcccgaccatccagtacctcatcggcaagggcgccaaggtcatcctctccagccacttgggtcgccctaagggtgttactcccaagtttagcttagctcccattgtaccacggctgtctgagcttcttggaattcaggtgcaaaaagctgacgattgtattggccctgaagttgagaaattggtgtctgccttgcccaatggtggtgtttgtctcctcgagaacgtaagattttacaaggaagaggagaagaatgacccagagtttgcgcagaagcttg

SEQ ID NO: 17831 - protein, 215 aa, Panicum virgatum
  misc_feature: Ceres CLONE 1794798
  misc_feature (80)..(215): Pfam Name: PGK Pfam Description: Phosphoglycerate kinase
  misc_feature: SWISSPROT Homolog: EC 2.7.2.3 Phosphoglycerate kinase
MASAAAHPTSLSIAARAATRAAAAAAAAATPLRRGGLAAACQPARSLAFTAADARLAVHVASRCRQASSARGTRAVATMAKKSVGDLTEADLEGKRVFVRADLNVPLDENQNITDDTRIRAAVPTIQYLIGKGAKVILSSHLGRPKGVTPKFSLAPIVPRLSELLGIQVQKADDCIGPEVEKLVSALPNGGVCLLENVRFYKEEEKNDPEFAQKL

SEQ ID NO: 17832 - DNA, 660 bp, Panicum virgatum
  misc_feature: Ceres CLONE 1794798-R
  misc_feature: Encodes the peptide sequence at SEQ ID NO. 17833
cttttgggtggtggtatgatcttcacattttacaaggcacaaggactttctgttggttcttcgttggtcgaggaagacaaacttgagcttgcaacatctctgcttgcaaaggcaaaggaaaagggtgtctcccttatgttgccaactgatgttgtcattgctgataagtttgcccctgatgctaacagccagattgttccagcatcttcaattcctgatggttggatggggctggacattggcccagattctattgcttcattcaatgcagccctggacacaacccagacaatcatctggaatgggcccatgggtgtttttgaattcgacaagttcgctgtaggaactgaggctgttgcgaagaagttggcagagcttagcggcaagggtgtcacaaccatcattggaggtggagactctgttgcagctgttgagaaggtgggagttgctgatgttatgagccacatttcaacgggaggtggtgccagcttggaattgttggaaggaaaggagcttcctggagttgttgcgttggatgaagccgtccctgtgactgtatgagttttcaatttgtttctccttcatcttcgtgtaccatgtaaacttgctacactcttgctcgctccttgtcagccgctcgaaatgcaagatcaatgcttt

SEQ ID NO: 17833 - protein, 186 aa, Panicum virgatum
  misc_feature: Ceres CLONE 1794798-R
  misc_feature (1)..(178): Pfam Name: PGK Pfam Description: Phosphoglycerate kinase
  misc_feature: SWISSPROT Homolog: EC 2.7.2.3 Phosphoglycerate kinase
LLGGGMIFTFYKAQGLSVGSSLVEEDKLELATSLLAKAKEKGVSLMLPTDVVIADKFAPDANSQIVPASSIPDGWMGLDIGPDSIASFNAALDTTQTIIWNGPMGVFEFDKFAVGTEAVAKKLAELSGKGVTTIIGGGDSVAAVEKVGVADVMSHISTGGGASLELLEGKELPGVVALDEAVPVTV

SEQ ID NO: 17834 - DNA, 1781 bp, Panicum virgatum
  misc_feature: Ceres CLONE 1794799
  misc_feature: Encodes the peptide sequence at SEQ ID NO. 17835
aggctgtagccatttggtatcgggtagatacaggacacgcttctctgctagtcacctgacgtgctagcgtccagcatccatggctgatttctggttgctgcttctgctcgccgtcagtgcagtctgggttcttcaagcatggagcctatggagagcccgagggctcggcaagaaggcggggaaggcggcggcgtacacgtacccgccggggctggagccgtacccgctgatcggccacctgccgcagttcctggcgaaccggcaccgcgtgctggactggatgtccgaggcgatcgagcgccatcccacgagcacgttcgtgctgcgccggccgggcggcgtgcggggcgcgatcaccgcgaacccggcgaacgtggagcacttcctgcgcggcagcttcgacaactaccccaaggggccccggttcgcgtcgctgctccacgacttcctcggccggggcatcttcaacgccgacggcgaggcctggcgcgcgcagcggaaggtggccagccacgagttcaacacgcgctcgctccgcgccttcgtggcgcgctgcgtgcacgccgagctgcacggccgcctcctcccactgctgcgccgcgccgcggcgtccggcgcccgcctcgacctccaggacgtgctcgagcggttcgcgttcgacaacatctgccgcgtcgccttcgaccacgacccgcgccagctcccggacggcggggacgacgcgacggacggcggcttcgccgacgcgttccgcgacgccgcgaatctcagcgcggggcggttccggtacgccgtcccggggttctggaagatcaagaaggcgctgaacgtggggtccgagcggcggctgcgcgagtccatcgccatggtgcacgacttcgccgatcgcatcatccagtcgcgccgggaggagatgcggagggacggcttcgagaagcacgacctcctgtcgcggttcatggcgagccaggacgagacctactccgagtccgaggtgcccctccgcgacgtcgtgatcagcttcctactggccgggcgggagaccacgtcctcggcactcacctggttcttctgactcctctccccgcgtccggacgtgcagcgccgcatccgcgacgaggtcgccgcggtgcgcgcccggcgcgcgcagggcgacgacgtcgtcggcttcgacctggacgagcttcgcgagatgcactacgtgcacgcggccatcacggagtcgatgcggctgtacccgccggtgccggtgaacacgctgcgggcggagacggacgacgtcctgcccgacggcacggccctgcaggcggggtggttcgtggcgtacaattcgtacgggatggggcggatggagtcgatctggggccgcgacgcgcgggagtaccggccggagcggtggctgaaccccgccgacgggacgttccggccggacagcccgttccggttcgtggcgttccacgcggggccgaggctgtgcctgggcaaggagatggcctacatccagatgaagtccatcgtggcgtgcgtccttgaggagctcgacgtggccgtcgacggcgcgtaccgcccccggaaggtcgcgtcgctgacgctgcggatggcggacgggctccccgtgaccgtgaagccgagacgagactgctgagctgacgacccatcagtctctgcagacaagtagttgcagatgacaaggtgttacgttggtagttcgctatcgtttgggcccgttaccctgttgcgttttggaatcccctgtatagaaataaaaaggagattccgat

SEQ ID NO: 17835 - protein, 331 aa, Panicum virgatum
  misc_feature: Ceres CLONE 1794799
  misc_feature: SWISSPROT Homolog: EC 1.14.14.1 Unspecific monooxygenase
MADFWLLLLLAVSAVWVLQAWSLWRARGLGKKAGKAAAYTYPPGLEPYPLIGHLPQFLANRHRVLDWMSEAIERHPTSTFVLRRPGGVRGAITANPANVEHFLRGSFDNYPKGPRFASLLHDFLGRGIFNADGEAWRAQRKVASHEFNTRSLRAFVARCVHAELHGRLLPLLRRAAASGARLDLQDVLERFAFDNICRVAFDHDPRQLPDGGDDATDGGFADAFRDAANLSAGRFRYAVPGFWKIKKALNVGSERRLRESIAMVHDFADRIIQSRREEMRRDGFEKHDLLSRFMASQDETYSESEVPLRDVVISFLLAGRETTSSALTWFF

SEQ ID NO: 17836 - DNA, 1825 bp, Panicum virgatum
  misc_feature: Ceres CLONE 1794800
  misc_feature: Encodes the peptide sequence at SEQ ID NO. 17837
gtaggctgcctctcttttctcttctcttgtctgacttcctcctccgggagtccagctcaccaggaaggagaagttccatagccttcttggctcatccgcccgcgtccacgctcgaacagttgagtcgctcttcctctcccaatttcccccattgttccatcgatctccctcctggagttgtagaagtagaaccggatgtacccgcgctcggcagcaagaagcagcaagcgcgggacgtttctcccccggcgtcagaggattaggtaagctaagcaggccgccgtagagccatggggtgcggggcgtcgagccagaaggacgccgtcggcgggccccggagacggccggggagcgtcggcgacgtggtcgtgttcctcccggggctccgggtgccgaggagcatcgacctcgcccaggcgctcggcgggcgcctggacagcagcatcgtggagcggctgtcggctctgagagcgcgcgtcgtcgagatggcaaggcaagagtcggcggcggcgctgaagccgaggcggaagacggcggcggcacggcacgggtctagtacagccagtctcctacaggccctcgaagactacttgccagttcttctaggattggtaaaagaaggtagtacgttgaggcacacagtgcaattcacctggactaaccaagaggataatgccgccgaggagacgaccatggcagatgcctggtacgaggtgctgtccgtgctgcatttgatggccatggtctgcttgcttcaggccaacaccctgcttctccccaggtcatacggcgatggctatgcaccaagagtttccgaagagagcagacgggccactgtcgatgttttcttgaaggcagcgggatacttagactgcgcaattcggcatgtaattccacagattccacccgaactaaggaggcaacttccagtagacctggttgaaggaaatctcaaagctataagcctgcaagctctgggtcagggggttgacatgcagcttggtttggctattgatagtccaaaggccactttagcagtaaaacggcgcttagcctgtgaaatggtcaagtattggcaacaagttcaggaaaacattccagatcttcctggctctgatggatgggggaaaaagcaccggctgtttgtcaagtggaaatatgttgaagcaaaggctgcagcatactattttcatggtttgattcttgatgagggaaacacggagaaatcccatggaatggcaatagctgcacttcaagcttcagaagaatttctaaaagaaagcaaaaggatttcagaagcattccatgcaactcctccaacatcgaggagccctactccattcggaacagcaaaatatatgtttgacaagatcccaaaagatgcttcaagcaaggtccgaatcaaccaggacctatatactcaagaaaaggtgataggaactccgccccccttaccagattttgcattggcactaacgccagaagactatgatcttcctccattagatccactttggaacaaagaagacaggcgtcagtaggtgtatatgcaactgaatggtttcttcagacgaagagcttggctttggagagaaaggagaagaaacagatctgccatgccaaagctgaacatggtaacaaatgaagtgtacaaagtatgtttgaacaaaatcacgagtcaaaaaaaagcaagcaaaatttaggaatgcctgaagataatctgaagagcattgtacaggcattttttcttctgacaagggaaatgctttgtaaaaggtttgattgaccattatcgatcctgattcctgatgttcggatgttccgg

SEQ ID NO: 17837 - protein, 416 aa, Panicum virgatum
  misc_feature: Ceres CLONE 1794800
  misc_feature (27)..(413): Pfam Name: BRO1 Pfam Description: BRO1-like domain
MGCGASSQKDAVGGPRRRPGSVGDVVVFLPGLRVPRSIDLAQALGGRLDSSIVERLSALRARVVEMARQESAAALKPRRKTAAARHGSSTASLLQALEDYLPVLLGLVKEGSTLRHTVQFTWTNQEDNAAEETTMADAWYEVLSVLHLMAMVCLLQANTLLLPRSYGDGYAPRVSEESRRATVDVFLKAAGYLDCAIRHVIPQIPPELRRQLPVDLVEGNLKAISLQALGQGVDMQLGLAIDSPKATLAVKRRLACEMVKYWQQVQENIPDLPGSDGWGKKHRLFVKWKYVEAKAAAYYFHGLILDEGNTEKSHGMAIAALQASEEFLKESKRISEAFHATPPTSRSPTPFGTAKYMFDKIPKDASSKVRINQDLYTQEKVIGTPPPLPDFALALTPEDYDLPPLDPLWNKEDRRQ

SEQ ID NO: 17838 - DNA, 1577 bp, Panicum virgatum
  misc_feature: Ceres CLONE 1794805
  misc_feature: Encodes the peptide sequence at SEQ ID NO. 17839
atctccaaggcttccatttccaacgatggagctcgcagcaacgttgtccatggccatggcattggtggctgtcttggtagtcttcgtcctcagctccgtcgtcctgccacgcggccggcggaaggcactgaaccttccgccggggccgcggggttggccggtgctcggcagcctcggcgttctggcgggcgcggccccgccgcaccgcgtgctggccgcgctcgcggcgcgccacggcccgctcatgcacctccgtctcggctcctaccacaccgtggtggcctcgtcggcggagaccgcccgcctcgtcctcaagacccacgacctcgccttcgccgaccgcccgcccacggccgccggcgagatcacctcctacggctaccggggcaagctctgcgccaccgagctcttctcggcgcgccgcgtcgactcgttcgagcgcgtccgcgcgcaggagatgcgcgcgctggcgatcggcctgttccggtgcgccggccgcgccgtcgccgtccgggagcacgtcgccggcgccacgctgcggaacatcctccgcatggctgtcggggagaagtggtcgggctgctacggcagcgccgagggcgaggcgttccggcgcacgctggacgaggcgttcgcggcgaccggggcggtgagcaacgtcggcgagtgggtgccgctgctgggctggctcgacgtgcagggctgcgcgcggcagatgaggcggctgcgcgagctctacgaccggttctacgagaagatcgtggacgagcacgaggagcggcggcggcgggccgatgccgccgccggtgagttcgtggcgagcgacctcgtcgacgtgctgttgcagctcgcagaggaggacaggccggagtcggaggccaggctcacgcgcgtcggcgtgaaggccttcatccaggacatcatcgccggcggcacggagagctcggcggtgactatagagtgggccatgtcggagcttctccgccacccggaggccatggcgggcgccaccggcgagctcgaccgcgtggtcggccgcgggcgctgggtaaccgagcgcgacctgccggacctcccttacatcgacgccgtcgtgaaggagacgctgcggctgcacccggtgggcccgctcctggtcccgcaccacgcccgcgaggacacggtggtcgccggctacgacgtgcccgccggcgcgcgcgtgctggtgaacgcgtgggccatcgcgcgcgacccggcgtcgtggcccgacgcgcccgacgcgttccggccggagcggttcctgggcggcggcgccggcgccggcgtggacgtccgcggggcgcacttcgagctgctgccgttcggggccgggcggcggatctgcccggcgtacgacctcgcgatgaagctggtggccgccggcgtggcgatcatggtgcaggggttcgcgtggcggctgccggacggggtggcattgttccaatgttcaataaaggatctactatgtctacagcgcttgaattttctgctagtctatatctatatctattactaaagcatgtaaagtttccatccaaatttttggtttgatccgtctc

SEQ ID NO: 17839 - protein, 502 aa, Panicum virgatum
  misc_feature: Ceres CLONE 1794805
  misc_feature (38)..(496): Pfam Name: p450 Pfam Description: Cytochrome P450
  misc_feature: SWISSPROT Homolog: EC 1.14.13.21 Flavonoid 3'-monooxygenase
MELAATLSMAMALVAVLVVFVLSSVVLPRGRRKALNLPPGPRGWPVLGSLGVLAGAAPPHRVLAALAARHGPLMHLRLGSYHTVVASSAETARLVLKTHDLAFADRPPTAAGEITSYGYRGKLCATELFSARRVDSFERVRAQEMRALAIGLFRCAGRAVAVREHVAGATLRNILRMAVGEKWSGCYGSAEGEAFRRTLDEAFAATGAVSNVGEWVPLLGWLDVQGCARQMRRLRELYDRFYEKIVDEHEERRRRADAAAGEFVASDLVDVLLQLAEEDRPESEARLTRVGVKAFIQDIIAGGTESSAVTIEWAMSELLRHPEAMAGATGELDRVVGRGRWVTERDLPDLPYIDAVVKETLRLHPVGPLLVPHHAREDTVVAGYDVPAGARVLVNAWAIARDPASWPDAPDAFRPERFLGGGAGAGVDVRGAHFELLPFGAGRRICPAYDLAMKLVAAGVAIMVQGFAWRLPDGVALFQCSIKDLLCLQRLNFLLVYIYIYY

SEQ ID NO: 17840 - DNA, 833 bp, Panicum virgatum
  misc_feature: Ceres CLONE 1794808
  misc_feature: Encodes the peptide sequence at SEQ ID NO. 17841
acaaggacgaaggacctcagcccagagcctacccatctccgatccctctccagccgatccgccggcagggagaaataaagcagcaagcgatggcgtccggcgggcagcggtccatggcgtccgccctcctgttcctgaacctcatcatgtacgtcgtcgtcgcggccatcgccggctgggccatcaactacagcatcgacgagagcaggaactcactgcagggcgtgtccccgccggtgcgcctgttcccgatctacttcccgatcggcaacctggcgacggggttcttcgtcatcttcgcgctcgtcgccggcgtcgtcggcatctccacctccctcaccggcctgcacgacgtcggccaggggctcccggccaacatgatgtccgccgccgccgccgcgctcgtcacctggaccctcaccctcctcgccatggggctggcctgcaaggagatcagcgtcagctggaggcccgcgagcctgcgcaccttggaagcgttcaccatcatcctggccgggacgcagctgctctgcgccgggtcgctccacgccggcgcgcacgcggccatcctcaccacccccatcggcggcagggtctgatgatgacgtgatcgactgagagtctgagacggcggcggcgacgacggacatgtatacgagagacttgtcatcttgggcacgcagtgggtcggcggtctgcgcgtgatcgatgtgtgtgtgtgtggcccggtgggtgcttgaaattcgtgtgtgctattcgctttcaaggtgtttggtgttggtctcgtggtgaattattgaactatatatatatggtatggcgattcttttccg

SEQ ID NO: 17841 - protein, 169 aa, Panicum virgatum
  misc_feature: Ceres CLONE 1794808
  misc_feature (15)..(156): Pfam Name: AWPM-19 Pfam Description: AWPM-19-like family
MASGGQRSMASALLFLNLIMYVVVAAIAGWAINYSIDESRNSLQGVSPPVRLFPIYFPIGNLATGFFVIFALVAGVVGISTSLTGLHDVGQGLPANMMSAAAAALVTWTLTLLAMGLACKEISVSWRPASLRTLEAFTIILAGTQLLCAGSLHAGAHAAILTTPIGGRV

SEQ ID NO: 17842 - DNA, 1559 bp, Panicum virgatum
  misc_feature: Ceres CLONE 1794809
  misc_feature: Encodes the peptide sequence at SEQ ID NO. 17843
atcgcatcatcttcttctcgcacaagttgagggcaggccgtcgaatcggatcttcttccagcacaactcgagggcggcggcggctactaaacccaccccacacgcgcccttcctttccgagcccgacgcgatcagccgagcgatgtcgtcgtcggcgcccgcgccggctgccatggccgtggacgacgcggaggacgaccagctcgcctccatgtccacggaggacatcatcagggcctcccgcctcctcgacaacgagatccgcgtccacaaggacgagctgcagcgcacgaacctggagctcgagtccgtcaaggagaaaatcaaggagaaccaggagaaaatcaagcttaacaagcagctgccctacctcgtcggcaacatagtcgagattttggaaatgaaccctgaggatgaggctgaagaggatggtgctaatattgacctggactcacaaaggaaggggaaatgtgttgttcttaagacatccacgaaacaaactatattccttcctgtaattgggttagttgaccctgataagctgaagcctggtaatttagtaggagttaacaaagacagctacttgatactagatacattgccttctgagtacgactcacgggtgaaggctatggaagtagatgaaaagcctactgaggattataatgacatcggaggactcgagaaacagattcaagagcttgtggaagctatagtgttgccaatgacacacgaggatcgcttccagaagttgggtattcgtccccctaagagggttcttttgtacggaccacctgggactgggaagacgctcatggcccgtgcatgcgctgcgcagactaatgcgacatttctgaaattggctggtccacaacttgtccagatgttcatcggtgatggagctaagctcgttagagatgcttttcagctggcaaaggagaaagccccgtgcatcatctttattgatgaaattgatgccattggaacaaagcgttttgacagtgaagtgagcggtgatagagaagtacaaaggacaatgttggagttgctgaatcagcttgatggatttagcagcgatgagaggataaaggtgatagctgcaacaaatcgtgctgatattcttgatcctgctcttatgcgatctggccgtctggaccggaagattgagttccctcatccatcagaagaagcacgagctagaatcttgcagattcactcgaggaagatgaatgtaaatccggatgttaactttgaagagttggcgcgttcaactgatgatttcaacggtgctcagctaaaggctgtttgcgtggaagctggcatgcttgctctacgccgagacgcaacagaggttacccatgaggatttcaacgagggaatcatccaagtgcaggcaaagaagaagtccagcttgaattactatgcataaggaaacacttggttaagtttgtgatcgttcacatgtttgtgggcttgtggcaacttcgttgttgggtagcataacttatgattgtattaagcgagcacgtgttgttttactttatattatcagatctaac

SEQ ID NO: 17843 - protein, 428 aa, Panicum virgatum
  misc_feature: Ceres CLONE 1794809
  misc_feature (211)..(398): Pfam Name: AAA Pfam Description: ATPase family associated with various cellular activities (AAA)
  misc_feature: SWISSPROT Homolog: EC 3.6.4.3 Microtubule-severing ATPase
MSSSAPAPAAMAVDDAEDDQLASMSTEDIIRASRLLDNEIRVHKDELQRTNLELESVKEKIKENQEKIKLNKQLPYLVGNIVEILEMNPEDEAEEDGANIDLDSQRKGKCVVLKTSTKQTIFLPVIGLVDPDKLKPGNLVGVNKDSYLILDTLPSEYDSRVKAMEVDEKPTEDYNDIGGLEKQIQELVEAIVLPMTHEDRFQKLGIRPPKRVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 17844 - DNA, 3293 bp, Panicum virgatum
  misc_feature: Ceres CLONE 1794814
  misc_feature: Encodes the peptide sequence at SEQ ID NO. 17845
aaaaatttccgaaacgtggctcggaagtcggaacgcacgccgcgcagcatttccctccccgtccccccctcgccgcctcgccacctcccctcccggaaaatccaaaactgcgccgcccatgcgccggccgcgccactgcggcggcctccgcccgctgctgctgctcctacccttcgccgcgctcctctccgtcgctaccttctccctccactcccccgaccgcctcctcgtcaccgtcacggcgcggcggccgtcctcgtcaccccgccacctgcaccggctggccgtctcgagcctcgaagcgcgcgcgctcggcctaggaggcgccccgccgctccacgcggacgccgcgcgcgcgttccggtccggcgggcgcctcctccgcgacgtcctctcctcccccgcgccgccgccctcggccgctgccggcgcaacgcggcggtgcccgccctctgtcgtggtgtcgggcgcgcggctccggggcacgggtggcggtggcggtggcggcgtcctgtccctgccctgcgggctggcgctggggtcgcacgtgacggtggtgggctcgccgcggcgccgcggggacgtggcgcagttcgcggtggagctgcgcggggaaggggacggggacgcggccccgaggatcctccacttcaacccgcggctccgcggggactggagcggccggccggtgatcgagcagaacacccgcttccgtggacaatggggacccgcgctccggtgcgagggccgtcggtcgcgcccggacgaggagaccgtagatggattggtgaaatgcgaggaatggtctggaaacattggggacacatcaaaggagttgaagagattgtggttgcagaaccatatcactggacagaagagcagaaattggatagattggccatatccgttcattgaggatgaattgtttgttctaacactgagcactggtttagacggctaccattttcatgttgacgggaagcatgtcacttcttttccttaccgttttggctttgttcttgaggatgccactatcttgtctgtgattggcgacattgacgttcaatcaatagtagctggttcattaccaacagctcaccctagcattgttcaaagaaatctggagttgctaacagaactaaaagcccctcctctttctgaagagaatgtagagctattcataggcattctttcagcgggtaatcatttcactgaacgcatggccgcgaggagatcttggatgtcttcagtacgaaattcctccagcactgtggctcggttttttgttgcagtgaatggcagaagggaagtgaatgaagatttgctgaaagaggcagatttcttcggggacatcgtcattgtgccttttgtggatagttatgatctggtggttctgaagactattgccatttgcgactatgcggcttgtgttgttccagcgaagtatgttatgaagtgtgatgatgatacctttgttagacttgattcagtgatggctgaagttaagaaaatctcagacggcagaagcttttatttggggaacatgaattacttccaccggccactgcgagagggaaaatgggctgtctcatacgaggagtggcccatagaagagtacccgccctacgctgatggtgcaggctacattgtttcttctgacattgcaaacttcgtcgcatctgaaatggagaagggaagactaaatgtaagctctgtctccacttactatctccatttcatgacccatttcgcatcaaacagtagaagagattgcgcagcaggagcaaaccgcatagggcccactccagcactcagtaaccacctgctttaacttccgttcccttggatgatgccactcttgttggaaacagaaaagacacgaacccaatcatgcctgaccctgaaaagatttaccaaaagccaaaaagctaaaaggccgtgcccatcaccacgcaatgcagtgtgcacgggcgcttaacaaatgattgcattgccattgccattgcgtttcgtccagctattcaagatggaggatgtgagcatggggatgtgggttgggcggttcaacagctccgggaacgccgtggcgtacgtccacagccccaggttgtgccagtccggctgcgccgacggctacctgaccgcacactaccagtcgccggcgcagatggtgtgcctctgggagaagctgcggcaagggaggccgcagtgctgcaacgcaaggtgacacgaagaaacctttgccccctgaaagctcacctcggcatgaacgggaataggataggtagcaaaccacaggtaacgcttgtacatcattggagggtacctagccccgttttttgcactgatcggaagcagtgacgaccacggaatacatcgggtgaaaaggatagtttaagtttacacatcatatctgtaacataaacacaaccatattatatatagtataacaatctctcttggtatataaatatatacatgccacagtgtactgctccctaggtactgagcgtactgctggtccaaaagagtgcccagccgaattgtttttcggcaccaggctcatctatacagtatcctcaactccagatcggaatgtctgcgagttttttctttctttcttttgtcagcgacgtgccgtgacgaaaggggagagcgcggctgctgctgtggattgtccggcccggccgtgccggcgggccgaccctactaacatgcgcacctgtctggctggctcgacgtcctgtccgcgtactgtgccgcgccctccaactgaggtacgtgctcactgttcaggactagggagttaaaatcctttgggtgacttgggttggacgcgtggttagccttctctctcgcaagtaactgggcgcttgcattgctttattgagattcgggcatgcatggtgcatctgcattgttacccatctcagatggcatgtttggttggacatgctctgttacatggcatgtaaatctagatctcgttatagatctatatgccatgtacgaaatgtacatcagtttccaggaggtgaacacagagcggtgtttttttttcttaataacaaaagaaagaaaagtgagcatccagcttttgaaacatcatctaaacatgagatacttttctttctttatttttttcgaactagttttatctaataatttatggatgaggggctcagatcctgacatttatgccctttacggctttaattattggtattgctcgctcttgtactcaaaccatttactgctgcttccgtctttaatcatggatgcaaatatctgac

SEQ ID NO: 17845 - protein, 570 aa, Panicum virgatum
  misc_feature: Ceres CLONE 1794814
  misc_feature (129)..(320): Pfam Name: Gal-bind_lectin Pfam Description: Galactoside-binding lectin
  misc_feature (365)..(553): Pfam Name: Galactosyl_T Pfam Description: Galactosyltransferase
  misc_feature: SWISSPROT Homolog: EC 2.4.1.134 Galactosylxylosylprotein 3-beta-galactosyltransferase
  misc_feature: Functional homolog of the protein sequence given in SEQ ID NO 50128
  misc_feature: Useful for making plants with altered carbohydrate content
MRRPRHCGGLRPLLLLLPFAALLSVATFSLHSPDRLLVTVTARRPSSSPRHLHRLAVSSLEARALGLGGAPPLHADAARAFRSGGRLLRDVLSSPAPPPSAAAGATRRCPPSVVVSGARLRGTGGGGGGGVLSLPCGLALGSHVTVVGSPRRRGDVAQFAVELRGEGDGDAAPRILHFNPRLRGDWSGRPVIEQNTRFRGQWGPALRCEGRRSRPDEETVDGLVKCEEWSGNIGDTSKELKRLWLQNHITGQKSRNWIDWPYPFIEDELFVLTLSTGLDGYHFHVDGKHVTSFPYRFGFVLEDATILSVIGDIDVQSIVAGSLPTAHPSIVQRNLELLTELKAPPLSEENVELFIGILSAGNHFTERMAARRSWMSSVRNSSSTVARFFVAVNGRREVNEDLLKEADFFGDIVIVPFVDSYDLVVLKTIAICDYAACVVPAKYVMKCDDDTFVRLDSVMAEVKKISDGRSFYLGNMNYFHRPLREGKWAVSYEEWPIEEYPPYADGAGYIVSSDIANFVASEMEKGRLNVSSVSTYYLHFMTHFASNSRRDCAAGANRIGPTPALSNHLL

SEQ ID NO: 17846 - DNA, 1786 bp, Panicum virgatum
  misc_feature: Ceres CLONE 1794827
  misc_feature: Encodes the peptide sequence at SEQ ID NO. 17847
atatgaagctcatgtattttattaacaaaacaactcttcactagaactgtgccaatttgccaagtgaaggtagacaccttaagccccttgtgagctagtgaagtctagcaataaaatcaaggaaaacattccacgagagtaataatggcggatgaatcatggaggatacctatgctagtgcaagaactggcagccaaggtgcagcagccaccaagcaggtatgtgcagccggagcagtatcatcctgtcagcctagtggttgctgctgagaagccggagcccatccctgttattgaccttagccggcttttggctgctgatagtgctgatgatgagggaagcaagctccggtttgccttgcagagctgggggctcttcctggtcgataaccatgaaatagaaacttctttgatggatgatttgatcaacgcatcaagtgagtttttccatctgccagtcgaagagaaacagaagtgcagtaacttgataggcggcatgggctcgtggcggttcttgtagctggcgacgagcacctgcacaaggccgaggatggcgctcctgtcggccgccgccttgaggtagaagggcgagccgaggaggaagagcgtgagcgcggtgaccatgagcacgacgggcacggagaagccgacgaccctgcccctggcctgctggatgtagactatgacagtggctgcgaacacgatggagaggcccagcactgtgtagtaccagttgaagaaggtctgtagcgtcccccgccgctgccgcccctggggtcgcgacgcacagagcaaatggatttggatggaggggtatacacgtccatacaggaaaaatacgaggagctgtaccctgcgggtgggcctcaggagtaggaagaggtatcctgatggtatatctccaatatgatgaattgtaatagcatatttgcaactcctgaaagttgtaatggtatatctccaattaacccatggaaatgacccagtggcatcaaaggatcaaaccctggactggttggaccgacttcatctcagggtagagccagaagatgagaggaatcttgtccattggcccgaacgtcccaattgtttcaggtctcttttacacgagtacacgttgaagtgcaagagaatcaaagattgtatccttcgggcaatgtccaaggctctaggacttaatgaagattacattgttgcccagtttagtaacaaggctcccagttttgcaagattcaactactacccaccctgtccaagaccagaccttgtctttggtgtcaagcctcactctgacagcggtgttcttaccatccttctcatggacaaagatgttggtggacttcaagttcttagagatggtgcatggcacaatgttccaactaatccccacaggttgttgattaatataggagacttcgtagagataatgagtaatgggatcttcaagagcccagtccacagggctgtcacaaacgcggggaaagagaggatctcattggctatgttccatggcctggatcctaaggaggggattgagccggcgacagctctgttacatgagaagcaaccggcgcggtacaggaaaattaaagccaaggagtacctggctggattctacgaacatttttgtagaggaacaagatttatcgaggctggtagcttagtttctaacggagtatcaatggtgaatgaagaatgttttttgtcgtgtgatgtacataatatggatcaccagatgaatgtgctgaaggtcatcgctgggatttttatatatgaagaaatttctc

SEQ ID NO: 17847 - protein, 124 aa, Panicum virgatum
  misc_feature: Ceres CLONE 1794827
  misc_feature: SWISSPROT Homolog: EC 1.14.11.19 Leucocyanidin oxygenase
MADESWRIPMLVQELAAKVQQPPSRYVQPEQYHPVSLVVAAEKPEPIPVIDLSRLLAADSADDEGSKLRFALQSWGLFLVDNHEIETSLMDDLINASSEFFHLPVEEKQKCSNLIGGMGSWRFL

SEQ ID NO: 17848 - DNA, 2083 bp, Panicum virgatum
  misc_feature: Ceres CLONE 1794830
  misc_feature: Encodes the peptide sequence at SEQ ID NO. 17849
aattatccgtttctcggcttctcgcagcggctggctagagatctgtttggatcgtgatgaaaggacggatcgctgctccgcctcctactccaattccaattcttccgtagcatccacaaatcaaacctcaatggcgatctgaaccaaccttccagaaccatctggaagttcatggatcggatcttcaagtccgccagggagtcgggctccctcaacctctccaatcgctccctcagggacatacccaaggaggtgtacaacaacttggacacaggcagccaggatgagaaatggtgggagggagtggacctccagaagctcatactgactcacaataaccttgaagtgctaagagaagaccttagaaatttgtcttcacttgttgtgttaaatataagccacaacaagatatcttcccttccagcagctattggagacctgccattgctaaaatcgctggatgcatctttcaatcaaataagcactctgcctgaagagattggtctggccactgcattagtcaaagttgacctctcaaataattgtctttctgagcttccagctagcctcgccaaatgttcagacttgtcggaactcaaggcttcaaacaacaccatatcaagaataccagatgcacttgctggctgttccaagttaagtaaattggatctagagggtaacaagcttgtgactatttcggaaaacatgtttccatcctggacaatgctcacggagctaaatcttgcaagaaatctgcttacaaccaccccggatagtatcggagcacttcataaacttattcgcctggacatgcatcagaataaaataacatcaattcctccttccataaagggttgctcttctcttgctgagctctatatgggaaataacttattgtcatcaataccagctgatattggcacactatcaaaattaggaatacttgatctccattctaatcagctaaaggagtaccctgttggagcatgcaacctcaaactatctttcctcgatctatcgaataactcattatctggtctaccagctgaactaggtaaaatgactaccctcagaaagcttctgcttagtggaaatcctatgagaacacttaggagttcattggtttctggaccaacaactgcattactgaagtatctgcggagtcggctttcatctgatgaggaaggatctggaagcacaagcaccccgacaaaagatgaccaaattgctgcagcgaggcaattgtccttatcttcaaaggaattggacttgagcggtcttggtgtgactagtgtaccagcagtggcgtgggagacaaacgatgtagtcaaattggatctttctaaaaattcaatagaagatcttccaaatgagttatcaatatgttcatcacttcaatccttggtgttgtcgaataacaagataaaaaggtggccgcacacggtgatctcctcccttaccagtctgtcttccttaaagctggacaataatcccttggcagagatatcattcactgatctagtgtctctggccaaacttgaagtacttgatttaagtggcaatgcttcagcactacctgaaccttctgcagtttctgcgctaccacaactgcaggagctctacctaagacggatgaaactccatgaatttcctaatggtttgttggacttaaaacagctccggattcttgacctgagtcagaataacctcacaactgtaccagagggtataaagaatttcactgttctgatcgagcttgacctgtcagacaacaatataacagcgctcccagcagagctgggattgcttgagcctaacctgcaagtgctgaaacttgacgggaatccgcttagaagcataagacggactctgttggagcgaggaacaaaagcaattctcaagtatctcaaagaaaaattgcccgctcaataatgtctcgagaacaaactgttgcgggactcgggcaataatatgtttcttggccaccgtatcttttatttaagccttacaattttcctgcgaattctatggaatttggatcttgcgcgagaagtgagcgagatgccttatgcgtgttgtgatc

SEQ ID NO: 17849 - protein, 586 aa, Panicum virgatum
  misc_feature: Ceres CLONE 1794830
  misc_feature: SWISSPROT Homolog: EC 2.7.11.1 Non-specific serine/threonine protein kinase
MDRIFKSARESGSLNLSNRSLRDIPKEVYNNLDTGSQDEKWWEGVDLQKLILTHNNLEVLREDLRNLSSLVVLNISHNKISSLPAAIGDLPLLKSLDASFNQISTLPEEIGLATALVKVDLSNNCLSELPASLAKCSDLSELKASNNTISRIPDALAGCSKLSKLDLEGNKLVTISENMFPSWTMLTELNLARNLLTTTPDSIGALHKLIRLDMHQNKITSIPPSIKGCSSLAELYMGNNLLSSIPADIGTLSKLGILDLHSNQLKEYPVGACNLKLSFLDLSNNSLSGLPAELGKMTTLRKLLLSGNPMRTLRSSLVSGPTTALLKYLRSRLSSDEEGSGSTSTPTKDDQIAAARQLSLSSKELDLSGLGVTSVPAVAWETNDVVKLDLSKNSIEDLPNELSICSSLQSLVLSNNKIKRWPHTVISSLTSLSSLKLDNNPLAEISFTDLVSLAKLEVLDLSGNASALPEPSAVSALPQLQELYLRRMKLHEFPNGLLDLKQLRILDLSQNNLTTVPEGIKNFTVLIELDLSDNNITALPAELGLLEPNLQVLKLDGNPLRSIRRTLLERGTKAILKYLKEKLPAQ

SEQ ID NO: 17850 - DNA, 328 bp, Panicum virgatum
  misc_feature: Ceres CLONE 1794839
  misc_feature: Encodes the peptide sequence at SEQ ID NO. 17851
acgagcgccagccagtcacctaccccgaagccgccgcgaccgatcgagccgagcgccccgccccacgccgcgccgcgctgcaccgcaccgaaaccctagctccttctcctcagccatggccaccgtctcgctcacgccgcaggtggtcttctccaccgagtcgggcggcgccctctcgtccgccaccatcctccgcttcccgccaaacttcgtgcgccagctcagcaccaaggcccgccgcaactgcagcaacatcggcgtcgcgcagatcgtcgcggcggcgtggtcagactgccccgccggccgcccccactccgggcggcggcgg

SEQ ID NO: 17851 - protein, 70 aa, Panicum virgatum
  misc_feature: Ceres CLONE 1794839
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGRR

SEQ ID NO: 17852 - DNA, 666 bp, Panicum virgatum
  misc_feature: Ceres CLONE 1794839-R
  misc_feature: Encodes the peptide sequence at SEQ ID NO. 17853
ccaaatgctgcctacctgatccttcggggcatgaagacactgcatctccgtgtgcaatgtcagaataacactgctctgcggatggcccaatttttagaagaacatccaaagattgcacgtgtctactatcctggtttgccgagtcaccctgaacatcacattgccaagacccaaatgactggctttggtggtgttgtcagttttgagattgctggggattttgatggtacaaggagattcattgattctgttaagataccctatcatgccccttcttttggaggctgtgagagcattatcgaccagcctgccatcatgtcttactgggattcgaaggagcagagggacatatacgggatcaaggacaacctgatcaggttcagcattggagtggaggattttgaggatctgaagaacgatcttgttcaggcccttgagaaggtctaagcacttgattcgttcactttaatatgtatatcagatcatggttgtcctggatcttgagagatctgtgagaatatttgagccgatggctgccaataaattttctccttttgcttaatttgttctctcattccaataagttgacctctgtactctgcagtctcgggttgtgcaggacgcagtgttgaacttgttcttgtcaaagttcagttgattggcctc

SEQ ID NO: 17853 - protein, 148 aa, Panicum virgatum
  misc_feature: Ceres CLONE 1794839-R
  misc_feature (1)..(146): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
PNAAYLILRGMKTLHLRVQCQNNTALRMAQFLEEHPKIARVYYPGLPSHPEHHIAKTQMTGFGGVVSFEIAGDFDGTRRFIDSVKIPYHAPSFGGCESIIDQPAIMSYWDSKEQRDIYGIKDNLIRFSIGVEDFEDLKNDLVQALEKV

SEQ ID NO: 17854 - DNA, 2355 bp, Panicum virgatum
  misc_feature: Ceres CLONE 1794851
  misc_feature: Encodes the peptide sequence at SEQ ID NO. 17855
aatcccgctccttccgattccgcggcgtccgctcttcactagcgggaatcgcccggagcccgctgcgggactgcaggccggggcctcgcgctcgatcgattccggggggtgggagcagcgggcggcgcggcaatccaccagcaggctgaagctctccgtccgaagccgctccgcagggcgcgaggcgatggtggccgcgtcgaggaaggaggaggagaggaacgagcggatcgtgtggggcctcctcaagctgccgcccaaccgcagatgcgtcaactgcaacggcctcgggccgcagtacgtgtgcaccagcttctggaccttcgtctgcgtctcctgcagcggcatccatcgtgagttcacgcaccgtgtgaaatccatctccatgtccacgttcagcacgcaagaggtcgaggctctccagaagggtgggaaccagcgagccagagaatcgttattgaaggactttgacacccagaaaatgaggctacctgatagcagcaacattggcaatcttagggaattcataaaagctgtttatgtggagagaaggtatgctggtgggagattttctgaaaggcctccaagagataataaacagaaccaaaaggcccatgaagaagaacatagaagggcaagttcctaccattcattttcacagagcccaccttatgattaccagtatgaagagcaacgcaatggcaaacaatctgcatttcttagtaggaagcctggctcagatcgagggcttgatgggaagatttctggatttgcttacagttcacataacctgcatgagagaatgtctgaggacagatttgctggtgagagttgcggatcaaggacttccaactgctcagggtcaagcatgagtgatacagttagaattgcaccccagtcacctaattttcctgataatggatgtttcagtgcccctgttctacaagatcaatcaaatcaacagagttcttatggactcactagttcacagataactatgcaagcaggaaacatagattcaatctctcctaaattgggcaagtcaagcttatctgatttgatttttgaggatgataatgttgaaagaactcagaaacccaccaactccgctgctccaagtttcatagcctttcctgatgctattagtgccccaaatcaagatcacgttaattccacagctgctaagaaacatcaagtaactgccttggaacaacctatagatctgtttgcaggtatacctactgaaactctgtcagctgataaagtgataccagcagctccgtcaatagacaattctgggtgggctacatttgatacacctccagaacaaaagcaactttcagtcgctgggctttcttatgttgctgccaccagcaacaataaacaggctttaagtcatgatttgttttcatttgaatcaaatgatgagccaacatggttccagagctctaaggataacgcttctgttaccaaccagtctactgcttcatctcctgatacaggcagttctcagccttggagtgttttcaatgcttccagtgctagcacacagtacactgccgagggagatatatcattaatgacttctaaattgcaagttccaaaagggctggtggatgacaatgtttctcagctctggcattcatttgatgatgtcaacggggttgtttctcatgatcaacactatgctcagcctcgaattgatgaccacaggaatgttgtgaacatatccctttcaaccagcaacccatttatgtgctctgtagtttcaaaggaatctcatgatgatgatcccaatgaagtattaatggtggatggattatcacctaatacattactttctgcttccgcacagccatctgtggaaggagcctctactgagcatgtgccactgaatccatttgatcttccatttgacactcatttggagacccctgatctgttcatgagttcattgcaagaggccttgcctaatccagatctctcaactttcctcgatggtttacctgaaacatggttctccagcagttcttgcgcttatgttccatcagcatcgcatggtggactaccgtgccttgtcgagcaggccccgaactctccgctgcggaacataccggttggcactgtgtcgacaggaaatcctttcgcatagatggtggagacggagaatattcatgttgttttagttcagtgagcttattagagctaggcagccgatagggccgccagggttaaatggaggaatattgagcaactataaggtttctgctggtgcgtggaatgtgtatattctttgtccactccatgtactctatccaaatgttaaaatgaacaggctggttccttgagattgtt

SEQ ID NO: 17855 - protein, 654 aa, Panicum virgatum
  misc_feature: Ceres CLONE 1794851
  misc_feature (13)..(131): Pfam Name: ArfGap Pfam Description: Putative GTPase activating protein for Arf
  misc_feature: SWISSPROT Homolog: EC 5.99.1.2 DNA topoisomerase
MVAASRKEEERNERIVWGLLKLPPNRRCVNCNGLGPQYVCTSFWTFVCVSCSGIHREFTHRVKSISMSTFSTQEVEALQKGGNQRARESLLKDFDTQKMRLPDSSNIGNLREFIKAVYVERRYAGGRFSERPPRDNKQNQKAHEEEHRRASSYHSFSQSPPYDYQYEEQRNGKQSAFLSRKPGSDRGLDGKISGFAYSSHNLHERMSEDRFAGESCGSRTSNCSGSSMSDTVRIAPQSPNFPDNGCFSAPVLQDQSNQQSSYGLTSSQITMQAGNIDSISPKLGKSSLSDLIFEDDNVERTQKPTNSAAPSFIAFPDAISAPNQDHVNSTAAKKHQVTALEQPIDLFAGIPTETLSADKVIPAAPSIDNSGWATFDTPPEQKQLSVAGLSYVAATSNNKQALSHDLFSFESNDEPTWFQSSKDNASVTNQSTASSPDTGSSQPWSVFNASSASTQYTAEGDISLMTSKLQVPKGLVDDNVSQLWHSFDDVNGVVSHDQHYAQPRIDDHRNVVNISLSTSNPFMCSVVSKESHDDDPNEVLMVDGLSPNTLLSASAQPSVEGASTEHVPLNPFDLPFDTHLETPDLFMSSLQEALPNPDLSTFLDGLPETWFSSSSCAYVPSASHGGLPCLVEQAPNSPLRNIPVGTVSTGNPFA

SEQ ID NO: 17856 - DNA, 632 bp, Panicum virgatum
  misc_feature: Ceres CLONE 1794869-R
  misc_feature: Encodes the peptide sequence at SEQ ID NO. 17857
gaacctctcaacaaggcgaagctagtacaggaaaccagggaatgttatcaccctacagatccagttcatttcctgtgcctcaatatgcgttgcagagagaggatgtatttcctgagagacctgatcaaccagaatgccaatattacatgaagacaagaggttgtaaattcggtgcagtgtgcaagttccatcatccacgggtcagatcactaccgcctccagattgtgtcttaagtccaatgggtcttccaatacgtcccggtgaagaactgtgcaaattttatttgcgttatggcatctgtaagttcggagccaactgtaagtttgatcatccaatggctactccaatgggagtctatgcttatggtttctcagcctcagcttctgcatctgcatcaactaatgtacctatggcccgactccttctgggatccccacctggttctggatacacatcctagacgcttgttttcagttgacctactttgatgtataaaatccaccacgctgtctcaggcgctgtgaatgtttctcctaactccctgccggaatcaagtcctgtaaattgagttgctactggagatgtacagcctctcttttttgtgttaatccagatcttttgggaggaacgc

SEQ ID NO: 17857 - protein, 152 aa, Panicum virgatum
  misc_feature: Ceres CLONE 1794869-R
  misc_feature (86)..(112): Pfam Name: zf-CCCH Pfam Description: Zinc finger C-x8-C-x5-C-x3-H type (and similar)
  misc_feature (40)..(66): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
TSQQGEASTGNQGMLSPYRSSSFPVPQYALQREDVFPERPDQPECQYYMKTRGCKFGAVCKFHHPRVRSLPPPDCVLSPMGLPIRPGEELCKFYLRYGICKFGANCKFDHPMATPMGVYAYGFSASASASASTNVPMARLLLGSPPGSGYTS

SEQ ID NO: 17858 - DNA, 950 bp, Panicum virgatum
  misc_feature: Ceres CLONE 1794869
ctcccgagtgaggtcggtcggccgccggyggcggcggcggagacctctctccattgcgtcgtgccccccccccccmccccccactycgtccscggatcggtgagtmaarwsggagggagcggcggsggsttyctccctgawmtartcttgttaggggggtgcggcttcctccctgatyttgtcttgttagggggstgcarcttccyccctccctccgtcaggggsgccgggggggggggsttytgctccccatcctccgcttgcgccgcctcccttgtgctcccccttytctccgcctcccctcctctccgtccgtgvggscctcccctcctcccacgatccgcaccccscaarcacatccctcaacgadmccgggtctcctccccctccamvccgtctaaatcgccaccatgcggccgcctcgggaagccsccaccaccttyacgcccatgtctggararvctaacgcaaatggggggcctcccccaaatccgggatygtcgcacmgtctcaagaagctgctgccgcccccsccstctctatgcctgcatytggarcacctcccccaamtccagtgcctcccatgtggamcggsctcccacctcsccagccgggctcccagggagggtgctgcagctgcagggaaaacccacaaaaaagaacaaaarcgcccccaccgctggarctcgaaaacarggcgcgarcacatcgacaaatgctcatccccacagcatcccargaaaacaartgarcactcatyatctcctctatcgtttttgcctattttcaaagaaatccgtcscgggttkcttartgttgcaaawctgaaaaaccatccttgtcttgtgcatgctttgtgttccaagaaatggaccaaggaaatgtgaaatgatagaaaccaattgcgggaaaaaatattgtatccctgccttgcgctgattcctgtcttc

SEQ ID NO: 17859 - DNA, 2289 bp, Panicum virgatum
  misc_feature: Ceres CLONE 1794872
  misc_feature: Encodes the peptide sequence at SEQ ID NO. 17860
gtagcttggggtggtggaccgtggccttccccgtttcgtctcgggttctcctcgttttatctcatcgcccttgctccgcccccctcctctctcccctcccctttcctccttccgcccccctcccgcgccgcggccttctccttcacgagaggccacgctccatccccgcccgctccgccttcccggcgactggcggcgagcgcagcccaactaaagcgtcgtggtcggccgactcttggcgggttgggggtacaaggcgccaatggggatcccggaggtggctctccacaccatgccgggggcattcgccgcccacgccccggcatccaatttgcccctcgtggcagacgctaggaggaggaagaggaacgcctacttggtgcccaacgtcagggcactgcaaggccttttaaagttccccaggttgaggtccgttcggcggcagtgccagcggattgatgaccttgcgagggtcacagaggggaatgggaattgggtcaaggatgcgatgaataatgccagccaggttcttgatgacgtgggcgtggcggatcaggctgtaagtggcaatggaggtttaaatgggaacactgtcaagcctgcacctcagaggcggaagacatcatcggtcgaagatgaggcctgggaacttctgcaggagtcgatggtttactattgtggtagccctgtcgggacaattgctgccaacgatccaaatgatagtgatccggtgaactatgatcaagtgtttattcgggacttcataccatcgggcattgcttttctattgaaaggggaatatgaaattgtgcgtaatttcattctacacacccttcagcttcagagctgggagaagacaatggattgccatagtccaggtcaaggtttaatgcctgccagcttcaaagtgcggacaattccacttgatggtgatgaggatgcaactgaggaggtcttggatcctgattttggggaggctgcaataggacgtgtggcacctgttgattcaggtctgtgatggatcatattgcttagggcatatggaaaatgttcaggagatctttcagtacaggagagaatcgatgtccagactggaatgaaaatgattctgaagctttgtttagctgatggttttgacatgttccctacattactcgtaactgatggttcatgcatgattgatcgtcgaatgggaattcatggacatccacttgaaattcaggcactcttctattcagctctcttgtgtgcacgtgagatgctgactccagaagatgggtcagctgacttaatccgtgccctaaataacagacttattgcactgtcctttcatatcagggagtactattggcttgacatgcaaaaattgaatgagatatatcggtataaaacagaagaatattcttatgatgctgtcaacaagtttaacatataccctgatcagattcctccatggcttgttgaatggatacctcctaaagggggctactttattggaaacctccagccagctcatatggacttccggttcttttcactgggaaatttatggtcaatagtaagcagcttggcaacgactcatcaatctcatgccatcttagatcttatcgaatctaagtggtctgatttagtggcagagatgccactaaaaatatgttatcctgctcttgagaaccaggaatggaaaatcatcaccggaagtgaccctaaaaacacgccttggtcataccacaatggagggtcctggccaacattattgtggcagctcacagtggcatgtatcaagatgaacagacctgagcttgccgcgaaagcaatagaaatagctgagaggcgtattgctacggataaatggcccgaatattatgacaccaagcgggcacgcttcatcgggaaacagtctcggctgtaccaaacatggtccattgctggattcctagtagcaaagctactgatggagaagcctgacgctgctaggattttgtgaaacgatgaggatgcaaaaatccttaatgctttgagcacgaacagaaaacggggcaagaaagtgttgaagaaaacatacattgtgtgaattctagcagcgagttccacaagtttcatcaaatgacccaagttagcgtttagtaatttataggaaacctctttcctgtatataaacttacacaagcttgtggtttttgttatgaggagggtgcctgctgtttggatgctgttattgtggatgcatcgggctttgcaagcacttgcttgagcgttcctcaattgtaattggacactttttttggt

SEQ ID NO: 17860 - protein, 251 aa, Panicum virgatum
  misc_feature: Ceres CLONE 1794872
  misc_feature (115)..(251): Pfam Name: Invertase_neut Pfam Description: Plant neutral invertase
  misc_feature: Functional homolog of the protein sequence given in SEQ ID NO 50740
  misc_feature: Useful for making plants with altered carbohydrate content
MGIPEVALHTMPGAFAAHAPASNLPLVADARRRKRNAYLVPNVRALQGLLKFPRLRSVRRQCQRIDDLARVTEGNGNWVKDAMNNASQVLDDVGVADQAVSGNGGLNGNTVKPAPQRRKTSSVEDEAWELLQESMVYYCGSPVGTIAANDPNDSDPVNYDQVFIRDFIPSGIAFLLKGEYEIVRNFILHTLQLQSWEKTMDCHSPGQGLMPASFKVRTIPLDGDEDATEEVLDPDFGEAAIGRVAPVDSGL

SEQ ID NO: 17861 - DNA, 1861 bp, Panicum virgatum
  misc_feature: Ceres CLONE 1794879
  misc_feature: Encodes the peptide sequence at SEQ ID NO. 17862
gagcggagcggagcccccaacccccaactccaactcgacccgggaagggggggagaaggagagagagagagagagagagagcgagagagatagagagggggcgcggcgaggaggccggcggcggcgccggcagcggcagccggggatgggggaggtggccgcgctgcgccagctcgtcggccaggtgcaggagctctgggacctctacggcgccaacgcccacccgctccccagatggtatttacttgactttgaacatggttcaatcaaagatgattattgtggaggacggactggatacaactcggaattactgaagatcatggagactaaccaatctcctcctcgcaagcgaccgtggagagatcgaaaccgcgagaaggcgccctgttcaaacacaactgaggtaatgcaacaggagatttggaaagagttccctgaagatctttttgaaactgtcattgcaaggcttccagttgctgcaatttttcgattccgcactgtctgccgaaagtggtcttctcttttgggctcagacagtttctctcatcagtactctgaagctccacatggactgccatggttctatacaatcacccatgagaatgcaaacaataatgttgcaatgtatgacccttcactgaagaaatggcaccacacatctgttcctcttgctcctacaaagatagttattccagtggcatctgtgggtggccttgtctgtttattggatctgagccacaggaatttctacatttgcaaccctcttaggcaatcactcaaggagatcccacccagatcagtccagggatggtcaagagttgcagtagggatggtgttgaacggaagaagttctagtcatggctacaaagtaatgtggttaggaaatgatgggacttatgaagtgtatgactctacaaagaacatgtggtcttgtccaggagttttccctacaagcatcaaactgccacttgctctgaatttcaggtcacagcctgtggcggttggcagcacgctatacttcatgtgtgcagaaccagatggtgttttgtcatatgatgtaagcacagggatttggagacagtttgccatcccactgccactgcatctgactgaccacacacttgccgagttccagggaagggtcatgcttgtgggtctgctgtgcaagaatgcagcgacctgcgtctgcatatgggagttgcagaagatgactctcctctggaaggaggtggacagaatgccaaatatctggtgcttagagttctacggtaagcacatgaagatgacatgcctgggcaacagtggtttgctcatgctctccttgaaggcgaagcgaatgaaccgccttgttacctacaaccttttgaaaagggagtggcagaaggttcctgattgcatgctcccatgcagccgcaaaaagcagtggatagcatgtggcacagcatttgatccgtgcccctctgccttggcctgacaggtcttttgccttcttcagccaagcacattgaaattttagcaatttcatatcattggccaatctttagatatttgtatgttgttgtgacaagtctctgtgttgcacacaaatccatggcactgtggtttgttttgtatcacgctcaagcaagcgaactgtttccttttatcacctatcagaatttgggtcgggaagctacgatgtcaactgggcaggctgacctaaatatgttaaaggttattgttgttgaaattggaatagtcaaggattttgtatgtttggttatcatctcgttaagtttgtaatgtttctggatgtgcagtcatctgcccagaactgagtttatatacaataataaccgggatattaatgttttgattc

SEQ ID NO: 17862 - protein, 443 aa, Panicum virgatum
  misc_feature: Ceres CLONE 1794879
  misc_feature (92)..(139): Pfam Name: F-box Pfam Description: F-box domain
MGEVAALRQLVGQVQELWDLYGANAHPLPRWYLLDFEHGSIKDDYCGGRTGYNSELLKIMETNQSPPRKRPWRDRNREKAPCSNTTEVMQQEIWKEFPEDLFETVIARLPVAAIFRFRTVCRKWSSLLGSDSFSHQYSEAPHGLPWFYTITHENANNNVAMYDPSLKKWHHTSVPLAPTKIVIPVASVGGLVCLLDLSHRNFYICNPLRQSLKEIPPRSVQGWSRVAVGMVLNGRSSSHGYKVMWLGNDGTYEVYDSTKNMWSCPGVFPTSIKLPLALNFRSQPVAVGSTLYFMCAEPDGVLSYDVSTGIWRQFAIPLPLHLTDHTLAEFQGRVMLVGLLCKNAATCVCIWELQKMTLLWKEVDRMPNIWCLEFYGKHMKMTCLGNSGLLMLSLKAKRMNRLVTYNLLKREWQKVPDCMLPCSRKKQWIACGTAFDPCPSALA

SEQ ID NO: 17863 - DNA, 569 bp, Panicum virgatum
  misc_feature: Ceres CLONE 1794889
  misc_feature: Encodes the peptide sequence at SEQ ID NO. 17864
actcagccatgggcaaccgcgggtcgcgccaccaccgccacgcagccgaccagcagcagccggcggcgcctcccaagccccaggcccaagcgccgccgccgccgcagcagcagcagccgcaggcgaggccgaagccggcggccgccccggcggcggcggacgcgggggcggtggggcgcgtgctggggcggccgagggaggacgtgcgcgcgacctacaccttcgggcgcgagctcggccgcggccagttcggggtcacctacctcgtcacgcaccgggagaccggccagcgcttcgcctgcaagtccatcgccacgcggaagctcgtccaccgcgacgacatcgaggacgtgcgccgggaggtgcagatcatgcaccacctcacgggccaccgcaacatcgtcgagctccggggcgcctacgaggaccgccactcggtcaacctcgtcatggagctctgcgagggaggggagctcttcgaccgcatcatcgccaggggccactacaccgagcgcgccgccgcggcgctctgccgcgagatagtcgccgtcgtccacagctgcccactc

SEQ ID NO: 17864 - protein, 186 aa, Panicum virgatum
  misc_feature: Ceres CLONE 1794889
  misc_feature: SWISSPROT Homolog: EC 2.7.11.1 Non-specific serine/threonine protein kinase
MGNRGSRHHRHAADQQQPAAPPKPQAQAPPPPQQQQPQARPKPAAAPAAADAGAVGRVLGRPREDVRATYTFGRELGRGQFGVTYLVTHRETGQRFACKSIATRKLVHRDDIEDVRREVQIMHHLTGHRNIVELRGAYEDRHSVNLVMELCEGGELFDRIIARGHYTERAAAALCREIVAVVHSCP

SEQ ID NO: 17865 - DNA, 1651 bp, Panicum virgatum
  misc_feature: Ceres CLONE 1794892
  misc_feature: Encodes the peptide sequence at SEQ ID NO. 17866
actgctcgagcgagctccagctctcaagaaaccacgccggatcatggccatggcgcctttccttcgcccgctcgtcctcgcgctcctgatcgcgtcctgcgccgcgcagcaggcgccgccggcgcagcccccgcagacgccgaacgccccgccgcaggcgcctccggctccccaggcgccggcggcgggcaacccgccgccgtcgtggcgtgcgccggcgtctgccgggactggaggggcgccgtgaaggagatcgtgcgcgcgccggaggcgtctgggaggcttaccttccccatctctctcaagcagcctggcccaagggatgcccctcttaaatgtttcattaggaggaaccgggctactcagtcatattttctgtgcattggagtcactgatgcattagctgatgatgggaaattcctacttgctgcacgtaaataccgaaggccgtcatgcactgaatacctgatttcacttgacgcacgtgatacgtcaaaggggaatggtacttatattggcaagttaagatcaaacttcttgggcacaaaatttactgtctatgatgcccatccaccttgtgccggagctgtggcttcgaagggtccatctgcgcacgtgatcggttcagcccaagtttctcccatgaagcctctgcctgctgggaattatccagtttctcacatttcttacgaagtgaatgtattgggttctagggggccaagaaagatgaactgtgttatggattctatccatgtatcagcgattaaagaaggagggactgctcccacgcagactgaatttccatccattaactccacctcattcgcatcagttccattctttggatcgaaatcaggccgactggatagttcaggtgctcaattaaccactcagaatgaaagtaaggtgtcgctgaagaacaagtccccgaggtggcatgaacagcttcagtgctggtgcctcaatttccatggacgggtgatggttgcgtccgtaaagaacttccagctggtggcttcaaatgagagtgctccaactccaagtaaccaggaggaggatgacgttatactccagtttggcaagatagggaaggacctattcaccatggactaccgctatcccatatctgcatttcaggcatttgccatctgcctgagcagctttgacaccaaaattggttgtgaatgaattaaggtgttgggcatatcgataatcacagaaagtcgaatgaaagacagcaaggacaatccttactagttaagtttcaagatggcgagtttggtgaatggtggtgattgatagagctggatacttctattctataatgtcgtgatataaatagcaatatagctttagtgggttttgtaagtgttgggaagtctgaacgactgaacaccagagtgtcctctagtatttcgctttcgattcagcgtttaagttcagactaaaatggagaggtcatatattcatatttgcatctatgtatgcaacctgctatttcaaatgaccattctgagatgccagaaggctcgcagccgaatatattgatgacaagggttcaaaagatgctccctttttttttctcacagtttcttctaaaaacttgtagtggtgttgttccgtctaaaaaaaggtaatgttgtttgactgt

SEQ ID NO: 17866 - protein, 395 aa, Panicum virgatum
  misc_feature: Ceres CLONE 1794892
  misc_feature (104)..(389): Pfam Name: Tub Pfam Description: Tub family
  misc_feature: The sequence is a functional homolog of SEQ ID NO 462 in the 10/666,642 US patent application
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
TARASSSSQETTPDHGHGAFPSPARPRAPDRVLRRAAGAAGAAPADAERPAAGASGSPGAGGGQPAAVVACAGVCRDWRGAVKEIVRAPEASGRLTFPISLKQPGPRDAPLKCFIRRNRATQSYFLCIGVTDALADDGKFLLAARKYRRPSCTEYLISLDARDTSKGNGTYIGKLRSNFLGTKFTVYDAHPPCAGAVASKGPSAHVIGSAQVSPMKPLPAGNYPVSHISYEVNVLGSRGPRKMNCVMDSIHVSAIKEGGTAPTQTEFPSINSTSFASVPFFGSKSGRLDSSGAQLTTQNESKVSLKNKSPRWHEQLQCWCLNFHGRVMVASVKNFQLVASNESAPTPSNQEEDDVILQFGKIGKDLFTMDYRYPISAFQAFAICLSSFDTKIGCE

SEQ ID NO: 17867 - DNA, 2483 bp, Panicum virgatum
  misc_feature: Ceres CLONE 1794916
  misc_feature: Encodes the peptide sequence at SEQ ID NO. 17868
agaggacacgccggcacgcgaccaaccatccggcgagatggaggccccgccgccgcgcaggtggccgccgggattccgcttcagccccaccgacgaggagctcgtcctctacttcctcaagcgccggatcgtctccggccgcccctccccctacgtcgccgacgtcgacgtctacaagtcccacccctcccacctccctgagaggtcggcgctccagacgggggacaggcagtggttcttcttcagccggatggaccgcaagtaccccaacggctcgcgcgccagccgcaccacgggcgacggctactggaaggccacggggaaggaccgcttcatctgcggcggcggcggccgagcggtggggaacaagaagacgctcgtgtaccaccacggccgggcccctcgcggggagcgcacggactgggtcatgcacgagtacaccctgctcgccgacgcgctcccgccggccgcgcaggggagggagtcctacgcgctctacaagctgttccagaagagcggggccgggcccaagaacggtgagcagtacggcgcgccctttcgggaggaggattggttggatgacgaggagggagtgatcgcggttgctcctgctagtcccgttcctaacaacaataattgtcctgctaccgtggaggagcacgaaattgctgaccgtgaacttccggttgaggatcttgacgagctcctgtcacaaattggaaatgataaggaggagtttggtgaagcacagcttgatttttcgacacctgctacttcccatggtcaaagtcagggttggcttagtgaggggggtaacaaggctgaggtagtggatgcttccattagtagtggtgctggggtagctgcagagaatacgtgcactggtggtctccctcttggggatattgagcagctcctgatgcaaatgtctgatgatcagcaaaacgctgaattgttctcggatttgtcgacatcagttccacaactgcagcttcagtgtgacgatcatcaggtgtggcttgatgcacacagggagcaggaagtttgtgctccggatcctaccacaagcagtggtgtcgtggtaacagcagaatgtactgacacagagtttggggatcttgaagggcttctgctgcaaatagccaatgaccaggacatgattgaacctcaatcagatctgtctggaccaattccatatcacaacttcaaccaggtcggcattggggatttccatgaatctcatggtgctctggttggtaatctttcttgtatagttcaagaaagtacatttgatccgcaaactgagccaagaagtcaatttccacagtctagtctaaccaatgtgccatttagcggagaaacaaattcttctgaagggacaagtgtgccacgatctgtgtcaggtttaatcagttacaatagccaggatgctgatgaggagttccttgaaatcaacgatttctttgatctggagggtgtagaacagagtgcaaattgtacagcaactgagcacttgatatctgcaacaaatgggatgtttgacaatttggaatactctgatgctcatacttttttacctggtccatttgacacagtgggagtggtagctgaaaatcaattttttgattatggtaacactggaattcaggaccagggatatcagtatacaacagaagtaacaacacacaatcaggctgctcttaatgtccggagccacatgaagcatactcatgttgtcttaccctcacatgcatcaggcactctaaatcttcatgcagcaaatgagccacctaacaggagctcaactgcttcacaatcatggttcaatgctgctctatcagccttgttggactctgtacctagcagtccagcattggctgctgaaattgaaaatactgttatcaacaaaacactccagcgcatctctagcttcagatcacatcaagcttcgggtgaagataacacagttatcaacagaacacttcatcgcatctctagcttcaggtcacagcaagttgcaagtgaacaaccaagcactccaacgattcaggttacaagaggtggcagactgatgtttctctctctactggttatacttgctgctgttatgtggacctttactgctggcagtgctgggtctgcactcaatttctgcaaggggttatggaaatcttcttctaggtgatccctaatcaacggcaaaaaatcacctgttattctggtgatttggtcctctctaattcttttcagtcctctgtatgggttattgtttgaatatccctttcctttcaaaagggggaagaggtagaagcattttgggggtggatcaatgattataggtgttagtagcttatgcaatagaacagggaaaaagaaatataatgcgagacaaaaagggtatctgatggtaatatatgtggctacttattatccttctgtattttgatggaaatatatagtgaatgtaagtaaagcattaagat

SEQ ID NO: 17868 - protein, 715 aa, Panicum virgatum
  misc_feature: Ceres CLONE 1794916
  misc_feature (9)..(137): Pfam Name: NAM Pfam Description: No apical meristem (NAM) protein
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
MEAPPPRRWPPGFRFSPTDEELVLYFLKRRIVSGRPSPYVADVDVYKSHPSHLPERSALQTGDRQWFFFSRMDRKYPNGSRASRTTGDGYWKATGKDRFICGGGGRAVGNKKTLVYHHGRAPRGERTDWVMHEYTLLADALPPAAQGRESYALYKLFQKSGAGPKNGEQYGAPFREEDWLDDEEGVIAVAPASPVPNNNNCPATVEEHEIADRELPVEDLDELLSQIGNDKEEFGEAQLDFSTPATSHGQSQGWLSEGGNKAEVVDASISSGAGVAAENTCTGGLPLGDIEQLLMQMSDDQQNAELFSDLSTSVPQLQLQCDDHQVWLDAHREQEVCAPDPTTSSGVVVTAECTDTEFGDLEGLLLQIANDQDMIEPQSDLSGPIPYHNFNQVGIGDFHESHGALVGNLSCIVQESTFDPQTEPRSQFPQSSLTNVPFSGETNSSEGTSVPRSVSGLISYNSQDADEEFLEINDFFDLEGVEQSANCTATEHLISATNGMFDNLEYSDAHTFLPGPFDTVGVVAENQFFDYGNTGIQDQGYQYTTEVTTHNQAALNVRSHMKHTHVVLPSHASGTLNLHAANEPPNRSSTASQSWFNAALSALLDSVPSSPALAAEIENTVINKTLQRISSFRSHQASGEDNTVINRTLHRISSFRSQQVASEQPSTPTIQVTRGGRLMFLSLLVILAAVMWTFTAGSAGSALNFCKGLWKSSSR

SEQ ID NO: 17869 - DNA, 477 bp, Panicum virgatum
  misc_feature: Ceres CLONE 1794922
  misc_feature: Encodes the peptide sequence at SEQ ID NO. 17870
ttctcctccggcgtgcgcacctgcccggcgcccggcgtcctctccatgtccgccgccaagtaggttgttgcccgcggcgcctggctgcgggcgcatgccacctaccacgtgaagctgataacgtccgatggcgaggtggagatgcaggtgcccgacgacgtgtacttcctgaaccaggccgaggaggaggggatacacctgtccttctcctgctctgcggggtcctgctcctcctgtgccggcaagatcatctccggctccgtctactacaccgacaagagcttctgctacaacgaccatatccccagcggatgggtgctcacctgccacacctaccccgcctgctacgtactcatcaacaccaacaacgaagacgaactcagcgcttaaccttcatcatctcatcatcattatatgccatgcataaaattaaagctgataactgccttgcatcacatctatcgatctatgtaatcc

SEQ ID NO: 17870 - protein, 82 aa, Panicum virgatum
  misc_feature: Ceres CLONE 1794922
  misc_feature (1)..(68): Pfam Name: Fer2 Pfam Description: 2Fe-2S iron-sulfur cluster binding domain
MQVPDDVYFLNQAEEEGIHLSFSCSAGSCSSCAGKIISGSVYYTDKSFCYNDHIPSGWVLTCHTYPACYVLINTNNEDELSA

SEQ ID NO: 17871 - DNA, 2801 bp, Panicum virgatum
  misc_feature: Ceres CLONE 1794924
  misc_feature: Encodes the peptide sequence at SEQ ID NO. 17872
agaactgttttggtttccacgggggaaattatcaaaagcattctgcagtggaaagcaacaaaattgaccgccgcacccgaatccagaaagcaacccctgtttcctctcccaccgccgccacccgctgcgcctcggcgccggcgacctcaccgccggccggcgaggggcacgacgagccaggtctctctttccccccgagtttcatttccctctccctctctccgggaggtgtcgtgtcagtgccgccctctactcgtcggttcgtccggcgtggagcgttagatccactcggccgcacctggatctatctcttcgtttgctgttaggttccttctcatcggcaagattagcactcccgtggtgccgttgcactctctttctcaggaatttgaggggttgagctaagcccccaatccatgcccagctgtcactgcgtccctgcaaggtttctctaggattttgcagaaacagccatgtggaggctcaagcatttcatccccaaggaacagcctagtggcctcgagggccgcaccatcgacgttggcaatgtcaaggtgcacgtccgggaggccattgctgagggtgggttttcatgcgtgtacgccgcccgggacatggtcaatcccgcgaagcagtatgcgctcaagcacgtgatcgtgcaggacgaggagtcactggagctggtccagaaggagatcacggtcatgaggtcactcaaggggcaccccaatgtcgtcacgctggtcgcgcacgcgatacttgatatgggccgagcaagggaggcactgttggtgatggagttctgcgagaagtcgctggtttctgtgttggatgacaggggggcaggctactttgatgaggagaaagtggcactgatcttccgagatgtttgcaatgccgtcttcgcgatgcactgccagacgccgcctcttgcgcacagggacctaaaggctgaaaatgttcttcttggtgctgatggggcctggaaactatgtgattttggtagtgtgtcgacaaatcataaatgcttcgacaaacctgaggagatgggcatcgaagaggataatattaggaagcacaccactcctgcatacagagctcctgagatgtgggacttgtacaggagggagtttatcagtgagaaagtagatatatgggctcttggatgtctcctgtatagaatctgctacttcaaatcagcatttgatggcgaatcaaagcttcagatacttaatgggaattatcgaatcccagagttgccaaagtacagctcttccattacaactctgatcaaagacatgcttaattcttctccagatgctagaccggacattacacaggtgtggttccgtgttaatgagttacttccattggagctgcaaaaggatttacctgatggatccccatctgggtcagcatttgagtctcatactgctatcgataaagcaccaaggagaccacctcaagggagttctgctttatcatcaagagaagacctgaggagtgcctcacctagtgatttttccaacctgatgccacaaggtcctacgaaagcttcggagaacaggggtcctatgggtgcattttggtcaactcaacatgctcaggagctagcttttgctgatgacaagggaccagcttttgatcaagagactattagccaagtcacctcaaagaaatcacaggctaagaaccagaacacaccagttcataattcatctcggaaatctctgtctgcatcagttgatagttcacctggggattttgaaattaggttttctgcaaacggctcggagtctgggttagagaaaaccaaaacagcaaaaacagaaaataaagccagcatacaagctacggccttgaactcattcgtggcagactttgacaacatcaaaatgaactcacaaaacaatgctgacaatgtaaacttgcttagcaagttaaaagaatgtcaactggaagcggaagttaatttacggaaggaacaactaaagatagcaaacctggagaaggaagaaatttcattgaagtttgataagttgtctgccatttgttcctctcagaggcgagagatacaagagcttaagcaagccctagctactgtttctacgccgccagctaagcagttcagagaaaattcaaaggttgagttctgctcacccagcacaagccttgatactccgccaagggagaagattgaaggaacccctccagagctccggcaaggcctatttacttcaaggccagggacaccgagtcctgacccaaaaccatggtcagcttttcctgaagagccaaaacctcaagcagctgtgaagagtgcccaccccaggtcagtccgaactctgcgtgcatcaaacagtaacaaagccagttcactgggacagttgaatgtaagttctagcgccgatccatttgcctttggtcaagatagctttaaggctgctccttctggaaccgtacttcccaagttatcaaacgtggggaatgctgctcagctcctgaataatcagaatgctgaagaaaagaaagatggatcgtaccaaccagccggatggactgggttttgattgtgctacacaaatttacattgatattatatgcaaaaagagtcaaagagtacatatggtcctggtggtgtggcagactgaagagccatcaaggaatgcctgaacttatgtaggtatgtgtggcaatgcatttttacaattattctggtgctgatcctgcataatgatgcatcctgttgtaactttagtgcaaatgtaagttgtaacatgcaaataattgctagatgttag

SEQ ID NO: 17872 - protein, 698 aa, Panicum virgatum
  misc_feature: Ceres CLONE 1794924
  misc_feature (28)..(292): Pfam Name: Pkinase Pfam Description: Protein kinase domain
  misc_feature: SWISSPROT Homolog: EC 2.7.11.1 Non-specific serine/threonine protein kinase
MWRLKHFIPKEQPSGLEGRTIDVGNVKVHVREAIAEGGFSCVYAARDMVNPAKQYALKHVIVQDEESLELVQKEITVMRSLKGHPNVVTLVAHAILDMGRAREALLVMEFCEKSLVSVLDDRGAGYFDEEKVALIFRDVCNAVFAMHCQTPPLAHRDLKAENVLLGADGAWKLCDFGSVSTNHKCFDKPEEMGIEEDNIRKHTTPAYRAPEMWDLYRREFISEKVDIWALGCLLYRICYFKSAFDGESKLQILNGNYRIPELPKYSSSITTLIKDMLNSSPDARPDITQVWFRVNELLPLELQKDLPDGSPSGSAFESHTAIDKAPRRPPQGSSALSSREDLRSASPSDFSNLMPQGPTKASENRGPMGAFWSTQHAQELAFADDKGPAFDQETISQVTSKKSQAKNQNTPVHNSSRKSLSASVDSSPGDFEIRFSANGSESGLEKTKTAKTENKASIQATALNSFVADFDNIKMNSQNNADNVNLLSKLKECQLEAEVNLRKEQLKIANLEKEEISLKFDKLSAICSSQRREIQELKQALATVSTPPAKQFRENSKVEFCSPSTSLDTPPREKIEGTPPELRQGLFTSRPGTPSPDPKPWSAFPEEPKPQAAVKSAHPRSVRTLRASNSNKASSLGQLNVSSSADPFAFGQDSFKAAPSGTVLPKLSNVGNAAQLLNNQNAEEKKDGSYQPAGWTGF

SEQ ID NO: 17873 - DNA, 2277 bp, Panicum virgatum
  misc_feature: Ceres CLONE 1794928
  misc_feature: Encodes the peptide sequence at SEQ ID NO. 17874
aaccactactagctcccacatttgggaagcagatccttaattagacagcaacccaaccacctactaggcttaggctgtgatccaagttcgctcactttgatctgcagattgcagaaatctgcagggtgcagaatggagagaacactgatcacctcctctaacatctccatggctgcgcatccttcaggatcgtccaggagagttggctacatctcccctgctgcctctgctgctgcacaaaactccagctacaggaagaagaagagcaccccgtcggccgccgcaaccgccgccaccgtcgtcacctcccctccggccaccgacaatgtccagtccactgctccgaagcaggacgagcaacaggacaagggagagcgcgtggcggccatgactaacacttcaagaattggcactgcaagtgcaagaacaagaagggcgccggcgccgagccagtctcgggctcagccccgccgccgcccctccccggctgccgcgtccctgccgatggcgctctgcagcgcgctggaggaggcgatcaacacgttcgtcgacccgccgtcgctgcggccgtcggtggacccgcggcacgtgctgtcagccaacttcgcgcccgtggacgagctgccgcccacgccctgccccgtcgtgcgcggcgccatcccgcgctgcctcgccggaggcgcctacatccgcaacgggcccaacccgcagcacctcccgcgcggcccgcaccacctcttcgacggcgacggcatgctgcactcgctgctcctcccggcggtggagtccgagtcgccgccgtccgaccccgtcctgtgctcgcggtacgtgcagacgtacaagtacctcgtggagcgcgacgcgggcgcgccagtcatgccgagcgtcttctccggcttccacggcctgggcgggctggcgcgcggcgccgtcgtggcggcgagggtgctcacggggcagatgaacccggccgagggcgtggggctcgccaacaccagcctcgtcttcttcggcgggcgcctctacgcgctcggcgagtccgacctgccgtacgccgtgcgcatcgacccggccaccggcgaggtgaccacgcacgggcggtgcgacttcggcggccgcctcttcatgggcatgaccgcgcaccccaagaaagaccccgtcaccggcgaggtgttcgcgttccggtacggccccgtgccgccgttcgtcacctacttccggttcgacccggccgggaacaagggccccgacgtgcccatcttctccgtgcagcagccgtcgttcctgcacgacttcgccgtcaccgagcggtacgccatcttcccggagatccagatcgtgatgcagcccatgggcatggtggccggcggcgcgcccgtcggggccgactccggcaaggtgccccggatcggtgtgctccccaagtacgccacggacgagtcggagatgcgctggttcgaggtgccgggcttcaacatcatgcacacgctcaacgcgtgggaggaggccggcggcgaggagctggtgctggtggcgcccaacgtcctgtccgtggagcacgcgctggagcgcatggagctcgtgcactcctgcgtcgagaaggtgcgcgtcaacctccgcaccggcgccgtgtcgcgcaccccgctctcggcggggaacctcgacttcggcgtgatccacccgggctacctcggccggcgcaaccgctacgggtacctgggcatcggcgaccccatgcccaagatcggcggcgtggccaagctggacctcgaccttgccggcacgggcgactgcaccgtggcgcggcgggacttcggggccgggtgcttcgccggggagcccttcttcgtccccgacgacgtggagggggacggcaacgaggacgacggctacgtggtgtgctacgtccacaacgagcgcaccggcgagaaccggttcgtggtcatggacgcgaggtcgccgcagctggacatcgtcgccgaggtgcagctgcccgcccgcgtcccctacggcttccacggcctctttgtcaccaaggccgagctccaggcgcagcagcaatgacaagaacatgattccaagagaacacacacaaactggatactgaatagtaggtcatagtatgaacaaaactctaggtctcgtatagcattcgagtgtacgaattgttgtattgtaaatggagcagaacccatacaagagtttcgtgatttgagttgatatggtaacacaaagattttaaccaggttcactggaccaacaattttcattggatcc

SEQ ID NO: 17874 - protein, 519 aa, Panicum virgatum
  misc_feature: Ceres CLONE 1794928
  misc_feature (11)..(511): Pfam Name: RPE65 Pfam Description: Retinal pigment epithelial membrane protein
  misc_feature: SWISSPROT Homolog: EC 1.13.11.51 9-cis-epoxycarotenoid dioxygenase
MALCSALEEAINTFVDPPSLRPSVDPRHVLSANFAPVDELPPTPCPVVRGAIPRCLAGGAYIRNGPNPQHLPRGPHHLFDGDGMLHSLLLPAVESESPPSDPVLCSRYVQTYKYLVERDAGAPVMPSVFSGFHGLGGLARGAVVAARVLTGQMNPAEGVGLANTSLVFFGGRLYALGESDLPYAVRIDPATGEVTTHGRCDFGGRLFMGMTAHPKKDPVTGEVFAFRYGPVPPFVTYFRFDPAGNKGPDVPIFSVQQPSFLHDFAVTERYAIFPEIQIVMQPMGMVAGGAPVGADSGKVPRIGVLPKYATDESEMRWFEVPGFNIMHTLNAWEEAGGEELVLVAPNVLSVEHALERMELVHSCVEKVRVNLRTGAVSRTPLSAGNLDFGVIHPGYLGRRNRYGYLGIGDPMPKIGGVAKLDLDLAGTGDCTVARRDFGAGCFAGEPFFVPDDVEGDGNEDDGYVVCYVHNERTGENRFVVMDARSPQLDIVAEVQLPARVPYGFHGLFVTKAELQAQQQ

SEQ ID NO: 17875 - DNA, 2198 bp, Panicum virgatum
  misc_feature: Ceres CLONE 1794936
  misc_feature: Encodes the peptide sequence at SEQ ID NO. 17876
gcgcaacgtgtttatccgtttccggttggacccatgagatatttcgctgggatcccggcggcgcacgggacgaattcctccgtgcgctgctggtggtaaccgatacaaactcccaagtcaaaaatctgcccatcaaaattttatgggcggatcaccagtcgccgcccaggaagcgagcgacgacgacgccgcccgagtcgtggtgcgaatcgcgggatcccacgtcgactccgcctccaatcccctccctccgccgggctcggcgacttttgcagcggagggcgagcaggagcacgccaagccggaggccccagctgaggctgcgtcggcgcaggctccggtagaggctaagcaggaggcggcggcggcggcggcagcagcagcaggcgtgcaggccatggcggtcaccgtggtgcgggacgtggaggcgggcccggacgcgagcaccagcggccagggcggggacaagccttcctggttcacgcctaagagattacttgtcatgttctgcattatcaacatgctaaactatgttgatcgaggagcaatagcaagtaatggtgtcaatggtagccgcacaaaatgttctggtggaacatgctccccaggctcagggattcagggagactttgatcttaataatgctgaagatggtgtgttgtcctcagcatttatggttggactgttggtggcttcgttgatatttgcatccctggcaaaaagatataatcctttcaggcttattggtgttggcttgttagtgtggacaatagcaacagctggttgtggggcctcgtttgatttctggtcaattactatatgccgcatgttggtaggtgtcggtgaagcttcatttataagtctcgcagctccattcatagatgacaatgcacctgtacctcagaaaacagcatggcttgctatgttctacatgtgtatacctaccgggatagcattgggctatgtttatggcggactggtcggaaaaacactgggttggcgtgctgctttctggggagaatcaattttgatggttccttttgttattctaggatttgtgataaagccactagaaatgaaaggactttctcacagcggaataaaagaatatggccagatgcttaatcctgaggttcaagatcagatagataataatgggacaaagcatgttatgcctggtggaatcgatgatcttgcaggaaaggtcccacaaaagttttccttctccagatttgccaaaaggctcatgactgaaattggtcttttcagcaaagatatgaaagaactactacaggagaaggtttttgtcaccgtggtcttaggttatatcgcctacaactttgtcattggtgcttattcctactggggccccaaggcaggccaacagatctacaatatgacaagtgcggatcttatgtttggtggaataactatagtgtgtggaatcgttggaactctagctggaagtttcacccttgacaagatagggtctacaatacctaatgctttcaagcttctttcctgtgcaacatttctaggggcgatattctgctttggcgccttttgtttcaagagcctttatggattcataccctgtttttcagtaggggagattttggtttttgcaactcaggcaccagtaaattttgtttgccttcattctgtgatgccacatttgcggccactggcaatggccgtatccactgtttcgatccatatatttggtgatgtgccttcttcacctcttgttgggcttcttcaggacaaaatcaataactagaggtccacagctcttatattgacatccatccttttcattgcagctgtgttttggtttattggcatatttgtccccagcgtggatcgtttcgaggaagagatcgagcatggcgttcctgcagccgagagatcaaacctcaggccactgctcgatgacaacgaggaggcacgggcatctgactaaaatccgtgcaagttagagcacgtcatggcaattttcttttcttttttgagggtaatcgtagccggattatttcccttgtgctggcaacatgtgaaatgtaaatttgcatgtcagctggatgtactatgtatatataataggtgcatttggtttgcgttcttttctactatagtgtacagactacagaaacaggcaatgtcaggattattttttaacgaatgcgaaacatttcagc

SEQ ID NO: 17876 - protein, 545 aa, Panicum virgatum
  misc_feature: Ceres CLONE 1794936
  misc_feature (122)..(532): Pfam Name: MFS_1 Pfam Description: Major Facilitator Superfamily
MGGSPVAAQEASDDDAARVVVRIAGSHVDSASNPLPPPGSATFAAEGEQEHAKPEAPAEAASAQAPVEAKQEAAAAAAAAAGVQAMAVTVVRDVEAGPDASTSGQGGDKPSWFTPKRLLVMFCIINMLNYVDRGAIASNGVNGSRTKCSGGTCSPGSGIQGDFDLNNAEDGVLSSAFMVGLLVASLIFASLAKRYNPFRLIGVGLLVWTIATAGCGASFDFWSITICRMLVGVGEASFISLAAPFIDDNAPVPQKTAWLAMFYMCIPTGIALGYVYGGLVGKTLGWRAAFWGESILMVPFVILGFVIKPLEMKGLSHSGIKEYGQMLNPEVQDQIDNNGTKHVMPGGIDDLAGKVPQKFSFSRFAKRLMTEIGLFSKDMKELLQEKVFVTVVLGYIAYNFVIGAYSYWGPKAGQQIYNMTSADLMFGGITIVCGIVGTLAGSFTLDKIGSTIPNAFKLLSCATFLGAIFCFGAFCFKSLYGFIPCFSVGEILVFATQAPVNFVCLHSVMPHLRPLAMAVSTVSIHIFGDVPSSPLVGLLQDKINN

SEQ ID NO: 17877 - DNA, 716 bp, Panicum virgatum
  misc_feature: Ceres CLONE 1794957
  misc_feature: Encodes the peptide sequence at SEQ ID NO. 17878
cagcagccatcgcctcttgcctcctccgcagctagctagcccagctcgtcgcagctccggcaagcctctggtacaacgcgagcggagccacgccggatcggagccgagcgagacgatggccggcgcgacggcggcggtgacggtggaggaggtgaggaaggcgcagcgcgcgtcgggtccggccaccgtgctggctatcgggacggcgacgccggcccactgcgtgcaccaggccgactacccggactactacttccgggtcaccaagagcgaccacctcaccgacctcaaggagaagttcaagcggatgtgcgacaagtcgatgatccggaagcgctacatgcacctgacggaggagttcctggcggagaaccccaacatgtgcgcctacatggcgccgtcgctggacgcgcggcaggacatcgtggtggtggaggtgcccaagctcggcaaggcggcggcgcagaaggcgctcaaggagtggggccagccgcggtcccgcatcacgcacctcgtcttctgcaccacctccggcgtcgacatgcccggcgccgactaccagctcaccaagctgctgggcctgcgcccctccgtgaaccgcctcatgatgtaccagcagggctgcttcgccggcggcacggtgctgcgcgtcgccaaggacctcgccgagaacaaccgcggcgcgcgggtgctggtggtgtgctccgagatcaccg

SEQ ID NO: 17878 - protein, 200 aa, Panicum virgatum
  misc_feature: Ceres CLONE 1794957
  misc_feature (8)..(200): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MAGATAAVTVEEVRKAQRASGPATVLAIGTATPAHCVHQADYPDYYFRVTKSDHLTDLKEKFKRMCDKSMIRKRYMHLTEEFLAENPNMCAYMAPSLDARQDIVVVEVPKLGKAAAQKALKEWGQPRSRITHLVFCTTSGVDMPGADYQLTKLLGLRPSVNRLMMYQQGCFAGGTVLRVAKDLAENNRGARVLVVCSEIT

SEQ ID NO: 17879 - DNA, 695 bp, Panicum virgatum
  misc_feature: Ceres CLONE 1794957-R
  misc_feature: Encodes the peptide sequence at SEQ ID NO. 17880
aaggacgtgccggggctcatctccaagaacatcgagcgcgcgctggaggcggcgttcgcgccgctgggcatctccgactggaactccatcttctgggtggcgcacccggggggcccggccatcctggaccaggtggaggccaaggtgagcctggacaaggcccggatgcgcgccacccggcacgtcctcgccgagtacggcaacatgtccagcgcctgcgtgctcttcatcctcgacgagatgcgcaagcgctccgccgaggacggctgcgccaccaccggcgagggcctcgactggggcgtcctcttcggcttcggccccggcctcaccgtcgagaccgtcgtcctccacagcgtccccatcaccgccggcgccgccgccgcatgatcgtccccatcaccggcaacattatttgccgcctccgcctccgatcgacgacccgtcacgcgaataacgtcgttctttctgcatcatttgtcatctactagacgctacgacctattactctttattttgcatgcatgtactgtaagtaagccctggaacctgatgaattttaagggcgagctagaccaagggtaaaaccgtaagatcgatcgagtgccatttagtagtattaattaattacggatggtgaggtattgtatacctgtgtaagacaagcttggctggattctattttatattatttggcg

SEQ ID NO: 17880 - protein, 128 aa, Panicum virgatum
  misc_feature: Ceres CLONE 1794957-R
  misc_feature (1)..(120): Pfam Name: Chal_sti_synt_C Pfam Description: Chalcone and stilbene synthases, C-terminal domain
  misc_feature: SWISSPROT Homolog: EC 2.3.1.74 Naringenin-chalcone synthase
KDVPGLISKNIERALEAAFAPLGISDWNSIFWVAHPGGPAILDQVEAKVSLDKARMRATRHVLAEYGNMSSACVLFILDEMRKRSAEDGCATTGEGLDWGVLFGFGPGLTVETVVLHSVPITAGAAAA

SEQ ID NO: 17881 - DNA, 2278 bp, Panicum virgatum
  misc_feature: Ceres CLONE 1794969
  misc_feature: Encodes the peptide sequence at SEQ ID NO. 17882
gactgccgcacgacctgccaccgcccgtcgcccgcatcccccgatgccgcccaagtcgaaggcggcggccgccgccgcagagccggtctccgtcgaggacctcttcacctcgctccaccgccacatccaggccagcgagttcaaacaggccgccaaggtcgccgaccaagttctcaaggcggcgccgggggacgaggacgcggtgcgatgcaaggtggtggcgcacatcaaggccgacgagatcgacaaggcgctcgccgcgatgcgtgccgccgagcgcctccccatcgacttcagctccaacaaggcatactgttactacaggcaaaacaaactgcaagaagctctggatcttttaagaggtcaggaagaaactgcacctgttctccagctggaatcccagattttgtaccggctaggaagaatgaatgactgcatgaatagctatgagaagcttcaaaaatttaagattgactcaatggatctgaagataaatatcattgctgctctggttgctgctggaagggcttctgaggtgcagacagctatgaaggcacaaaaggttgatcttaccacaagagcacttagggatactcgtagctttgagctcgcatacaattctgcttgctccttgatagaagacaagaagtattcagaagctaaggagcagttggacttggctaaaagaattgggaaagaagagcttatggtggaagactatggtgaagatgatattgaatatgaactagctcctgtatctgctcagcttgcttatgtgcaacagctacaaggacaatctcaagacgccatgcaaacctatgttaatatgataaacaaaaaggcagctgatttatcaccagttgctgatccatcatcacttgctgtggcaacaacaaaccttatttcactaaaaggtacaaaagatgctgcagacagcttgaagaagcttgatcggctttttgaaaaatctactgctccaaaccatttgcaacttgttgacctcaagttgtcccaaaggcaaaaagaagctctgtattctgcccgtgttctcttactcctccatacaaataaaactgatcaggcacatgagttggtcagtggactgcttggtatgtttcgagatagtgtattcccagttttacttcaagctgctgttcatgtgaaagaaaaaaaggttcagaaagctgaagaagttcttagccagtacgccgagaagcatcctgagaattctaaaggggccctcctttcccttgctcagattgctgctaatgccaatcattttcagcttgctgctgactcgctgtccaaaatacttgacattcagcacatgcctgcaacagttgctacactagtggctcttaaagagcgactaggtgactcgaatgctgcagcctctgtacttgattctgctatccagtggtggaagaattccatgaccgaggataacaaattagatttgttcatgagggtggctgctgagtttaagctcagtcatggacgtgatgaagaggcttgtctgttgtatgaggaacttgttaagagccatggaagcattgaagctttggctgggcttgtagtgacttcagcacgcactaacgtggagaaggctgaacaatacgagaagaagctgaagccattgccaggcctcaaaggagttaatgttgagagcttggagaagacatctggtgcaaggcatgttgaagggcctcaagatatgaaggtagacgttcctgaggaggtgaagaagcaaaaggcaaagaagaggaagcggaagcctagatacccgaagggctttgatccagcaaacccggggccgccaccggatcctgagagatggctgcccaggagagagcgatccagttaccgtccaaagaggaaggataagagggctcaggtcagaggtgctcaaggagctgtaactagagagacagcggctgccagtgtttcttcaaaaggaagccaaaacaccagttcatcaaagactccggcaaacaccgatcagccaaaggctagcaacaaatccaggaagaagaagtcgagatcttagatgaatttttttaaagttaaacaaattgacagtgcaaaaggacatgccaatttaccttgttgacttgaaatttttgggttggattgcttgcgtattttctttctagtttgtttaaagtgacttgaaaattttgttgagctgaatcgcgatagaacgctccactagatttatgttttctttataagtgtatacagtactttttgttgtacttttaactcaattcaagcgtgc

SEQ ID NO: 17882 - protein, 667 aa, Panicum virgatum
  misc_feature: Ceres CLONE 1794969
  misc_feature (521)..(609): Pfam Name: SRP72 Pfam Description: SRP72 RNA-binding domain
MPPKSKAAAAAAEPVSVEDLFTSLHRHIQASEFKQAAKVADQVLKAAPGDEDAVRCKVVAHIKADEIDKALAAMRAAERLPIDFSSNKAYCYYRQNKLQEALDLLRGQEETAPVLQLESQILYRLGRMNDCMNSYEKLQKFKIDSMDLKINIIAALVAAGRASEVQTAMKAQKVDLTTRALRDTRSFELAYNSACSLIEDKKYSEAKEQLDLAKRIGKEELMVEDYGEDDIEYELAPVSAQLAYVQQLQGQSQDAMQTYVNMINKKAADLSPVADPSSLAVATTNLISLKGTKDAADSLKKLDRLFEKSTAPNHLQLVDLKLSQRQKEALYSARVLLLLHTNKTDQAHELVSGLLGMFRDSVFPVLLQAAVHVKEKKVQKAEEVLSQYAEKHPENSKGALLSLAQIAANANHFQLAADSLSKILDIQHMPATVATLVALKERLGDSNAAASVLDSAIQWWKNSMTEDNKLDLFMRVAAEFKLSHGRDEEACLLYEELVKSHGSIEALAGLVVTSARTNVEKAEQYEKKLKPLPGLKGVNVESLEKTSGARHVEGPQDMKVDVPEEVKKQKAKKRKRKPRYPKGFDPANPGPPPDPERWLPRRERSSYRPKRKDKRAQVRGAQGAVTRETAAASVSSKGSQNTSSSKTPANTDQPKASNKSRKKKSRS

SEQ ID NO: 17883 - DNA, 678 bp, Panicum virgatum
  misc_feature: Ceres CLONE 1794972
  misc_feature: Encodes the peptide sequence at SEQ ID NO. 17884
aaaccctagagacggcggccatggattcgggaggcggaggagggagcggcgctcacaaggcagcctcgggctcagcgccctcgccggcgccgccgacgcccaaccccacggcgatgctctcggccctcatgagcaagcgcgccaagctccaggaggagctccgctccatcgagcgccaggtttatgatatggagaccacctacctgcaagagtctaatcagtttggaagtgtgctgaagggttttgaatcatttttgtcatcctcaaaaaacacgtctaacctcaagcgctcccggaaattccaggctgacgagaggctattctctctgtcatcagttacttctccagcggttgatgaacatttgactggacgagatgatggaagagaatatggaccaggccgttcaaaaggcggaagcacccctgcaaatgggcaagggaaaccgaagaagggaggacgccccggtgggcgagatggcaagagactacggccgtccaacgatccagatctggacgatgaagatgactactaactcctcccggttgtaggcctactgtagcggattaacttcatttagcgtttagccgcacatgattctttatgtattgtctcctttctcttgcagccccagctcgattgttttgcttgcttgcgtctctgcctatgtttttaaagcg

SEQ ID NO: 17884 - protein, 170 aa, Panicum virgatum
  misc_feature: Ceres CLONE 1794972
  misc_feature (28)..(109): Pfam Name: NuA4 Pfam Description: Histone acetyltransferase subunit NuA4
MDSGGGGGSGAHKAASGSAPSPAPPTPNPTAMLSALMSKRAKLQEELRSIERQVYDMETTYLQESNQFGSVLKGFESFLSSSKNTSNLKRSRKFQADERLFSLSSVTSPAVDEHLTGRDDGREYGPGRSKGGSTPANGQGKPKKGGRPGGRDGKRLRPSNDPDLDDEDDY

SEQ ID NO: 17885 - DNA, 1418 bp, Panicum virgatum
  misc_feature: Ceres CLONE 1794981
  misc_feature: Encodes the peptide sequence at SEQ ID NO. 17886
ctcccactcctctgccgcttggccgccgtgcgccaccggagtctggtcgccctcgccgggatggccgcagtccccgccaccctgtccgcctccgcggctcagatcgggggctttctctcgaagaagccttacgcgccgccgtcctgggccacgcacctctcccccatgccttcccataccttctcgctcggccatttcccaacaccgattcacaagtggaatctccccaatttgccggaaggcacggaagtatggatcaagcgagacgatttatccggcatgcagttgagtggaaacaaggtacggaagctggagtttctgatggcagatgccctagcgcaaggcgcagactgcgttatcactgttggtggtatccaaagcaaccattgccgtgccacagcagtggctgctaagtacctcaatcttgattgctacctgatactacgtacctccaagcttctcgtggataaagaccctggtttggttggcaatctccttgtcgagagactggtgggtgcacacattgatcttgtatcaaaagaagagtatggaaaaattggcagtgtggctttagctgacttgctgaagaaaaagctgtcggaagaagggaggaaaccttatgtgattcctgtcggcggatcaaactcactgggaacatggggatatattgaggcgataagggagatcgagctgcaaattcagcaatctgttgatgctcagtttgatgatattgttgttgcatgtggcagtggtggaacaattgctggtcttgctttaggatcaagattgagcagcttaaaggcaaaagtccatgcattctctgtttgtgatgatcctgaatacttctatgactatgttcaaggcctgattgatggacttcaatctggtttggactcacatgatatagtcagcatcgaaaatgctaaaggattaggttatgccatgaacacagccgaggagcttaagtttgtcaaagacatagctgcagcaacaggcattgtccttgatccagtctacagtgggaaggcggcatatggattgctaaaagacatggctgacaatccagccaagtggaagaggcggaaaattttgtttgtccatacaggtggtctccttgggttgtttgataaggctgatcagttgtcagctctggctgggagttggcgcagaatggatctcgaagattctatagcacgcaaagatggcactggtaagatgttctgatcaatatggtccaaaagcttccatgatggtttagtcttctggacaccatattcatcatagaatatttactcttacatttgtgcaagaaaatacagaatagacggttcgcatggtgtagagcattgatgaaacttaagaataaagcaaatctttctgctatttggaaataaatatttcaatgttgatgtttggac

SEQ ID NO: 17886 - protein, 387 aa, Panicum virgatum
  misc_feature: Ceres CLONE 1794981
  misc_feature: SWISSPROT Homolog: EC 4.4.1.15 D-cysteine desulfhydrase
MAAVPATLSASAAQIGGFLSKKPYAPPSWATHLSPMPSHTFSLGHFPTPIHKWNLPNLPEGTEVWIKRDDLSGMQLSGNKVRKLEFLMADALAQGADCVITVGGIQSNHCRATAVAAKYLNLDCYLILRTSKLLVDKDPGLVGNLLVERLVGAHIDLVSKEEYGKIGSVALADLLKKKLSEEGRKPYVIPVGGSNSLGTWGYIEAIREIELQIQQSVDAQFDDIVVACGSGGTIAGLALGSRLSSLKAKVHAFSVCDDPEYFYDYVQGLIDGLQSGLDSHDIVSIENAKGLGYAMNTAEELKFVKDIAAATGIVLDPVYSGKAAYGLLKDMADNPAKWKRRKILFVHTGGLLGLFDKADQLSALAGSWRRMDLEDSIARKDGTGKMF

SEQ ID NO: 17887 - DNA, 2033 bp, Panicum virgatum
  misc_feature: Ceres CLONE 1795004
  misc_feature: Encodes the peptide sequence at SEQ ID NO. 17888
aaaaagtgagtgcggccacgtcgtagggttttgcttttcccggcggtaaagcggggaggcggaggcggaggcggaggcggaggcgaggcggaggggcgcggcaaccgccgcccggccatggagatcgggcgctcccccgtgagcggctgctccaaggagcaccagaagatctaccaggagtggttcgcgctcgcggactcagatggggatggccgcatcacggcccccgacgccatcaagttcttcggcatgtccaagctctcccgccccgacctcaagcaggtatgggcgatcgcggactccagacggcaggggtacctgggtttccccgaatttgtcgcggcaatgcagctagtctctctggctcaagcagggaatgagatcactcaagatagccttaagcgcgatgatttaggcagtttgaatccacctgtgatggaaggtttggatgctctacttgcgaaatctaagcatatggtgaagcgggtggatccagaattggatggatttcctcaggaacaatcaccttcaaataaatggttcagctcaaagtcatcaaagaagataccgctgactgctgttacttctgtcatcgatggcttgaaaaaattatacatcgaaaagctgaagcctttggaagttacatacaaattcaatgatttcgtttctcctttgctgacgagtagtgattttgatgcaaagccaatggttatgctcttaggtcaatattctactggtaaaacaacttttatcaagcatctgctaagaacaagctatccaggtgcccatattggaccagagccaacaacagacagatttgtcgtagtaatgtcaggaactgatgaaaggactattcctgggaatactattgctgttcaagccgacatgccttttagtggtcttacaacatttgggactgcatttttatccaagtttgagtgctctcagatgctacatccactgcttgagcatatcacatttgtcgacacacctggtgttctttctggtgaaaagcaacggactcaacgtagctatgatttcactggtgtgacatcatggtttgctgcgaagtgtgatcttattcttcttctgtttgatcctcataagcttgatatcagcgatgagttcaaacgtgtcatcggatctttacgtgggcatgatgataaaatacgtgttgttttaaacaaggcagatcaagtagacactcaacagcttatgagagtttatggtgcattgatgtggtctctcgggaaagtattgaatacacctgaggtttcacgtgtttatattggatcattcaatgacaaaccagtaaatgaatcagctgttggtccacttggaaaggaactatttgagagagagcaagatgatctcctttctgatctcaaagatatccccaagaaagcatgtgatcgtcgaatcaatgaatttgttaaacgtgctagagctgccaagattcatgcttatataattggccatctaaagaaggagatgcctacaatgatgggcaaagcgaaagcccaacaacgactcatagacaatttgcaggatgagtttgcgaaggtgcaacgggaataccatcttccggcaggggatttcccctacgtggagcacttcaaagaggtcttgagtgggtatagcttcgacaagtttgagaaagtcaaacccaagatgatacaggcagtggatgatatgcttgggtacgacattcctgaacttctcaagaacttcaggaacccatatgagtgaaccggttggaagatgattttggtcttgcactggaacgagagatcagtcaggcaccgatagatgcctcctgtagcgatggaattgtctggctacatgaatcattgtggactgtggtcaaggtcctgtggggtcttcgttgccatccacgcctcaccattgttgtacaactctgtattcataagaatgggagagcaattgctcaagctttcacggacatctgatcatgtaaaatcaactagtatgtgatttttagtgctatagagccacactcatcgtttctcccg

SEQ ID NO: 17888 - protein, 543 aa, Panicum virgatum
  misc_feature: Ceres CLONE 1795004
  misc_feature (198)..(358): Pfam Name: Dynamin_N Pfam Description: Dynamin family
MEIGRSPVSGCSKEHQKIYQEWFALADSDGDGRITAPDAIKFFGMSKLSRPDLKQVWAIADSRRQGYLGFPEFVAAMQLVSLAQAGNEITQDSLKRDDLGSLNPPVMEGLDALLAKSKHMVKRVDPELDGFPQEQSPSNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGTDERTIPGNTIAVQADMPFSGLTTFGTAFLSKFECSQMLHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLQDEFAKVQREYHLPAGDFPYVEHFKEVLSGYSFDKFEKVKPKMIQAVDDMLGYDIPELLKNFRNPYE

SEQ ID NO: 17889 - DNA, 2038 bp, Panicum virgatum
  misc_feature: Ceres CLONE 1795007
  misc_feature: Encodes the peptide sequence at SEQ ID NO. 17890
aagtagccgaatcactaggcgctactcgctcctcatccattcgtgtcagaagaaggcggccccaaaattccttcagccgcagcagcgaagcatggcaatggcgctctcctgctgcatgctcggcgccgcccggacggcggcctccccttccctccccgcctccgccgccctcctccggcggcgccaccgctcgctggaggttgccgtgggtccattcccgcacgcccagcggtggcgccgcggcctccgcttccgctgcgcctcgtccccttcctcgtcgcccccgccgccgccggcggtgccccccgaggagatcgacgactacgagcttctggacacaacagggaattgtgaccctttatgctcacttgatgatgttagctcacagtactttgaagctaactacaaaccaaaagatgatcttctgaaagctttgactatctttgcaacagcattggctggggcagctgcaataaatcattcctgggttgctgctaatcaggacatcgcaatggtactggtttttgctcttggctatgcaggtatcatttttgaagagtcactggcatttaacaaaagtggagtcggaatattgatggctgtctgcctatgggttgtcagaagcattggggctccctcggttgatgtagctgttgaagagttaagtcacacaactgctgaagtcagtgaaatagtatttttcttgcttggtgcaatgaccattgtggagattgttgatgctcatcaaggtttcaagttggtgactgataatatatctactcgaagccctaaaactcttctgtgggtgattggtatagtaactttcttcctgagtgcgatccttgacaacttgacgtccactattgtgatggtgtcattgcttcggaaattagtacctccatcagaatatagaaagttgttaggtggtgttgttgtaatagcagcgaatgctggcggtgcatggacaccaattggtgatgtgacaaccactatgttgtggattcatggtcaggttacaacattgaaaataatgcagggcttgtttattccctcagttgtttcattggcagtcccactggctctgatgtccctcaccagtgaagcgaatggaacatctcagaaatcttccagcatgctgtcatcagagcagatggctcctcggggacaactcgtattggctgtaggacttggagctttagtgtctgtcccagtctttaaagctctcaccggtctgccacctttcatgggtatgctgcttggtcttgggattctctggatcctgacggatgcaatacattttggagactctgagaggcagcgactaaaagttccgcaggccctgtcacggattgatacacaaggaattttattcttcttaggtatccttttatcagttggcagcctggaatctgctgggatcttgaggcagttagcgaattatcttgatgccaatattccaaatggtgatcttattgctagtgcaattggtgtggcatcagcagttatagacaacgttccacttgttgctgcaacgatgggaatgtatgacctgacttcatatcctcaagattcggacttctggcagcttattgcattctgtactggtactggaggttcaatgcttatcattggctctgcagcaggagttgcttttatgggaatcgaaaaggtggatttcttttggtattttcgcaaggtgagcggttttgctcttgcaggttatgcagcaggtataatctcatatctagctgctcaaaatctccatctaactcttcccacatcactggccgagatcccatttattcctggctcataaaaggttggtctttgtactcttgtaagcatgatctcgccttacatatggagaaagtatcattaatactgtcttccatatcgtatgtaagctctgatgtgttatactagcagattagaaatgttgggttattgcagaagcaagcttattagtcattttcaaaagaaaacaaattgtgtcccttgtatgctactaagaacatgcaggctcgtttagtcattttcg

SEQ ID NO: 17890 - protein, 574 aa, Panicum virgatum
  misc_feature: Ceres CLONE 1795007
  misc_feature (145)..(508): Pfam Name: CitMHS Pfam Description: Citrate transporter
MAMALSCCMLGAARTAASPSLPASAALLRRRHRSLEVAVGPFPHAQRWRRGLRFRCASSPSSSPPPPPAVPPEEIDDYELLDTTGNCDPLCSLDDVSSQYFEANYKPKDDLLKALTIFATALAGAAAINHSWVAANQDIAMVLVFALGYAGIIFEESLAFNKSGVGILMAVCLWVVRSIGAPSVDVAVEELSHTTAEVSEIVFFLLGAMTIVEIVDAHQGFKLVTDNISTRSPKTLLWVIGIVTFFLSAILDNLTSTIVMVSLLRKLVPPSEYRKLLGGVVVIAANAGGAWTPIGDVTTTMLWIHGQVTTLKIMQGLFIPSVVSLAVPLALMSLTSEANGTSQKSSSMLSSEQMAPRGQLVLAVGLGALVSVPVFKALTGLPPFMGMLLGLGILWILTDAIHFGDSERQRLKVPQALSRIDTQGILFFLGILLSVGSLESAGILRQLANYLDANIPNGDLIASAIGVASAVIDNVPLVAATMGMYDLTSYPQDSDFWQLIAFCTGTGGSMLIIGSAAGVAFMGIEKVDFFWYFRKVSGFALAGYAAGIISYLAAQNLHLTLPTSLAEIPFIPGS

SEQ ID NO: 17891 - DNA, 1409 bp, Panicum virgatum
  misc_feature: Ceres CLONE 1795009
  misc_feature: Encodes the peptide sequence at SEQ ID NO. 17892
gtcgtcgtccaggtcagagctcgaggcagcgaggatcctatctatatttacaatggccgcctccaatagcagcagcgctggcaagaacggcaccaacccgctggaggccatgggcgccttcttctcgaagcaggtcgaccggcggaagctggtgaccaccgagaagcaggcgctggccacgcggctatcggcgtccggcgacgcgttcccggggtcggagcaccggccggcggaccggaagcggtggatggcggagctgggcgcggaccgggtgcgcgtgcaccaggtggtgtggcccggcacccacgactcggccaccaacaagatcggcgtcccgctggtgacccgccccttcgcgcagtgccagtccatgtccgtgtacgagcagctgtccatgggcacgcgcgtcatcgacgtgcgcgtccaggaggagcgccgcgtctgccacgacatcctggccacgtaccccgtcgacgtcgtgctcgacgacgtgcggcgcttcctgggcgagaccgagtcggaggtgctcatcctggaggtgcgcaccgagttcgggcacgaggacccgcccgagttcgacaagttcctggtcgacaagctcggcgaggagaacctgatcccgcaggacgaggcggtgttccacaagaccatcgcggagctgctcccgcggcgggtgatctgcgtgtggaagccccgcaagtcgccggcgcccaagccggggggcccgctgtggagcgcgggctacctcaaggacaactggatcgacacggacctgcctgagaccaagttcgagagcaacctcaagtttctggggcagcagccgccggtggcggaccggcgcttcttctaccgggtggagaacacggtgacgcccaaggccgacaacccggtgctgtgcgtgtggccggtcaccaagcgcatccacggctacgcgcgcctcttcatcgccgaggccttcgccaagggcctcggcgacaagctgcaggtcttctccaccgacttcatcgacggcgacttcgtcgacgcctgcgctggcgtcaccaaggcgcgcgtcgacggcaccgccgcctgaccaccctgcgggtgcgcacgggcttcgtagcaattagaggagccgctgcgattacaagcaggcaggctcaacccggtggcctcgctggactagcagtggtggatcagaacgttacagtattgtcgtgtgaagagtattcgtagcgtaggtcttcgtgtacgttgcgtgtagcgattcgggcattgcagtgttttgtccagtgtgcgtgtagcacaaaacatgcgattcgagtttaaagttgtgcgtacgtgtatcgtgcatagtgatgattgatgaattgctcgtgggagatcgtgatgtacaaaggaataaacagaaaagggttcgctctgttctg

SEQ ID NO: 17892 - protein, 339 aa, Panicum virgatum
  misc_feature: Ceres CLONE 1795009
  misc_feature: SWISSPROT Homolog: EC 4.6.1.13 Phosphatidylinositol diacylglycerol-lyase
MAASNSSSAGKNGTNPLEAMGAFFSKQVDRRKLVTTEKQALATRLSASGDAFPGSEHRPADRKRWMAELGADRVRVHQVVWPGTHDSATNKIGVPLVTRPFAQCQSMSVYEQLSMGTRVIDVRVQEERRVCHDILATYPVDVVLDDVRRFLGETESEVLILEVRTEFGHEDPPEFDKFLVDKLGEENLIPQDEAVFHKTIAELLPRRVICVWKPRKSPAPKPGGPLWSAGYLKDNWIDTDLPETKFESNLKFLGQQPPVADRRFFYRVENTVTPKADNPVLCVWPVTKRIHGYARLFIAEAFAKGLGDKLQVFSTDFIDGDFVDACAGVTKARVDGTAA

SEQ ID NO: 17893 - DNA, 1620 bp, Panicum virgatum
  misc_feature: Ceres CLONE 1795019
  misc_feature: Encodes the peptide sequence at SEQ ID NO. 17894
ctctctctctctccgacacgcgctctcctccccgtccccttcctcctcaccgacggcggcggcggcggccgagatcccggatggggtcccgcccaccttcaggttccggccgacgcagcgcgagctcatcgagttctacctcctcccgcgcgcccgcggccaggatccattccccggcgtcatcatcgaggacgacgcggcggggagctcgctgccctgggacctcttcgagcgccacggactggggggcgaggacgaggactacttcctcgcgcgcaccggcggggccaggaagcccggcgcccgccaggaccgcggctgcgacggcggcgccggggcgtggaagtggaagatgcagagcagcgccgacaagggcctgcgcgtcggcggcgagaggatcctctgccgcaggagcaacctcagcctgcacatgggcaagggcaagagcggcggcagcgtggggtgggtgatgcacgagtacaccgtcgccgcgccgccgtgcccgtcgcccgtcaagatctgccacatcgccttcaccggccacggcaggaagcggaagcgcgtgccggatggccaagaagactgccccggtgaacacgcgtcccggcgcgcgcgcgtcgaggccgcggcggcctgtggctgttcttctggggagatgcagatgctcggtcctgactccggcgaggtggtgcccgcttctgcagatgaagagcgctcgcagctcgtcctgaccggcggcgacatcttccctcagagtcctcttctcggaagcagcgatttcctgggcttcccctccacagcgtcagccaatgcggagcagtaccaagagctggagcagcaggtgccgagtacacaggaggaggaggagcaggtcatgatgccacagctgatggtccaacaatctggcatgatggagcagctttctgcaggggaactggagttctggagctcgataggggtcgatgttcaaagcaccaactgtgctgagcaggagttctggagctcgaacggggtcgacagcaacagcgtggtcccaggcatcggcgacatggcaggagataaccaagaccagcaggagttctggagttcgtttacggctgatgtccagagcaactgcacggtgccagacctctatgtatcaccgatacgcgatacgggtacggcgatacggcgatatgtgagtttaaaaaacgattgagagtatcggagtatcggatacgcaagtatcggatacgggtacggctgggttagtgaactatcggtgattcatagccagacatggccgccggagcgctcggcggcaatccctggggaggctactgcatcacttgctaggagggtagtttctgctcatgaactggcagatatttggagatttttgcagcacaaggatggagcagctgtgcctggcaccagcagaaccgatttttgcagctaggagttggtttcttgggatgtcagcagctgcttgttccacatgtttttttcccctgcagttactgattattttctgcagtaactgtaatctactgatatagagtaacactcattttgtagccctatatatgaattgaacctatctaaaactttaattatcttatgctggaatttccagtttgc

SEQ ID NO: 17894 - protein, 398 aa, Panicum virgatum
  misc_feature: Ceres CLONE 1795019
  misc_feature (29)..(163): Pfam Name: NAM Pfam Description: No apical meristem (NAM) protein
SLSLRHALSSPSPSSSPTAAAAAEIPDGVPPTFRFRPTQRELIEFYLLPRARGQDPFPGVIIEDDAAGSSLPWDLFERHGLGGEDEDYFLARTGGARKPGARQDRGCDGGAGAWKWKMQSSADKGLRVGGERILCRRSNLSLHMGKGKSGGSVGWVMHEYTVAAPPCPSPVKICHIAFTGHGRKRKRVPDGQEDCPGEHASRRARVEAAAACGCSSGEMQMLGPDSGEVVPASADEERSQLVLTGGDIFPQSPLLGSSDFLGFPSTASANAEQYQELEQQVPSTQEEEEQVMMPQLMVQQSGMMEQLSAGELEFWSSIGVDVQSTNCAEQEFWSSNGVDSNSVVPGIGDMAGDNQDQQEFWSSFTADVQSNCTVPDLYVSPIRDTGTAIRRYVSLKND

SEQ ID NO: 17895 - DNA, 710 bp, Panicum virgatum
  misc_feature: Ceres CLONE 1795047
  misc_feature: Encodes the peptide sequence at SEQ ID NO. 17896
acaggagcccgcggagtgatcaaaaaagcaagtaacaagagaagatgaccgacgttgtgatgaccatcagtactaccacggatttggaaagagaactgaataaatccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctggcgtggaggcgctaccgatgtacgttctactgaagaatgacgatgtgatcgacatggtcgttggcgtcaggaggcacgagctcgagaacgccataaaaaacaatatctaacgactgatccgatcagatcatccatgcgtcgagaacgaacgggaaatgaatgattcatagttaaataagcccactactgtacgtcccatgtgttgtatcacggatactgaaactcgtgtgtgcatgtacacatcctagctagctcagccgccgtagatccccatgttatacattgtacgtatggatctcgattatcgattgtcccatgtttgatttcctaaacttctgtggaagtagatccccatgttatgtatactctggtttgaaacagtttgcaataaatcaatgtctggctagtatatttctaaggaggaagagacaagagagcgaggcgaagcc

SEQ ID NO: 17896 - protein, 108 aa, Panicum virgatum
  misc_feature: Ceres CLONE 1795047
  misc_feature (4)..(107): Pfam Name: Thioredoxin Pfam Description: Thioredoxin
  misc_feature: SWISSPROT Homolog: EC 1.8.1.8 Protein-disulfide reductase
MTDVVMTISTTTDLERELNKSDKLIVLEFMAPWSEPCKVMKEPYRRIARARKDRVNFYTLNVDKFKDLAEEAGVEALPMYVLLKNDDVIDMVVGVRRHELENAIKNNI

SEQ ID NO: 17897 - DNA, 2406 bp, Panicum virgatum
  misc_feature: Ceres CLONE 1795048
  misc_feature: Encodes the peptide sequence at SEQ ID NO. 17898
atactatagcaaggcaaccatccagatcagcggagcgctcgttgccgtgcatcactccactgctctctaaggtcgccggcgcgatgctcgctgcctcgtccggccaaatggtcgggctctgcttcccgcgccgctctccgtccccgctcctcagcccccgccgccgcctcctccctcggcgccccgccgcgaggccgcgcggcggcctgccccggtggcggtgctcgtccgccgcctctccgccgcccccgtccgccgactccgcgcttgaacatccacttcgtagaaagtgctctcctctacttgagagtgttctattacctggcggaagtgacttgaacgtgcatgaatggaaggcagttccagatatctggaggacagcggcagagaaatatcctgacctcgtagctgttatagatccttatcatgaaccgccgacagaatggacatatacacagcttgaacaagaaatattagatttttctcaaggtctaagggccattggcgttgctccagatgaaaagctagctctatttgctgacaactcatgtcggtggttagttgcagatcaaggaatcatggctactggtgcaatcaatgttgttagaggaacaagatcttccgatgaagaattgtttcaaatatacactcattcagaaagcattgcacttgttgtggacagtcctcaattctttaaccggcttgtagaatctttcatatcaaggattaatgcaagattcattgtgctactttggggagacaaatcatgcatagatagcaaagctgtgaaggatataccactttatgactacaaggatatgactaaacttggccgggagagtcgtaatactctgcttctttctggccaccaaggtcagcaagaagtcttcgaaactattgctccagaagatgtggcaacacttatatatactagtggaacaagtggcatgccgaaaggtgtaatgctgacccaccgaaatctcttgcatcagataaagaatttgtgggacattgtaccagcagaacctggtgataggttcgtaagcatgcttccaccatggcatgcttatgagcgtgcttgtgagtacttcatcttcacttacggaatccagcaagtttacactaccgtcaagtacctgaaggaagatttgcagcgttaccaacctcagtatattatatcggtaccactggtctatgaaactttgtacagttccattcataggcagatttcttccagttcggctgctcgaaaaatcattgctctttcacttatcaagataagcttactatatatggagaccaagaggatctatgagggaacagttttatcgaacaatcctgttcaaccatcattcattgtctatatggtcaagtggatatgggcaaaatttattgccacatttttgtggcctttgcataatctggcaaagatactagtctacaagaaaattcatttagcaatcgggatttcaaaggctggtattagtggtggtggaagtcttccgatgcatgtcgataagttttttgaggccattggcattaaagtacaaaacggttatggcctaactgagacttctcctgctgtagctgctagaagaccattctgcaatgttctaggcacggttggccccccagtaaaacatactgaaatcaaggtttttgacatagagactggtgatgtgcttccagatggttcaaaggggattgtgaaaattaaaggaccacaagtcatgaagggatactataagaacccatctgctacgaatgaagctctggatcaagagggttggttcaacactggagatataggttggattgcacctcgccacaccgtagggccgagtcggaagtgtggagggatgcttgttcttgaaggacgtgcaaaggatacaatagttctctctacaggtgaaaatgttgaacctgctgagattgaggaagcagctagcaggagtaacttgattaatcagatagttgtgatcggccaggatcaacggcgtcttggtgccatagttgttccaaacagtgatgaagttctggcagaagcaaaaaggaagtctctcgttgatgagaatggcgaagtggcgaaagataaggtcataaacatgctatatgatgagctgagaacccggaccgcacattgctctttacgcatcggccctatcatgatcgtcgatgaaccatttacaattgacaacggactgatgacacccaccatgaaaacaagacgggacaaagtgactgcaaaataccaaacagagatcgaagcgttgttcaagtgagatatggagtgttggtgcgtgcgagtgcagacagcagctgcaataagaagatatatagagaacgatgcgtccatctgatagaaacaatgctgttgcatttaataataaataaatatactccact

SEQ ID NO: 17898 - protein, 732 aa, Panicum virgatum
  misc_feature: Ceres CLONE 1795048
  misc_feature (122)..(632): Pfam Name: AMP-binding Pfam Description: AMP-binding enzyme
  misc_feature (483)..(731): SWISSPROT Homolog: EC 6.2.1.3 Long-chain-fatty-acid--CoA ligase
  misc_feature (276)..(323): SWISSPROT Homolog: EC 5.1.1.12 Ornithine racemase
  misc_feature (82)..(293): SWISSPROT Homolog: EC 6.2.1.1 Acetate--CoA ligase
MLAASSGQMVGLCFPRRSPSPLLSPRRRLLPRRPAARPRGGLPRWRCSSAASPPPPSADSALEHPLRRKCSPLLESVLLPGGSDLNVHEWKAVPDIWRTAAEKYPDLVAVIDPYHEPPTEWTYTQLEQEILDFSQGLRAIGVAPDEKLALFADNSCRWLVADQGIMATGAINVVRGTRSSDEELFQIYTHSESIALVVDSPQFFNRLVESFISRINARFIVLLWGDKSCIDSKAVKDIPLYDYKDMTKLGRESRNTLLLSGHQGQQEVFETIAPEDVATLIYTSGTSGMPKGVMLTHRNLLHQIKNLWDIVPAEPGDRFVSMLPPWHAYERACEYFIFTYGIQQVYTTVKYLKEDLQRYQPQYIISVPLVYETLYSSIHRQISSSSAARKIIALSLIKISLLYMETKRIYEGTVLSNNPVQPSFIVYMVKWIWAKFIATFLWPLHNLAKILVYKKIHLAIGISKAGISGGGSLPMHVDKFFEAIGIKVQNGYGLTETSPAVAARRPFCNVLGTVGPPVKHTEIKVFDIETGDVLPDGSKGIVKIKGPQVMKGYYKNPSATNEALDQEGWFNTGDIGWIAPRHTVGPSRKCGGMLVLEGRAKDTIVLSTGENVEPAEIEEAASRSNLINQIVVIGQDQRRLGAIVVPNSDEVLAEAKRKSLVDENGEVAKDKVINMLYDELRTRTAHCSLRIGPIMIVDEPFTIDNGLMTPTMKTRRDKVTAKYQTEIEALFK

SEQ ID NO: 17899 - DNA, 953 bp, Panicum virgatum
  misc_feature: Ceres CLONE 1795071
  misc_feature: Encodes the peptide sequence at SEQ ID NO. 17900
gcacctcgcttcgatctcctgcgttgcattggtctcctagcttgctcgtttcgttcctctttatttgctcgatcgaacgatcgatcgatcccaggtcttggttactgcaatgacgtccggtggcgcgtcgctggccttggccgcgctgctcctcgtgggctgcgtcgcggcggcggcggcgaccaagtacaccgtcggtgacgcctccggctggacgaccagcggcgattacgccacctgggccagcggcaagaagttcaaagtcggcgacactctcgagttcaagtacgccggcggcgcgcacacggtggacgaggtgagcgcggcggactacgccgcctgctcctccagcaacgcgctcagcagcgacagcgccggctccaccaccgtgaccctcaagaccgccggcaagcactacttcatctgcggcgtcgcgggtcactgcagcagcggcatgaagctcgtggtgaatgtggccgcgaccaagtcgtccgccccggcgccggcgccggcgcctgccgtggcctcggccccggacgccgcggacaccaccccggacgccactcccgccacgacccccaagtcgccctcgagctccggcggcgccacgtccaagaccccggtcacggtcctctcgccgccggccaagaagtccacctccggcgccgccgggctcagcgccgccgcgtgggccggcttgggcctggccgggctcgtggccgtgcacctcggcgcgttctagggggccgacggccagggcggaggcagtgcttgctgttttgttctcgttttattgtcgtatcatacagtactccgtaggatgcccgccgtcgattcatgtatttgtcgaggacctgagaggtttcttttgatccaggcaacttagtgcttttgctgagcggcgctggttatcatattcttttcatgccttttctatcaatattttccacttc

SEQ ID NO: 17900 - protein, 210 aa, Panicum virgatum
  misc_feature: Ceres CLONE 1795071
  misc_feature (35)..(116): Pfam Name: Cu_bind_like Pfam Description: Plastocyanin-like domain
MTSGGASLALAALLLVGCVAAAAATKYTVGDASGWTTSGDYATWASGKKFKVGDTLEFKYAGGAHTVDEVSAADYAACSSSNALSSDSAGSTTVTLKTAGKHYFICGVAGHCSSGMKLVVNVAATKSSAPAPAPAPAVASAPDAADTTPDATPATTPKSPSSSGGATSKTPVTVLSPPAKKSTSGAAGLSAAAWAGLGLAGLVAVHLGAF

SEQ ID NO: 17901 - DNA, 1279 bp, Panicum virgatum
  misc_feature: Ceres CLONE 1795074
  misc_feature: Encodes the peptide sequence at SEQ ID NO. 17902
gaagtgcacaggcagtgacgggcgcacgcataccgacggacgaggtaggctgctcatcacccatccctgttcccccggccgcccgtgtcgggcggaggcgggacgcgcgcgggatcggaatgggacgccacgcccacgcgggctccgccgccgccggcgtgcagcacaagctgcgcaagggcctctggtcgcccgaggaggacgacaagctctacagccacatcatccgctacggcgtcggctgctggagctccgtgcccaagctcgcgggcctccagaggtgcggcaagagctgccggctccggtggatcaactacctccgccccgacctcaagcggggcagcttctcgcagctggaggaggacgccatcgtcggcctgcacgagatcctcggcaacaggtggtcgcagatcgcgtcgcacttgccgggccggacggacaacgagatcaagaacttctggaacagctgcctcaagaagaagctgcgccagcgcggcatcgaccccaccacccacaagcccatctccgccgacgcaggcggcttcgcgccgaagcagcagcagcagcaccagcaggtgttcgacccgttcccgctgaccgacagcttcggcggcggcttcgacgcggctggtggccccgcgctgtacggccacctgggcggcggcggcaagcaggacgcggccgcgttcgtggactacagcagcgtgctggacgtgtcggagaacctgggctacggcgagagctccagcaacagcagcaactggaactgcgccccggaggcgagcaatgcgctcgacggcagcgaggcggcggcgcagctgcactgggcctccggcgaggagcagtcgctcgagcacaagttcctgctgccctgccacgggcagcaggagcagagcctgccgcatttcgacttcgacatcagccggggcgccgtggtcggcgacttcaacctcgagttcttctgaggtttcaacctgtgaattccagttccggcgacataaattaccaccgtatatacactgttcctaaaggcatttcacacagaccaaacggaagcttagagactgtgctttaatttgttaatccccctagtcgtccttcttactcctcctccttagtccttaacaatgtctctttttaacgtttctttgttctgttttcagcatgggtaaaataaaggcatatatacaaatatagtacaagtgtaaacacagtgtagttgctatatactgtatacagtactaaggttttgtaagaataagtttcttacttcactttc

SEQ ID NO: 17902 - protein, 281 aa, Panicum virgatum
  misc_feature: Ceres CLONE 1795074
  misc_feature (20)..(67): Pfam Name: Myb_DNA-binding Pfam Description: Myb-like DNA-binding domain
  misc_feature (73)..(118): Pfam Name: Myb_DNA-binding Pfam Description: Myb-like DNA-binding domain
  misc_feature: Functional homolog of the protein sequence given in SEQ ID NO 50235
  misc_feature: Useful for biocontainment applications
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1004 in the 11/435,388 US patent application
  misc_feature: The sequence is a functional homolog of SEQ ID NO 1002 in the 11/435,388 US patent application
  misc_feature: Functional homolog of the protein sequence given in SEQ ID NO 50784
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 36 in US patent 7193132
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: Functional homolog of the protein sequence given in SEQ ID NO 50785
  misc_feature: Useful for making plants with modulated biomass
  misc_feature: Useful for making plants with modulated flowering time
MGRHAHAGSAAAGVQHKLRKGLWSPEEDDKLYSHIIRYGVGCWSSVPKLAGLQRCGKSCRLRWINYLRPDLKRGSFSQLEEDAIVGLHEILGNRWSQIASHLPGRTDNEIKNFWNSCLKKKLRQRGIDPTTHKPISADAGGFAPKQQQQHQQVFDPFPLTDSFGGGFDAAGGPALYGHLGGGGKQDAAAFVDYSSVLDVSENLGYGESSSNSSNWNCAPEASNALDGSEAAAQLHWASGEEQSLEHKFLLPCHGQQEQSLPHFDFDISRGAVVGDFNLEFF

SEQ ID NO: 17903 - DNA, 1955 bp, Panicum virgatum
  misc_feature: Ceres CLONE 1795075
  misc_feature: Encodes the peptide sequence at SEQ ID NO. 17904
gagcatttccgttcccaaatcgcactggcatagtcagagaccgaactcggccattcccaacaggtcaccgcatcctcgccgtcgccgtagtagccaaagctcccaacccgcccgcgtcggttcccccgtgccgacgagatggggagcgcggacctggtgctcaagcctgcgtgcgagggctgcggcaacacgtcggacctttacggcacgggatgcaagcacaccacgctctgcagcgactgcggcaagtccatggcgcgctcccgcgcccgctgcctagtctgctccttgcccatcaccaggctcatccgggaatataatgtccgagctaatgctattacggataagacatactctattggaagatttgtcactggtttgcctcctttctcgaagaagaagagtgctgagaataagtggtctcttcataaggagggtctacaaggacgtcagatacatgacaatatgcgggaaaaatacaacaggaaaccatggattttggaagatgaaacgggccaatatcagtatcaaggtcaaatggaaggatcacagtcagctacagctacatattatttgttaatgaggcatggcaaggaatttaatgcctatcctgctggctcttggtataacttcagtaaaattacacagtacaaacaactgacactggaagaggctgaagaaaagatgaataagaggaagactagtgcaactggttatgaacgttggatgatgaaagcagctgcaaatgggccagctgcctttggttcagacatgaagaaacttgaagccaccactggtggggaaaaagaaagtgctcgtcctaagaaaggaaaaagtaacgaggagggtaataattctgataaaggtgaggaggatgaagaagaggaagcagcacgcaagaataggcttggactcactaaaaaaggcttggatgatgatgaggaaggtggaaaagatctagactttgatttggatgatgaaattgagaaaggtgatgactgggagcatgaagaaacatttactgatgatgatgaggctgtagatatcgatccagaggaacgggcagatttagctcctgaaattcctgctccacctgaaattaagcaggatgatgaagagaatgaagaagaaggtggtctgagcaagtctggcaaggaattaaaaaagctgcttggtcgtgctgctggactaaatgagtcagatgctgatgaggatgaagaagaagaagaagacgagtcatctccagtgctggctccaaagcagaaggatcaagttaaggacgaacttgtagaaaacagtccagttaaaccaacgccatcaggacatgcccgcagcacacctgctgccaaatccaagcaaaagagaaaaacaggtgctgatgatgcaaaaacttctggcggtgcagcttcaaagaaagcaaaggtggaatgggatatgaaagcatcaaatatcaaggagaaagcaccttcttcggcaaaacctacatcaaaaccctctgcttcatcaaaaagtgggacaaatgtattacctgttacagaggatgaaatcaggagtgttcttcttgctgtggctccagtcaccacacaagatctagtatccagattcaagtctaggcttcgaggtccagaggacaagaatgcttttgctgaaattctgaagaaaatttcgaagatacaaaagacgaatggccacaactatgttgtccttagagacaagaagtgaagaacccaacttaggtgttgacttcgttgtcacgatctttagctgtactttggggataaaagatatttagtaacaagtaacatgctgtactttggtgataaacaaagttgaaacatacttttgattttgtgtacgtagattttgtttctattaaagtgattgtcagtttgtgtaagtagatttataaaccctgattacagaaaatttggccacactaaccaagtgccacctcc

SEQ ID NO: 17904 - protein, 527 aa, Panicum virgatum
  misc_feature: Ceres CLONE 1795075
  misc_feature (19)..(525): Pfam Name: TFIIF_alpha Pfam Description: Transcription initiation factor IIF, alpha subunit (TFIIF-alpha)
  misc_feature: SWISSPROT Homolog: EC 2.7.11.1 Non-specific serine/threonine protein kinase
MGSADLVLKPACEGCGNTSDLYGTGCKHTTLCSDCGKSMARSRARCLVCSLPITRLIREYNVRANAITDKTYSIGRFVTGLPPFSKKKSAENKWSLHKEGLQGRQIHDNMREKYNRKPWILEDETGQYQYQGQMEGSQSATATYYLLMRHGKEFNAYPAGSWYNFSKITQYKQLTLEEAEEKMNKRKTSATGYERWMMKAAANGPAAFGSDMKKLEATTGGEKESARPKKGKSNEEGNNSDKGEEDEEEEAARKNRLGLTKKGLDDDEEGGKDLDFDLDDEIEKGDDWEHEETFTDDDEAVDIDPEERADLAPEIPAPPEIKQDDEENEEEGGLSKSGKELKKLLGRAAGLNESDADEDEEEEEDESSPVLAPKQKDQVKDELVENSPVKPTPSGHARSTPAAKSKQKRKTGADDAKTSGGAASKKAKVEWDMKASNIKEKAPSSAKPTSKPSASSKSGTNVLPVTEDEIRSVLLAVAPVTTQDLVSRFKSRLRGPEDKNAFAEILKKISKIQKTNGHNYVVLRDKK

SEQ ID NO: 17905 - DNA, 2608 bp, Panicum virgatum
  misc_feature: Ceres CLONE 1795076
  misc_feature: Encodes the peptide sequence at SEQ ID NO. 17906
attggagtagcagcaaagcaactcaaacgcagtcagttctctgctctgttgctccctcctcgttccacagcgatccttcctcaacttagaggccgaggaactggcaagcattcctacctgcgctcctctcatttctccccaggaagcctgcacgatcttcttgaagcgatcaacctggagcccttggattcctcgggcgggcgtcgcgtgctttcttggacccggagcctcgcgagatttgctgagtacttctccgatctagagagagaggctacttgggtttcttggccacagagcaaggggacagggacaccaacgcctatatggatctctgaagctgatgggccattggtgattcttggttctgatttggtggtggctggtgaggagaaggtggaggagaaggggaagggtggaatctcacaaatagagaggtgattcaggttactcttggtgtgtcaagatgaagtacatgaagcttggatcgaagccggatgtctttcagacagatgggaacagcatcaggtttgttacaactgagctggcaacggatattgttatcactgttggggatgtcaagttctatcttcacaagttccctcttttgtcgaagagttcctgcttacaaacattggtagcctcaacaaatgatgaaagcaatgatgaagtagatatctctgatatccccggtggacctgcggcattcgaaatttgcgccaagttctgctacggaatgatagtcacactgaacgcctacaatgtcctcgcagcgcgttgtgcagctgagtaccttgagatgttcgagacaattgacaagggtaacctcatctacaagattgatgtgttcttgtccgcaagcatattccagacatggaaggactcgatcatcgtgctgcagtcaacaaagtcacttcagcaatggacagagaacctgaaggtgatcaaccattgcgtcgattccatcgcctccaaggcatccatggatccatcagaggttgattggtcatacacctacaacaggaagaagcttccatcagaaagtggtctcgattcgcactggaatggcgttaggaagcaacagacagtgcctagagactggtgggtggaggacctctgtgaccttgaggtgtgcttgtacaagaaagtcatcttggctatcaaggccaagaggaggacaagcagcaatgtgatcggtgaagctctgagggcttacgcctgccgccggctgttcagttccctggacaatgccgtcaacaatgggcttgactgcacaaagcattgtgcagctcttgaaaccgtcatctccctgttgccagctgagaaaggttcagtctcttgtggtctccttctgaagctgctgagagcttcatgcctgctggggtccggtgagacctaccgcgaagacttgatcaagagaattggcacacagatggatagagcttctgtctctgatcttttgatacctgcaggctcaagcgatgatgcaatgtacaatgttgacatggtcacatcaatactgaaggagttcatgctgcatcacaaagatgggagtgagccaaagttgcaggaagatgatgacaccatggatgtagctgatcaattcatccgtgtggagaagttcaattctatctccatctcttcaaagctgggggctgtcacaaagctgatcgatgcatatctatccgagatcgccaaggaccccggccttcctctggagaagttcattgcactcgctgaatcattgcctcctgcatctcgaccagtgcacgacgcgctctaccgcgccatcgatgtttacctcaaggagcacccagggctgtcgaagagcgagaagaagcggctatgcgcactgatggactgcaagaagctgtccgccgatgcgagcgcgcacgccgtgcagaactagcgcctcccactgcgcgtggtggtgcaggtcctcttcttcgagcaggtccggcagtcgtcggcctcggccactgttccgtccgccgcacgctcgttcctcctgcccagggaggacggcacctcgtgcggcagctcacgatccgcgaccacaacagcgaccgaggacgaacagtgggccggcgttgtgggcgcaccggcgtccgcgtctggcggtgacgccagctctctccggtcagtgagcctggcagccagcaagagacgtgacagcgccggcggcaagaagaaagcaaagggcggtgcagttgtgccgacgccggcaaagagggtgctggggaagctgtggtccagcaaggccagcagcggggagaacagcgggtcggacgacacgtcggagagccccgccggctccctcaaccaggaggagaccaagtcaacgccgacacggatcacgaggcactctgtgtcatagtggctgtatatttttgttttttgtttttgttctggagtgatggttttgttacatgcaacatttggattggatttactgactgaaatactttagtgtaatatattgtccattataatcgcagaaaggtgtaatattgggactataccttgtgtaagattccgtagcagtaagaaaggttggaatatgatttcagtttttttaagaaaaaaacatcttgttgggaaagtcttttcc

SEQ ID NO: 17906 - protein, 480 aa, Panicum virgatum
  misc_feature: Ceres CLONE 1795076
  misc_feature (210)..(474): Pfam Name: NPH3 Pfam Description: NPH3 family
MKYMKLGSKPDVFQTDGNSIRFVTTELATDIVITVGDVKFYLHKFPLLSKSSCLQTLVASTNDESNDEVDISDIPGGPAAFEICAKFCYGMIVTLNAYNVLAARCAAEYLEMFETIDKGNLIYKIDVFLSASIFQTWKDSIIVLQSTKSLQQWTENLKVINHCVDSIASKASMDPSEVDWSYTYNRKKLPSESGLDSHWNGVRKQQTVPRDWWVEDLCDLEVCLYKKVILAIKAKRRTSSNVIGEALRAYACRRLFSSLDNAVNNGLDCTKHCAALETVISLLPAEKGSVSCGLLLKLLRASCLLGSGETYREDLIKRIGTQMDRASVSDLLIPAGSSDDAMYNVDMVTSILKEFMLHHKDGSEPKLQEDDDTMDVADQFIRVEKFNSISISSKLGAVTKLIDAYLSEIAKDPGLPLEKFIALAESLPPASRPVHDALYRAIDVYLKEHPGLSKSEKKRLCALMDCKKLSADASAHAVQN

SEQ ID NO: 17907 - DNA, 461 bp, Panicum virgatum
  misc_feature: Ceres CLONE 1795078-R
  misc_feature: Encodes the peptide sequence at SEQ ID NO. 17908
gaaccaatatttaagcttgcaggtttcaagatggaagtggtaaaaactacacatgctggtcatgcaaaatctcttgtatcaactgttgattttagtacctgtccagatggtattgtatgcgtgggtggtgatggaattgtaaacgaggttctcaacggtcttctatgcagagatgatcaaaatgtagctgcctctgttccaatcggtattatacctgctgggtctgataactcacttgtttggacagtcttgggtgtcagggatccaatttctgcagcactgtccattgtcaggggaggtcttacacctattgatgttttttctgttgaatggattcaaagtgggactatgcattatggcacaactgtatcatattttggttttattagtgatgttcttgaactctcagagaaatatcagaagcgttttgatcctctccgttactttgtagctggtttctc

SEQ ID NO: 17908 - protein, 153 aa, Panicum virgatum
  misc_feature: Ceres CLONE 1795078-R
  misc_feature (1)..(111): Pfam Name: DAGK_cat Pfam Description: Diacylglycerol kinase catalytic domain (presumed)
  misc_feature: SWISSPROT Homolog: EC 2.7.1.91 Sphinganine kinase
EPIFKLAGFKMEVVKTTHAGHAKSLVSTVDFSTCPDGIVCVGGDGIVNEVLNGLLCRDDQNVAASVPIGIIPAGSDNSLVWTVLGVRDPISAALSIVRGGLTPIDVFSVEWIQSGTMHYGTTVSYFGFISDVLELSEKYQKRFDPLRYFVAGF

SEQ ID NO: 17909 - DNA, 708 bp, Panicum virgatum
  misc_feature: Ceres CLONE 1795078
ttaataaaataaaaaatttctccccctcctcgtctcgtctcgtcctcctcccccctcgcctcgccctcttccttcctcgggcggctagccaggctcctctcttcctctgcctccgccgcgcgcggtcgtctccgaccactgcgagccgcgagctagggtttggctcccccccgcctaatcgagctcggggatcggcaccccccgcggcgggaggtctcggctaggctcgacccccccggttcgacccgatttggcttagtcatgagtgtcttctcatgagcttcccctattgatgctttacagctctatgctttttcttaacatgcaacatctccggatgttatctatgtactggatatacacttagaagtcagagatgcagaagtctgaccatcatgagcagaatcttacttcaccaagagggctaatccataaaatacttcgccgtacaaatagtaggcgttctccaactgcagcagagcagcaaacttctcctgtatctccagaaacaagcaacacaatattttcaaagcaaaaagatcctgatgatgtcatcaatgatccagaaaaggcgagcacacatagtatccaaattgaagatgagaaatctgatttacttggatgcgaggtttattctgggaagcttacattagataacagaactaagagtgcatcaagtgaacaatctggatcagggtccagcagcaa

SEQ ID NO: 17910 - DNA, 734 bp, Panicum virgatum
  misc_feature: Ceres CLONE 1795092
  misc_feature: Encodes the peptide sequence at SEQ ID NO. 17911
agagcattggaatcaatagcaattgcgtgctccgcacccgcacgccaaccgccaccgccgccggctcgccgccgattcgagggttcgttccgggagaaggcagatcggttccgcgatggagtgcatcgccgagatgccgcccgcgccgctggaccgccgcccgcgcaagcggcagcgtctggggtgggacgtcggtcccgccgagatgcatcaggttcagcttggactttgtgggcaagaagttgtgaatgccataagtgctgtggcattgggtctctcttcaggtggtattgtctcctctcagctcaaccaagggcagcctcgtgagggttcccctccactgagagatgatgacaaggatgggcattatgtgtttgctgttggagataaccttacacctcgctataagatcaatgcaaaaatgggtgaaggtacctttggtcagatgttggagtgttgggacaaggaaaggaaagaaatggtggctattaagatcatcagaggcattaagaagtacagggatgctgcaatgatagaaattggcatgctcgagcagcttggtaaatacaatgaaagtagatccaggttagtctctggttcagttagcactcttctgtgcactttacattcataagattgcttgtatatatgagctggtctattttgcagttgtgttcaaattcggaactggtttgactatcgtaaccatatctgtattgtaagtacattgttag

SEQ ID NO: 17911 - protein, 172 aa, Panicum virgatum
  misc_feature: Ceres CLONE 1795092
  misc_feature: SWISSPROT Homolog: EC 2.7.12.1 Dual-specificity kinase
MECIAEMPPAPLDRRPRKRQRLGWDVGPAEMHQVQLGLCGQEVVNAISAVALGLSSGGIVSSQLNQGQPREGSPPLRDDDKDGHYVFAVGDNLTPRYKINAKMGEGTFGQMLECWDKERKEMVAIKIIRGIKKYRDAAMIEIGMLEQLGKYNESRSRLVSGSVSTLLCTLHS

SEQ ID NO: 17912 - DNA, 1934 bp, Panicum virgatum
  misc_feature: Ceres CLONE 1795099
  misc_feature: Encodes the peptide sequence at SEQ ID NO. 17913
atccatcgaaattccatccagtccaccaacttttctttgtttagtcaactccgtctccatccatccatccccacacaagagcaacagaataccaccgcactcgcacactccgctcccccgccgctcgccgtggtgttctcctgtaccctgcagtactcgatcggcggcggttctcccccggcgacgcggccggctcggtgctgctgctgctagcaaatcgccatggaaacgtacaccacggatgacgcgcttacagccatggggtttgggaagttccaggcgcttgttcttgtatacgccggcacgggctggctcgcggactccatggagctcatgttgctgtccttcgttggaccactggtccggcagcagtggaatgtctcggcccagcacgagagcctgctctccagtgttgtcttcactggcatgttgataggagcctgttcctggggctatatttccgacaagtatggaagaaggacagctttgttgttctcaattgttctcactactggagcagggtttctaagtgctttatctcccaactatatatccttgatagtttttcggtttcttgtcggtataggggttggtggcacacatgtattttcatcttggtttttggaatttgttcctgcaaaaaaccgtggcacctggatgattgttttttctgttttctggactattggaacaatcctggaagcttcacttgcatgggtcgtcttgtcaagattgagttggcggtggttgctggcattcactgctcttccatgcttcctgctgcttctcctttttgtcattgcacccgagtcaccacgctatctttgcgtacaaaacagaatatctgatgcaacgcttgttctagagagaatggccaagacaaacaaagtagctcttcctcctggagttctcacataccataaagagacacaattagttgaccacaatcctcttaccgctcagaatgggcgtcttccagtcagagataatgattgtgcagctgacaatgctatgagctccaaatctggtggtattgctgcattgcgcaaactattttcacgtaaattgctcagatcaactcttcttatatggtttgtatggttcgcaaactcgttcgcatattatgggctagtactgctgtcatcgcagctgggtgatgctaacagaagatgcgcttctggccagaagtctgaagtgcaacaaaaaaatgacaacctttacaaagatgtctttataactagtttagcagagtttccaggcttagtgatttctgccattattgttgattggtttggccggaaagctacaatgtggatcctgttgtttggatgctgtgctttccttggaccactcgctgttcatcagaaagaatcattgacaacagcccttctattcggtgctcgcgcatgtggcatgggtagctctacagttttatgtttatacgcaccagaggtgtacccaacatcagcacgctcaacgggtgttggaattgccaccgccattggtaaaattggtggcatcgtgtgccccatcatcgctgtcggcatgctgcggagttgccaccaaatggaagccgttgtggtctttgagctggtgctaggtctcgctggagttgcctgcattctcttccctgtggagaccaagggccgtgagatgaaatgacggtgtcagatcaaagcacgttgaggcccaaatgcacccaaagcgaccagcgtgcatcacttccatttatgattttgttcctatatagagaaacctaatatgattagtatataggtggatatctgggtcaaatccaggccgtttctgtattctgcgtggtatgttttttgtgtgtgggtattgtgacgtttattatcaatacttgttgtgcatgtgtaactcaagtccagcagtgttacattcttaagaaataaaaccgtgacattttcttc

SEQ ID NO: 17913 - protein, 479 aa, Panicum virgatum
  misc_feature: Ceres CLONE 1795099
  misc_feature (25)..(436): Pfam Name: MFS_1 Pfam Description: Major Facilitator Superfamily
METYTTDDALTAMGFGKFQALVLVYAGTGWLADSMELMLLSFVGPLVRQQWNVSAQHESLLSSVVFTGMLIGACSWGYISDKYGRRTALLFSIVLTTGAGFLSALSPNYISLIVFRFLVGIGVGGTHVFSSWFLEFVPAKNRGTWMIVFSVFWTIGTILEASLAWVVLSRLSWRWLLAFTALPCFLLLLLFVIAPESPRYLCVQNRISDATLVLERMAKTNKVALPPGVLTYHKETQLVDHNPLTAQNGRLPVRDNDCAADNAMSSKSGGIAALRKLFSRKLLRSTLLIWFVWFANSFAYYGLVLLSSQLGDANRRCASGQKSEVQQKNDNLYKDVFITSLAEFPGLVISAIIVDWFGRKATMWILLFGCCAFLGPLAVHQKESLTTALLFGARACGMGSSTVLCLYAPEVYPTSARSTGVGIATAIGKIGGIVCPIIAVGMLRSCHQMEAVVVFELVLGLAGVACILFPVETKGREMK

SEQ ID NO: 17914 - DNA, 634 bp, Panicum virgatum
  misc_feature: Ceres CLONE 1795124
  misc_feature: Encodes the peptide sequence at SEQ ID NO. 17915
ccccaaccccaactccaactcgacccgggaagggggggagaaggagagagagagagatagagagggggcgcggcgaggaggccggcggcggcgccggcagcggcagccggggatgggggaggtggccgcgctgcgccagctcgtcggccaggtgcaggagctctgggacctctacggcgccaacgcccacccgctccccagatggtatttacttgactttgaacatggttcaatcaaagatgattattgtggaggacggactggatacaactcggaattactgaagatcatggagactaaccaatctcctcctcgcaagcgaccgcggagagatcgaaaccgcgagaaggcgccctgctcaaacacaactgaggtaatgcaacaggagatttggaaagagttccctgaagatctttttgaaactgtcattgcaaggcttccagttgctgcaatttttcgattccgcactgtctgccgaaagtggtcttctcttttgggctcagacagtttctctcatcagtactctgaagctccacatggactgccatggttctatacaatcacccatgagaatgcaaacaataatgttgcaatgtatgacccttcactgaagaaatggcaccacccatctgtt

SEQ ID NO: 17915 - protein, 173 aa, Panicum virgatum
  misc_feature: Ceres CLONE 1795124
  misc_feature (92)..(139): Pfam Name: F-box Pfam Description: F-box domain
MGEVAALRQLVGQVQELWDLYGANAHPLPRWYLLDFEHGSIKDDYCGGRTGYNSELLKIMETNQSPPRKRPRRDRNREKAPCSNTTEVMQQEIWKEFPEDLFETVIARLPVAAIFRFRTVCRKWSSLLGSDSFSHQYSEAPHGLPWFYTITHENANNNVAMYDPSLKKWHHPS

SEQ ID NO: 17916 - DNA, 367 bp, Panicum virgatum
  misc_feature: Ceres CLONE 1795124-R
cttcttcagccaagcacattgaaattttagcaatttcatatcattggccaatctttagatatttgtatgttgttgtgacaagtctctgtgttgcacacaaatccatggcactgtggtttgttttgtatcacgctcaagcaagcgaactgtttccttttatcacctatcagaatttgggtcgggaagctacgatgtcaactgggcaggctgacctaaatatgttaaaggttattgttgttgaaattggaatagtcatggattttgtatgtttggttatcatctcgttaagtttgtaatgtttctggatgtgcagtcatctgcccagaactgagtttatatacaataataaccgggatattaatgtttt

SEQ ID NO: 17917 - DNA, 3488 bp, Panicum virgatum
  misc_feature: Ceres CLONE 1795128
  misc_feature: Encodes the peptide sequence at SEQ ID NO. 17918
acagccgttgcccaccacccagagcacgcggcggcttgtcgccgtggcgcgccaccaccaccacacgaagtcgccggagagaagccatccagcgtgcgccacggccatggcgcctcacgcctcggcggccgccaccccctcactgcgctttccccaccctccgtctgccaccggcctcgcctcgcctctcgctgggggctgcggcgggtttcgggtccggttccaccccagccggcggggctggggtatgcaggggcgccgggatgctggctcccacgtgccgcgcgtggggagttttctgggcggcgtattcggcggcggtggccgcgacgacggggaggcgacgcggaagaagtacgccgacaccgtggcgcgcatcaacgccatggagcccgaggtctccgcgctttccgacgccgacctgcgagcgcgcactgccgcgctccaggagcgggcgcgcgccggagagtcccttgactccctcctccccgaagcatttgctgttgtgagggaggcttccaagagagttctaggccttcgtccttttgatgttcagttgattggtggcatggttcttcacaagggggagattgcagaaatgaagacgggagaggggaagacgcttgtggctattctgccagcatacttaaatgctttgagtgggaagggagtgcatgttgtcactgtaaatgattatcttgcaagacgtgattgtaagtgggttggtcaagttccccgatttctaggactgcaggttggcttaattcaacagaacatgacacctgagcagaggagggaaaattattcatgtgatattacttacgtcacaaacagtgagcttggctttgattatctaagagataaccttgcaatgactgtagatgagcttgtcttgaggaacttcaattactgtgtgatagatgaagttgattcaattcttatcgatgaagcaagaaccccacttataatatcaggtctagctgaaaagccaagtgatcggtattacaaagcggcaaagatagctgaagcttttgagcgagacattcattacactgttgatgaaaagcagagaaacgttttacttacagagcaaggctatgctgacgctgaagaaatactggacataaatgatctatacgatcctcgtgaacagtgggcttcatacgttctaaatgcaatcaaagctaaggagctttttcttaaagatgtcaattacatagttcgtagcaaggaagtgcttattgtggatgagttcactggcagagttatggcgggtaggcgatggagtgacggtctccatcaagcaattgaagcaaaagaaggtgtacctatacaaaatgaaacaataactctggcatcaataagttaccaaaacttctttcttcagtttcccaaactctgtggcatgactggaactgcagctacagagagccaggagttcgagagcatctataaactaaaagttactgtcgttccaacaaacaagccaatgatacggaaggacgactcagatgttgtttttagagcaacaaatggaaaatggcgtgctgttcttgtggagatatcgagaatgaataaagttgggcgtcctgtgcttgttggtaccactagtgttgagcaaagtgaatctttatcggaacaattgcgtgaagctgggattcctcatgaggtcctgaatgctaagccagagaatgttgagagggaggcagagatcgtcgctcagagtggacgccttggtgctgtgacaattgccaccaacatggcaggacgtggaactgatattatccttggtggcaatgcagaattcatggccaggttgaagttgcgtgagatccttatgccaagagttgtcaatccaatagatggtgtcattgtatcaaagaagcagatgccaccaagaaagacatggaagacaaacgaaagcttgttcccatgtgaactttcaaaagaaacattatcatctgtcaaagatgctgttgaagtggctgtcaaagaatggggagagaaatcattatctgaactggaagcagaagagcggttgtcctactcatgtgagaagggaccaacacgtgatgacataatagcaaatttgagaaatgcatttatgaagatagcagatgaatataaagtctacacagaggaggaaaagaagaaggtcattacagcaggtgggcttcatgtagtagggacagagcgccatgaatcacgcagaattgacaatcagctccgaggtcgaagtggcaggcaaggagatcctggaagctctcgcttctttcttagtcttgaggataatatctttcggatctttggaggtgacaggatacagggtctgatgcaagccttcagagttgaggatcttcctattgaatcaaaaatgttaacaagggccctagatgaagctcagaggaaagttgagaactacttttttgacatcaggaagcaattatttgagtatgacgaggtcttgaatagccagagagatcgtgtatatgcagaaagaagacgtgcccttgcttctgatagtcttgagtcgcttattgtggaatatgctgaattaacaatggacgacatattagaggcaaatataggccctgatactccaaaggaaaactgggacctcagcaagcttatagctaagctacagcagtattgctatcttttggatgacttgacaccagaattgttggagagcaaaacttcaagctatgaggatttgcgggagtatcttcataagcgaggacgtgaagcatacttccaaaaagctgaaattgtggagaagcaagctcctggcttaatgaaagaagctgagcgcttcctaattttaagcaatattgataggctctggaaagaacacctgcaggcactaaagtttgtgcaacaagctgttggtttaaggggttatgcccaacgagatccccttattgagtacaaacttgagggatacaacctcttcttggatatgatggctcaaatccggagaaatgttatttattcagtatatcagttcaaaccagtggtgaagaaccaagaagaggaaaaaacccagaataagggttccaaaaagaaagtggacaaaggtgctaataaacttggtgctgcccaagctgcgtcatgatcgacctgtgagaaatgttgcgttgtgcaaagttgcacttcatggtggcaatctccatgtgtataccctcccttacactgtatcaccctatgtgatgattgacatttcagtgcaggagaaatgtgaagagcaattcatgatacaaatgagatgtggtggcttctactgggacacagcttcaatatgtagctttttacttgaattgtgggtcctgcaggcaaattttgcacggcaaccgagcacactgttcctagtatgaatagcatcacaatttagtagttgtacataaatagaatttgccgtaggaagagtttttgttcctgtatccacggttttgtataatactataatgttgtaatccattcttgctggc

SEQ ID NO: 17918 - protein, 1002 aa, Panicum virgatum
  misc_feature: Ceres CLONE 1795128
  misc_feature (65)..(446): Pfam Name: SecA_DEAD Pfam Description: SecA DEAD-like domain
  misc_feature (752)..(969): Pfam Name: SecA_SW Pfam Description: SecA Wing and Scaffold domain
  misc_feature (291)..(402): Pfam Name: SecA_PP_bind Pfam Description: SecA preprotein cross-linking domain
MAPHASAAATPSLRFPHPPSATGLASPLAGGCGGFRVRFHPSRRGWGMQGRRDAGSHVPRVGSFLGGVFGGGGRDDGEATRKKYADTVARINAMEPEVSALSDADLRARTAALQERARAGESLDSLLPEAFAVVREASKRVLGLRPFDVQLIGGMVLHKGEIAEMKTGEGKTLVAILPAYLNALSGKGVHVVTVNDYLARRDCKWVGQVPRFLGLQVGLIQQNMTPEQRRENYSCDITYVTNSELGFDYLRDNLAMTVDELVLRNFNYCVIDEVDSILIDEARTPLIISGLAEKPSDRYYKAAKIAEAFERDIHYTVDEKQRNVLLTEQGYADAEEILDINDLYDPREQWASYVLNAIKAKELFLKDVNYIVRSKEVLIVDEFTGRVMAGRRWSDGLHQAIEAKEGVPIQNETITLASISYQNFFLQFPKLCGMTGTAATESQEFESIYKLKVTVVPTNKPMIRKDDSDVVFRATNGKWRAVLVEISRMNKVGRPVLVGTTSVEQSESLSEQLREAGIPHEVLNAKPENVEREAEIVAQSGRLGAVTIATNMAGRGTDIILGGNAEFMARLKLREILMPRVVNPIDGVIVSKKQMPPRKTWKTNESLFPCELSKETLSSVKDAVEVAVKEWGEKSLSELEAEERLSYSCEKGPTRDDIIANLRNAFMKIADEYKVYTEEEKKKVITAGGLHVVGTERHESRRIDNQLRGRSGRQGDPGSSRFFLSLEDNIFRIFGGDRIQGLMQAFRVEDLPIESKMLTRALDEAQRKVENYFFDIRKQLFEYDEVLNSQRDRVYAERRRALASDSLESLIVEYAELTMDDILEANIGPDTPKENWDLSKLIAKLQQYCYLLDDLTPELLESKTSSYEDLREYLHKRGREAYFQKAEIVEKQAPGLMKEAERFLILSNIDRLWKEHLQALKFVQQAVGLRGYAQRDPLIEYKLEGYNLFLDMMAQIRRNVIYSVYQFKPVVKNQEEEKTQNKGSKKKVDKGANKLGAAQAAS

SEQ ID NO: 17919 - DNA, 2112 bp, Panicum virgatum
  misc_feature: Ceres CLONE 1795144
  misc_feature: Encodes the peptide sequence at SEQ ID NO. 17920
atttgctttgcttgcgaacccttatttaaaagccccaccgctcctctcctcccatctgcagcagcagcactgcggcggaggaggtgagacgacgaccggattcccttcccttccggttgcagcagatcgggctcggagctccaggcctggtgccgcaactgtcttcttttcagaatcatcctccacccatggcggacgacgagcatgaaccattggtgcgccgcaagaggaagacggttttggtggactacttggtgcagttccgatggatcctcgttatcttcgtggtccttccggtttcggctctcatctacttcaatatctatctgggcgacatgtggtctgccatgaagtcagagaagaagcgccagaagcaacatgaagagaatgtgcagaaggtcgtgaagcggctcaagcagaggaacccaaagaaggatggtcttgtttgcacggccaggaagccctggattgctgttggcatgcgcaatgtggactacaagcgtgccaggcattttgaggtcgacctttctgccttcaggaacatcctggagattgacaaggagaggatggttgctaaggttgagccccttgtgaacatgggtcagattaccagagctacttgccctatgaaccttgcccttgcagtcgttgcggagctcgacgacctcactgttggtgggctcatcaatggttatggtattgaggggagctctcacctctatgggcttttctctgacacggttgttgccatggaagttgtccttgcagatggcagggttgttagagccaccaaggataacgagtactctgaccttttctatggcattccctggtcccagggaacacttgggttccttgtctctgctgagatcaagctcattcccatcaaggaatacatgaagctcacatacactccggtcaaggggactctgaaggaaattgcgcaggcctatgctgattctttcgcaccaagagacggtgaccctgcaaaggtccctgactttgttgaaggaatggtgtacacagagagcgaggctgtgatgatgactggcgtttatgcttcgaaagaagaggcgaagatggagggcaacaagatcaacagcgtagggtggtggtttaagccttggttctaccagcatgctcagacggccctgaagaggggcgagtttgtggagtacatcccgacaagagagtactaccaccgccacacccgatgcttgtactgggaggggaagctgatcttgccgttcggcgaccagttctggttcaggttccttctgggttggctgatgccgccgaaggtgtctctgctgaaggcaacccagggtgaggctgtcaggaactactaccatgacagccatgtgatccaggacatgctggtgccgctgtacaaggttggcgatgcccttgagtttgtccaccgcgagatggaggtatatccgctgtggctgtgccctcaccggctgtacaagcttcctgtgaagaccatggtgtaccctgagcctgggttcgagcaccagcacaggcagggtgacacgagctacgcgcagatgttcacggacgtgggtgtgtactatgctcccgctgctgttctaaggggcgaggagttcaatggtgtggaagcggttcgccgactggagcagtggctgatcgagaaccacagctaccagccgcagtatgctgtgtcggagctgagcgagaaggacttctggagaatgtttgacgcgtcccactacgagaactgccgtcgcaagtacggagcagtggggacgttcatgagcgtgtactacaagtcgaagaaggggcggaagacggagaaggaggtgcaggaggcggaggcagccatcctggagccagcctatgccgacgaggcctaatcgtagccggcgatgaagcagcgtttggtttctggtgacttagatgcgggccgccacagcagcagagtttgctttgtttacctgatgggattggaacgagatgttgtgtctcggttcttgttctgcttgcttagaataacttgattctgtagtgtgtctgtctgtggtggtgagtcgttgccgttgtagcgattgtctgtttatcatttcttgtttatggaattgctgaactttt

SEQ ID NO: 17920 - protein, 562 aa, Panicum virgatum
  misc_feature: Ceres CLONE 1795144
  misc_feature (56)..(201): Pfam Name: FAD_binding_4 Pfam Description: FAD binding domain
  misc_feature: SWISSPROT Homolog: EC 1.1.3.8 L-gulonolactone oxidase
MADDEHEPLVRRKRKTVLVDYLVQFRWILVIFVVLPVSALIYFNIYLGDMWSAMKSEKKRQKQHEENVQKVVKRLKQRNPKKDGLVCTARKPWIAVGMRNVDYKRARHFEVDLSAFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYTPVKGTLKEIAQAYADSFAPRDGDPAKVPDFVEGMVYTESEAVMMTGVYASKEEAKMEGNKINSVGWWFKPWFYQHAQTALKRGEFVEYIPTREYYHRHTRCLYWEGKLILPFGDQFWFRFLLGWLMPPKVSLLKATQGEAVRNYYHDSHVIQDMLVPLYKVGDALEFVHREMEVYPLWLCPHRLYKLPVKTMVYPEPGFEHQHRQGDTSYAQMFTDVGVYYAPAAVLRGEEFNGVEAVRRLEQWLIENHSYQPQYAVSELSEKDFWRMFDASHYENCRRKYGAVGTFMSVYYKSKKGRKTEKEVQEAEAAILEPAYADEA

SEQ ID NO: 17921 - DNA, 2170 bp, Panicum virgatum
  misc_feature: Ceres CLONE 1795148
  misc_feature: Encodes the peptide sequence at SEQ ID NO. 17922
accacagctcaagcagcttctctttctctctctttctctccctctcctcgcctccccacgccgatctctcgaacgcttggggagacgagactctgcgatcttccgcctcgctcatcagagctcacgaagttctacgcatttttttcgctgtttaatccgcttgtttaattattccatcttcttcgcgttgttaatctgtgatcgattctaccctgctagtttacagttcgtgtttaatctaattgattctgctgttgctattactgttccgtgtcgtgcttgtcttgttcgtttgctgctgctaaccatggacgcaggttcccactcgatctcctccgagaagagccgcgccgccgccgcgccgccgccgccgctgcaggaggcgggctcccgcccctacatgccgtcgctgagctcgggatcgcgcaacccgtcggccaagtgctacggcgacaggttcatcccggatagatcggcgatggacatggacatggcgcactacctgctaacggagcctaggaaggataaggagaacgcggcgggtgtggcggcgtccccgtccaaggaggcgtaccggaggctgctcgcggagaagctgctcaacaaccggacgcggatcctcgccttcaggaacaagccgccggagcccgagaacgtctcctgcgccgaggcagcttccaacctgcaggccaagccggccaagcagcggcgccacattccccagtctgccgagcggactctggacgcaccagagctcgtcgatgactactacctcaacctgcttgactgggggagcaacaacgtgctgtccattgctttgggcgacacggtgtacctgtgggacgcatcgagcggatccacatctgagcttgtgaccgtcgacgaggacagcggtcctattactagcgttagctgggctcccgatggtcgacacattgctgttgggctcaactcgtctgacgttcagctctgggacaccagctccaaccgactgttgagaactcttaggggtgtgcatgaggcaagagtcggctcgctggcatggaacaacagcatcctaacgaccggcagcatggacggcaagatcgtgaacaatgacgtgaggatcaggaaccacgttgtgcagacgtatgaggggcacagccaggaggtgtgtggcctcaagtggtctggatcagggcagcagctggccagcgggggcaacgacaaccttctgcacatttgggatgtgtcaatggcatcctccatgccatctgctggccgcaaccagtggctgcacaggctcgaggaccacatggctgctgtgaaggcgctcgcctggtgcccattccagagcaacttgctggccactggcggcggtggcagcgatcggtgcatcaagttctgraacacacacactggtgcatgtctgaactccgttgacaccggatcacaggtgtgcgctcttctctggaacaagaatgagagagagctgctgagttcacacggattcacacagaaccaactgactttgtggaagtatccatcaatggtgaagatggctgaactcactggccatacttctcgtgtccttttcatggctcagagtcctgatggttgcacggtagcatcagctgctgcagatgagaccctccggttctggaacgtttttggagcccctgaagcgcccaaacctgcagccaaggcttctcacactgggatgttcaacagcttcaaccatatccgttaggagagtcatgaagaatttctcttctgttggatatggtcctgctgtcccagtgtcctagtttacatagatcgcttctcattgatgagatctacctaattggctaagcaggcggcgtgatgggaagcattgcaatctcctaatgcattattttttgctttcaggagggtcagaaattaatgacaaagggttggcttcattgacgtcttcatcaagaagctatctgcaaccatctatgatctatctgcaacaccacaggcgtacaaatgacaggaaaagtaacaaaacagctggttctctgaggctcaggtgctgttcaatgtagaatgtttttccccttttggatgcaacatgctagcatcaagagaatatgtttgatgtggcagcaattgtaaatcaagcacgaccattcttttcattatgtataatgaaatatttgtcctc

SEQ ID NO: 17922 - protein, 473 aa, Panicum virgatum
  misc_feature: Ceres CLONE 1795148
  misc_feature (269)..(307): Pfam Name: WD40 Pfam Description: WD domain, G-beta repeat
  misc_feature (408)..(446): Pfam Name: WD40 Pfam Description: WD domain, G-beta repeat
  misc_feature (185)..(223): Pfam Name: WD40 Pfam Description: WD domain, G-beta repeat
  misc_feature: SWISSPROT Homolog: EC 2.3.1.48 Histone acetyltransferase
  misc_feature: Functional homolog of the protein sequence given in SEQ ID NO 50293
  misc_feature: Useful for making plants with modulated biomass
  misc_feature (360)..(360): Xaa is any aa, unknown, or other
MDAGSHSISSEKSRAAAAPPPPLQEAGSRPYMPSLSSGSRNPSAKCYGDRFIPDRSAMDMDMAHYLLTEPRKDKENAAGVAASPSKEAYRRLLAEKLLNNRTRILAFRNKPPEPENVSCAEAASNLQAKPAKQRRHIPQSAERTLDAPELVDDYYLNLLDWGSNNVLSIALGDTVYLWDASSGSTSELVTVDEDSGPITSVSWAPDGRHIAVGLNSSDVQLWDTSSNRLLRTLRGVHEARVGSLAWNNSILTTGSMDGKIVNNDVRIRNHVVQTYEGHSQEVCGLKWSGSGQQLASGGNDNLLHIWDVSMASSMPSAGRNQWLHRLEDHMAAVKALAWCPFQSNLLATGGGGSDRCIKFXNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 17923 - DNA, 669 bp, Panicum virgatum
  misc_feature: Ceres CLONE 1795156
  misc_feature: Encodes the peptide sequence at SEQ ID NO. 17924
actcctcaccactctgcttgctccgctgctctgctccgccccaatcagtgagagctgccatccactgacccgccgcgagcgccaatggcggcggccgcggccctggcagcggccgtgctggcgctgtcatgcttcggcgcgcccgcgacggcggaggcggaggcggaccgcatcggcagcctgccggggcagccaccggtcaacttctccatgtactccgggtacgtcaccgtggacgcggccgcggggcgggcgctcttctactggctcatcgaggcggccggcgcgcctgcggagtccgcgccgctcgtgctctggctcaacggcgggcccgggtgctcctccgtcggctacggcgcgtccgaggagctcggcgccttccggatcaaccccgacggcaggtcgctctccaggaacccctacccctggaacaaagtggcgaacatgctgttcctggactcgccggccggcgtcggctactcctactccaacaccaccgccgatctgtacaccgccggtgacaacaagacagctcatgattcgtacaatttcttggtaaattggttggagcagtttccgcagtacaagcatcgcgatttctacatcacgggagagagctacgcaggtcactacgtgcctcagctgtctcagctagtgtaccgraacaac

SEQ ID NO: 17924 - protein, 194 aa, Panicum virgatum
  misc_feature: Ceres CLONE 1795156
  misc_feature (34)..(194): Pfam Name: Peptidase_S10 Pfam Description: Serine carboxypeptidase
  misc_feature: SWISSPROT Homolog: EC 3.4.16.6 Carboxypeptidase D
MAAAAALAAAVLALSCFGAPATAEAEADRIGSLPGQPPVNFSMYSGYVTVDAAAGRALFYWLIEAAGAPAESAPLVLWLNGGPGCSSVGYGASEELGAFRINPDGRSLSRNPYPWNKVANMLFLDSPAGVGYSYSNTTADLYTAGDNKTAHDSYNFLVNWLEQFPQYKHRDFYITGESYAGHYVPQLSQLVYRN

SEQ ID NO: 17925 - DNA, 645 bp, Panicum virgatum
  misc_feature: Ceres CLONE 1795156-R
  misc_feature: Encodes the peptide sequence at SEQ ID NO. 17926
aagacttcacttcacaagcgcaggttgataaaaggaagaatgccctggttgccgagaggatatgatccctgcaccgagaactacgcaacaaagtactataacttacctgaggtgcaggaagctttgcatgccaatgtcactggaataccatatgcctgggtagcctgcagtgatccaatttttgactattggaaagattcaccgaagtccatacttcctatttaccgtgaacttattgctgcaggcataaggatatgggtcttcagtggtgatgctgattctgttgtccccctaaccgcgacaagatactccatcgatgcgctctctctaccaaccgtcacaaactggtatccttggtacgacgatgaagaggttgctggatggtgccaagtttacaaaggtttgacgcttgtgacgatccgaggtgcggggcacgaggttcccctccaccgtccgcggcaaggcctgaagctcttcgagcactttctgcgcgacgagcccatgcccaagcctgtagatagcattcagacgttttagaatttgctatctcgcttgtcggagaagaacaggatgcgccaagccatcttgttgtaaaatatctactgccacattttcaggggaacgtatttcgcctgtgaaaaaatc

SEQ ID NO: 17926 - protein, 178 aa, Panicum virgatum
  misc_feature: Ceres CLONE 1795156-R
  misc_feature (1)..(165): Pfam Name: Peptidase_S10 Pfam Description: Serine carboxypeptidase
  misc_feature: SWISSPROT Homolog: EC 3.4.16.6 Carboxypeptidase D
KTSLHKRRLIKGRMPWLPRGYDPCTENYATKYYNLPEVQEALHANVTGIPYAWVACSDPIFDYWKDSPKSILPIYRELIAAGIRIWVFSGDADSVVPLTATRYSIDALSLPTVTNWYPWYDDEEVAGWCQVYKGLTLVTIRGAGHEVPLHRPRQGLKLFEHFLRDEPMPKPVDSIQTF

SEQ ID NO: 17927 - DNA, 2221 bp, Panicum virgatum
  misc_feature: Ceres CLONE 1795164
  misc_feature: Encodes the peptide sequence at SEQ ID NO. 17928
aaattacaccgaaccatttcttcgtctcggcttctcctccccaaatcgagccatccaccgctcttcctcccctcctctcgccgccgcccggatccggctgcgcctcccctagttccttcggaccagcggtgagccggcggaggtagcgagcgctgtggcggcggcggtagggttgcggtgcgggaattgatccgggggaagaagaggcgccggcagcggtggcgcctggcatggcaggggcgcccggggtggggcctggcgcgggcgcggggggcggaggcggaggcggcgccgcggcggggctcaagacctacttcaaaacccccgaggggaggtacaagctgcagtacgagaagacgcaatccgccgtcctgcactacagccacggcggcaagaccgtctcgcagttgacggtggcatacctcaaggagaagcctcctagccagggctctcagccatcaacaccaagctccagcagtgggatgcgatctgcggcagcaaggttgctgggcagtgggaatggtagcaaggcacttagctttggtgggggaaacggtgcaaaccgggctgttgctggaagcagccgtttaggaggaggcctcggtacatctgcgaaccttggtggatcacacggggtgacaaattatgatggcaagggtatatacattgtcttcaatgctgctgatacactattcattagtgatctcaattcacaggagaaggatccaataaagtccatccatttcagtaactcaaacccactgtgccatgcattcgatccagaggccaaagaggggcatgacctgatcattgggatgggatcaggggatgtctattcaatgtcgctgaggcaacagctacaagatcctggaagaaagcctgtggcagctcaacattataataagggtgataaagacggctcctccaatggcagtcggtgtacatctgttgcgtgggtgccagagcgcgaaggcattttcatcgttagccattctgatggaaatttgtatgtttatgataaaaacaaggatggaaacacagactgtacatttccagctgtgaaggatcaatcccagtttatggttgtacatgcaaagtctagtaagagcaacccagttgctagatggcatatctgtcaaggttcgatcaatgcaatttccttttcacccgatggcgcatacctggcgactgttgggagagatggctatttgagagtttttgatttttcaaaggaacaactgatatttggtggaagaagttattatggtgcattgctgtgttgcacttggagctcagatggaaaatatctattaacaggtggtgaagatgatcttgtgcaggtatggagcatggatgacagaaagatcgttgcatggggtgaaggacataattcctgggttagtggagttgcttttgattcatattggtccccaccaagttctgatggaaatggagaaaatgtctatcgctttggttctgttggtcaggacacccaactgcttctgtgggacctggcgcttgatgagattgttgtcccactacgtcatccttcaagtgcctccccgacatttagcggtgggagtccttctgcacattgggacaacgcttgccttccaacaggtgttctccagccttctccaagaatgcgagatgttccgaagctctcaccccttgttgctcaccgagtacatgccgatcccctctctggtctggtgttcactaatgaatcaatcctcaccatctgtcgcgagggcctcatcaaaatctgggccagaccggaccagagtgaaaacaaccagcaatcaaattcttctgaattcgttttaggcagccctgttcctaaggatagggtgatcgcatcttctaataaatcagggggctccagcttcaagaaaccatcgtctgttcttgtcacatgactgagccgacaggatgttccttgtgggtattttccgacaggatgttcattgtgggcgttttcctctgcttaccccttggtcattgatggtcatatttcttactggcaccgtgtttgagggagaaactgaagttctcaaaagaaggctgcggttggaggaaagcatttgttcatagatgttcccgggcttacaaaaatgctagcgttgccagatgtgtggcacaaaagaataatggaatatgctcttgtacagatacatatacttaatgataaaattgtataaatttattttgtgttccatat

SEQ ID NO: 17928 - protein, 562 aa, Panicum virgatum
  misc_feature: Ceres CLONE 1795164
  misc_feature (293)..(331): Pfam Name: WD40 Pfam Description: WD domain, G-beta repeat
  misc_feature (335)..(373): Pfam Name: WD40 Pfam Description: WD domain, G-beta repeat
MAGAPGVGPGAGAGGGGGGGAAAGLKTYFKTPEGRYKLQYEKTQSAVLHYSHGGKTVSQLTVAYLKEKPPSQGSQPSTPSSSSGMRSAAARLLGSGNGSKALSFGGGNGANRAVAGSSRLGGGLGTSANLGGSHGVTNYDGKGIYIVFNAADTLFISDLNSQEKDPIKSIHFSNSNPLCHAFDPEAKEGHDLIIGMGSGDVYSMSLRQQLQDPGRKPVAAQHYNKGDKDGSSNGSRCTSVAWVPEREGIFIVSHSDGNLYVYDKNKDGNTDCTFPAVKDQSQFMVVHAKSSKSNPVARWHICQGSINAISFSPDGAYLATVGRDGYLRVFDFSKEQLIFGGRSYYGALLCCTWSSDGKYLLTGGEDDLVQVWSMDDRKIVAWGEGHNSWVSGVAFDSYWSPPSSDGNGENVYRFGSVGQDTQLLLWDLALDEIVVPLRHPSSASPTFSGGSPSAHWDNACLPTGVLQPSPRMRDVPKLSPLVAHRVHADPLSGLVFTNESILTICREGLIKIWARPDQSENNQQSNSSEFVLGSPVPKDRVIASSNKSGGSSFKKPSSVLVT

SEQ ID NO: 17929 - DNA, 2188 bp, Panicum virgatum
  misc_feature: Ceres CLONE 1795187
  misc_feature: Encodes the peptide sequence at SEQ ID NO. 17930
agagatcccatccaactactccgcccgccgtctccctcctctgcgcccgccgcttcggtcccgcccgcttcgctttgctcggcgcaggttgccttccgactcttttttttttcctttcccccctcccctttcttcctactccgtctccgggttcggctggatccaaatgggcgcctgcgtgtccagggtcaccgtctgctgctgccgcacgccgcgcaacggcgtaaccaacgactacactgatgctgtgacggaggagcagggggaggcatacgagctaccggtcttccaggagttcacctttgagcagttgcgcctcgctacgtcagggttcgccgtcgagaacatcgtgtctgagcacggcgagaaggcgcccaatgtggtatacaaggggaagctcgatgcccagcgccgcatcgccgtcaagcgcttcaaccgctctgcctggcctgacccacgccagttcctggaagaagctagatcagttggccagatccagagcaaaagattggcaaatttgcttggttgttgctgtgaaggtgatgagagattgcttgttgcagagtacatgcccaatgacacgctagccaaacatcttttccattgggaatcacaagcaatgaaatggcccatgagattaagggttgttctctatcttgccgaggctttagaatactgcaccagcaggggtcgtgcgctctaccatgatctcaatgcctacagagttctgtttgatgatgactgtaatcctagactttcctgttttggcctcatgaagaacagtcgggatgggaaaagttacagtacgaatttagcctttacacctccagaatacatgaggactggacgaatcactcctgaaagtgtcatatacagcttcgggaccatgctattggatgttcttagtgggaagcatattcctcctagccatgcccttgacctgattcgagatcggaactttaatatgcttacagactcgtgtttggagggtcaattttcgaatgaggaaggaacggaactggtgcggttagcttcaaggtgccttcactatgaaccacgcgagcgacctaacgtaagatcacttgtgcaatcattggctcctcttcagaaggatgttgagactccgtcttatgaactgatggacattccacgtggcggtgtatcatctatccaatcattacctctttcccctctcgccgaagcctgttccagaaaggatctgacagcaatacatgaaattctagaaaagacaggctacaaggatgacgaggggacagcaaatgagctctcgtttcaaatgtggacaaatcaaatgcaagatactttgaactcaaagaagaagggcgacaatgcttttcgtcaaaaggattttactacagccattgattgttattcccagttcattgaagttggcacaatggtttcaccaaccatttatgctcggcgctgcctgtcatatctgatgaatgacatgccacaagaagcattgagtgatgcaatgcaggctctagtaatatctccaacatggccaacagcattctatcttcaggcagcagcattactagcacaaggcatagagaatgaagctcaagaagcactaaaagatggttgtaacctagagcaaagtagcagcagtgggcattgagtgcgaacagatttgtagtcacaaaatgcacataattttcaggtgcttgtttgaacagagtattattggatatggaagcaggtgttggtgatttgtcaattcggctaggggttggttaaccttgttcagattttgtgcgtttggaacgtcgtccctcccatatcttcatgtaggatgatgtatatatggaagaaagcgacaacagagaggccctgaaagagatggcaaagacattcaaaggtgaataagtaccgcagacaggaaattaatggagaaagggaaactttttcttggttcgtccagccgaaaaaggaaacccaaggaaaacgtcaaaaaaggggttgctcatgtacatgtccatcgtgctggtagtgggtgtgtaaacctgtacagcgagcgttgtttttctttcgtctttgtttcatatgtgttagctcccattggtatatttttggcgaagatggtggaattctttgcagaggcgaaaaattgcagtgttcgatgggctgttccatttatgaatctccgacgcattcatccctg

SEQ ID NO: 17930 - protein, 492 aa, Panicum virgatum
  misc_feature: Ceres CLONE 1795187
  misc_feature (72)..(310): Pfam Name: Pkinase_Tyr Pfam Description: Protein tyrosine kinase
  misc_feature: SWISSPROT Homolog: EC 2.7.11.1 Non-specific serine/threonine protein kinase
MGACVSRVTVCCCRTPRNGVTNDYTDAVTEEQGEAYELPVFQEFTFEQLRLATSGFAVENIVSEHGEKAPNVVYKGKLDAQRRIAVKRFNRSAWPDPRQFLEEARSVGQIQSKRLANLLGCCCEGDERLLVAEYMPNDTLAKHLFHWESQAMKWPMRLRVVLYLAEALEYCTSRGRALYHDLNAYRVLFDDDCNPRLSCFGLMKNSRDGKSYSTNLAFTPPEYMRTGRITPESVIYSFGTMLLDVLSGKHIPPSHALDLIRDRNFNMLTDSCLEGQFSNEEGTELVRLASRCLHYEPRERPNVRSLVQSLAPLQKDVETPSYELMDIPRGGVSSIQSLPLSPLAEACSRKDLTAIHEILEKTGYKDDEGTANELSFQMWTNQMQDTLNSKKKGDNAFRQKDFTTAIDCYSQFIEVGTMVSPTIYARRCLSYLMNDMPQEALSDAMQALVISPTWPTAFYLQAAALLAQGIENEAQEALKDGCNLEQSSSSGH

SEQ ID NO: 17931 - DNA, 1579 bp, Panicum virgatum
  misc_feature: Ceres CLONE 1795199
  misc_feature: Encodes the peptide sequence at SEQ ID NO. 17932
ggtcggctcttcatttctttccactcttcccgctgacacaccagggcgctccccgccgcgccgcgcatgccaatggccgccgccgccgccgccgccgctttctcctcatcccgtatctctccctctatctcaacccgtatccgccggagacgccccgcgccgcgcgcctccgcaggcggcgtcacggcgcgcgcccggcggctgcgctgcgacttcgtcgccggcggagggaacggagctctctccggagaggacgaccctcgcctcatcgaccgacaaaaagctcttgatgcagccatgagtgacataaacaactcttttggaaaaggaagcgttacaagattaggcagtgccggtggtgcttttgttgagacgtttccaagtggttgtctaacactagattttactctgggtggtggccttccaaaaggaagagtagtggaggtatatggtccagaaagcagtggaaaaacaaccctagctctgcatgcaattgctgaagtacagaagttaggaggaaatgccatgcttgtcgatgcagagcatgcttttgaccctacttattcaaaagctcttggggtagatattgaaaatctgattgtctgccaacctgacaatggagagatggcactagaaattgcggaccgtatgtgcagatctggagcaatagatctcatctgtattgattcagtgtcagcgctcactccacgggcagaaattgaaggtgagataggaatgcagcagatgggtctacaagctcgtctgatgagtcaagcgttgcgaaagatgtcaggcaatgcctcaaaggctggctgtactcttatattcttgaatcaaataagatacaagattggagtattctatggcaatcctgaagtcactagtggagggatagctttgaaattttttgcatctgttcgccttgagatacggcccattgggaagataaaatctgccaagggagatgaagacattggtgtgaaggttcgtgtcagagtgcagaaaagcaaagtctctaggccctacaagcaagctgaattcgaaatcatttttggggagggtgttagtaaattggggtgtgttcttgattgtgctgagctgatggaagtagttgcaaagaaaggttcatggtacagctacaaagatgtaagactgggccaaggcagggaaaaggcactacagtatctccgagagaacccaaccatcagtgatgagatagaaaaggtggttagagctatgataccagaaggaaccagacatatgagcctactagcttttgggcagtcatcatcaagtgaagacgaacaagtgtatgatgagcaatagccaatagcagtgcatgaggttctgaagatgaacaactgtgaagccatcgggcaccacaattctgggcttttgtccctatgcgatggcggaaaagaccagaggtgatcaaacagcgtgcggtggtgcatgcactgttgtaggggagtttggctgatgagttgtgccatcactgagaatgatataactcgtgggggcatttagtgtatgacgaaggaactgatatttcaaattaatgaagctaatttctatttgc

SEQ ID NO: 17932 - protein, 342 aa, Panicum virgatum
  misc_feature: Ceres CLONE 1795199
  misc_feature (1)..(317): Pfam Name: RecA Pfam Description: recA bacterial DNA recombination protein
MSDINNSFGKGSVTRLGSAGGAFVETFPSGCLTLDFTLGGGLPKGRVVEVYGPESSGKTTLALHAIAEVQKLGGNAMLVDAEHAFDPTYSKALGVDIENLIVCQPDNGEMALEIADRMCRSGAIDLICIDSVSALTPRAEIEGEIGMQQMGLQARLMSQALRKMSGNASKAGCTLIFLNQIRYKIGVFYGNPEVTSGGIALKFFASVRLEIRPIGKIKSAKGDEDIGVKVRVRVQKSKVSRPYKQAEFEIIFGEGVSKLGCVLDCAELMEVVAKKGSWYSYKDVRLGQGREKALQYLRENPTISDEIEKVVRAMIPEGTRHMSLLAFGQSSSSEDEQVYDEQ

SEQ ID NO: 17933 - DNA, 1557 bp, Panicum virgatum
  misc_feature: Ceres CLONE 1795202
  misc_feature: Encodes the peptide sequence at SEQ ID NO. 17934
gggaggaagccacagggccgctgcccgcagcagccccactcgccattcttgccgagccgagtccacggctccggccgcgccgaggcggcgccccccttcggttctcgcctcgggagtcgcggattggtagaggaagcgaggagattcgagcggcgcggccatggacacgaccaccagggccgccaagatcccgtcgctccaccagacggagatcaactgggacaacctcgacaagaccaagctctacgtggtgggcgctggcatgttcagcggcgtcactgtggcgctgtacccggtctcggtggtaaagacccggatgcaggtggcctctggggacgccttgaggaggaacgcgttggctaccttcaagaacatcctcaaggtggacggtgtgccagggctgtaccgaggttttcttactgttatcatcggggctgtcccaactaggatcatcttcctcacggcgcttgagacaaccaaagcagcctcgctcaagcttgttgagcccttcaagctgtcagagccggtgcaggccgcctttgccaatggccttgctggtctgtcagcgtcaacatgttcacaggctatttttgttccgattgatgtgataagccagaaattgatggttcaaggatattctggtaacgccaggtataaaggtggaatagatgttgctcgaaaggtcataaaggctgatgggattagggggctgtacagaggatttgggttgtctgttatgacctacgcaccatctagtgctgtgtggtgggcgagttatggatccagtcagcgcataatttggagtgctcttggccattggaaaaacaaagaagaggctcctagccaaatgaaaatagttggtgttcaagcgtcaggtggagttattgctggtgcagtgacctcttttgttacaactcccatagatacaatcaagaccaggctgcaggtaatggataacgaaaataagccaaaagctgggcaagtagttaaaagattgattgctgaagatggatggaaaggtttgtacagagggttaggtccaagatttttcagttcatcagcttggggtacctcgatgatagtatgctacgaatatctgaagcgcttgtgtgctaaagatgaagaggtctgacttctgagtcgccttaaaaccaatgcaatttctacaatgctggaagttttgtattagcagaagtgaaataatgctatacgtcaacaacagtgacaccctactgaagctccagttcttgctgacataggcgaaagcattaagcatggatgtttgacggtgttaaagacttaatttgatgctagacaatagtccatacaaaactttggttctctgggcagtattttcgaaaatacaggggcccttattttttttgcccgcttatgttgaatatggattaggaagattattttagatggacatataaaagagatcagatgtacacacttctcattctttgaaacatcaaggcttgctatggcgctggatgatagagaccagttgtaattgacatggagcgatgtttccaaaagatgctcgttttgact

SEQ ID NO: 17934 - protein, 323 aa, Panicum virgatum
  misc_feature: Ceres CLONE 1795202
  misc_feature (232)..(321): Pfam Name: Mito_carr Pfam Description: Mitochondrial carrier protein
  misc_feature (125)..(217): Pfam Name: Mito_carr Pfam Description: Mitochondrial carrier protein
  misc_feature (27)..(114): Pfam Name: Mito_carr Pfam Description: Mitochondrial carrier protein
MDTTTRAAKIPSLHQTEINWDNLDKTKLYVVGAGMFSGVTVALYPVSVVKTRMQVASGDALRRNALATFKNILKVDGVPGLYRGFLTVIIGAVPTRIIFLTALETTKAASLKLVEPFKLSEPVQAAFANGLAGLSASTCSQAIFVPIDVISQKLMVQGYSGNARYKGGIDVARKVIKADGIRGLYRGFGLSVMTYAPSSAVWWASYGSSQRIIWSALGHWKNKEEAPSQMKIVGVQASGGVIAGAVTSFVTTPIDTIKTRLQVMDNENKPKAGQVVKRLIAEDGWKGLYRGLGPRFFSSSAWGTSMIVCYEYLKRLCAKDEEV

SEQ ID NO: 17935 - DNA, 2000 bp, Panicum virgatum
  misc_feature: Ceres CLONE 1795209
  misc_feature: Encodes the peptide sequence at SEQ ID NO. 17936
agggaactccatctcacccactccatctcaggggcagtccagtgactccacgaggctccaccgcccgcccccgtgtgcctccgccccacgtcgcgccgccgcccgcccccttcggccttcgactcccgcggcccctgctggcctgctctggtggcctttaggtggggcgcgcgcctcccgctggttgccggcactccgcgcgcccgcgccctaagcccctgaccccgccgttgcgacgcacctccgcccgcagccccgcacccggtgccggtggccaccggcctgcggccgccgcccggctgccccgacgcgctgcaggctcgtccccgccgcgtgcaccgggaataacaacggggcaaaatgactgggcaaaatgaaaaataacaatggccggttggattaggacatcaacccgcaccgtaacacgctaacgcactactcccactcaactcaaatatatcttattacagtgaatgtggcagcagcaagcagcgacctcttgattttatatgcaacgtgctggttctttacatgcactcctgaatgcttgaacctggagtgattacataacttggtattcatcatataaatgacgggaagaagattggcagggcatggatatttgattcccagaaccctttacttcatacgatggcaggctatgtcatcattctcagccggccatggacgccgacccaagaagaagctatatcaccgtgagcctggtcttgacaaagccatggacctccaaaagaagcctgccctcctcattcgtctccgtgacctcattttggcacaaaggataggctcattacttgtacgtgaccttgaaaaggaggttggctttgtccaaaaatggaactttctttcacttatcgagcgtcatcccaatatcttccatgtctctggcggaagcgtttcccgagagcccattgctgtcacacttacagagaaggccaaaaagatatccagtgaagaggatcaagcacgagaggtaatggagccaatcttggtgaaaaacctaaggaagttactgatgatgtcgatggactgccagatccccctggagaagattgagttaatccaatctgaactgggattacctaagaacttcaagaacaacttgcttccaaggtatcctgattttttctcaatccgtgatgtgaagggattggaccatttgtgtctggagaattgggactcttcactagcagtcacagcgcgagaggaaaaattggattttgagggtttccaaataggctgtagagggattcctaaagatggaaatatctcgggtccttttgctttcaagttgaagtacccagcaggatttaggccaaatcggaagtaccttgaggaggttgtcaggtggcaaaagatggcatttccttcaccttatttgaacgctaggcgagttgagtctgcaacgcctcaggctcgaaagcgagctgttgctgtcctgcatgagattttgagcctgacaatggagaggcgattgacatctgataagctagacgtatttcacaatgagtacaggcttccatgcaagttacttctttgtttggtgaaaaatcatggcatcttctacatcactaacaagggagcaagaagcactgtcttcctcaaggaggcttatgagaacagtaatctcattgataagtgtcctttattgaaattccatgagcggtttgcatctttgattggccgaccatgctcgaactcagataatctggtagcaatataattggtggttgatttactggtcaggagacagcttatcaagcacatttgtgttagcaataatcctgtgtgtgcatgtacctgtccaggttcagacttcagagtgtccaggtgcagcctttagtgtaataagattttcagctagcagattagggaggataataggcaaccacagcagtaatggcggcagtaaccaggtggttaagtgagtccttattgtagcatgtatccagctatacattgcaagaaaaaacattcag

SEQ ID NO: 17936 - protein, 384 aa, Panicum virgatum
  misc_feature: Ceres CLONE 1795209
  misc_feature (89)..(370): Pfam Name: Peptidase_C12 Pfam Description: Ubiquitin carboxyl-terminal hydrolase, family 1
MTGRRLAGHGYLIPRTLYFIRWQAMSSFSAGHGRRPKKKLYHREPGLDKAMDLQKKPALLIRLRDLILAQRIGSLLVRDLEKEVGFVQKWNFLSLIERHPNIFHVSGGSVSREPIAVTLTEKAKKISSEEDQAREVMEPILVKNLRKLLMMSMDCQIPLEKIELIQSELGLPKNFKNNLLPRYPDFFSIRDVKGLDHLCLENWDSSLAVTAREEKLDFEGFQIGCRGIPKDGNISGPFAFKLKYPAGFRPNRKYLEEVVRWQKMAFPSPYLNARRVESATPQARKRAVAVLHEILSLTMERRLTSDKLDVFHNEYRLPCKLLLCLVKNHGIFYITNKGARSTVFLKEAYENSNLIDKCPLLKFHERFASLIGRPCSNSDNLVAI

SEQ ID NO: 17937 - DNA, 2118 bp, Panicum virgatum
  misc_feature: Ceres CLONE 1795226
  misc_feature: Encodes the peptide sequence at SEQ ID NO. 17938
cggtcgtgctagctcgggcgcccgatccgtcgctagggtttccaccgccgcctgcgatgggcgccctcaccgacagccgcaagcgcctcaccgccgaccaccgcctccccatcccctccttcccgccgccgtcccctccccctgcctccaagaggcccaagctcgcgcagctcccctcctccctggatccttccacctccgcctccccgccgcccaacccctctccccaaatcatccacgccgccgccgccgcgtccaccacgaccacgccggtcccttcctcctcctgcaaccccgcctcctccccactcccgaacaggcgccgcctcccgccgccaccgccattcaagcgcccgatccacggatcccagcgcgtcctccgcgccttccgcttcgacggaccttcacggccccacgccgcggggccgtcgtggtcctcgccatcctcgcccccggcgccccaaccccggtcgctcggactcgagcagtacgtcgagctcgtcaacagcgtctcccaccccgcaccgccgactcccaccgccatccccgatgcagtgcgggagaaagaggcggtgcccctcgaggtggtcgccgtcgaggaggacggagatgataggaagcagcaggacgacgaggaggaggtggtgagggtgtgcgtggtggtgaggagggtgccgctgtacaaggagctgtatgaggcgtccagccggaagcgggatgccaagctcaagacactcgagttcgaggtgaggctcgccgaggagggccgccttggccttgagcgcctcgcggaagtcctccctcggatttctcctaagaaggaggaggtgcctgaaccttttgttcctcttacggatgaggatgaagaaattgttcatgaggctcttcatggcagaaacagccgtgagagattagcagtacatgaaccttcaaacattgtgataacaagggagatcttgcagtgcttgaataaccaagaatggctaaatgatgaggttatcaatttgtatcttgatctgcttaaagcgagggaactaagacaacctagcaagtttttaagatgccatttcttcaacacctttttctacaagctgatttctggtggatatgactataaagctgttagaagatggacaacaaaaaggaagttagggtacagtctaattgagtgtgacaaggtacttttgggttctctttttaggtttatatcctactgtttgcatttaaccaaaacttgttataactgtgtccagatatttgttcccatacacaaggaagtccattggtgtttagcagtcatcaacataaaggacaaaaagtttcaatatctggattcacttggcagcatggacatgaaggtcttgaaaattttggccaggtattttgtggatgaggtgaaagacaaaagtggccaacacatcgatgccctttcatggaaacaggaaggtgtcaaaaaccttcctttgcaggagaatggatgggattgcggtatgttcatgctgaaatacatagacttctacagcggaaatatggaccttatttttggacagaagcacatgcggtacttccgcaagaggacagcaaaggaaattctgaatttgagggctgaataaatcatgggggacatcataggtcattaaggcctggttcggatatttatggttgtctgtggcatcggaaaggtatagtgctgaatccaaggatttccacagttgtctgatttctcagtggcaccatgcaatggtcaagcagcactgcagcagggtggagagccaggtaactacggcttcagattgaattcggcatgactgggatgctgtatggttctgctagggtggatggagtctttttggctgggttagattgcatttagttgagagacagggatgtatggcttacttgaattatatataatatgagcggacctcgagcagtgtgctgctataagcgagcaaatccacatttgtagggctgtatggctttgcagcagcgagttttgtgtaatgatccgtttctttttttttccttgaatttttttaatggtgcatatctgaattctgaaatggcagccctgccagttttctttatcaataaatgaggtcaagtgtaagtttcatt

SEQ ID NO: 17938 - protein, 518 aa, Panicum virgatum
  misc_feature: Ceres CLONE 1795226
  misc_feature (308)..(517): Pfam Name: Peptidase_C48 Pfam Description: Ulp1 protease family, C-terminal catalytic domain
MGALTDSRKRLTADHRLPIPSFPPPSPPPASKRPKLAQLPSSLDPSTSASPPPNPSPQIIHAAAAASTTTTPVPSSSCNPASSPLPNRRRLPPPPPFKRPIHGSQRVLRAFRFDGPSRPHAAGPSWSSPSSPPAPQPRSLGLEQYVELVNSVSHPAPPTPTAIPDAVREKEAVPLEVVAVEEDGDDRKQQDDEEEVVRVCVVVRRVPLYKELYEASSRKRDAKLKTLEFEVRLAEEGRLGLERLAEVLPRISPKKEEVPEPFVPLTDEDEEIVHEALHGRNSRERLAVHEPSNIVITREILQCLNNQEWLNDEVINLYLDLLKARELRQPSKFLRCHFFNTFFYKLISGGYDYKAVRRWTTKRKLGYSLIECDKVLLGSLFRFISYCLHLTKTCYNCVQIFVPIHKEVHWCLAVINIKDKKFQYLDSLGSMDMKVLKILARYFVDEVKDKSGQHIDALSWKQEGVKNLPLQENGWDCGMFMLKYIDFYSGNMDLIFGQKHMRYFRKRTAKEILNLRAE

SEQ ID NO: 17939 - DNA, 1999 bp, Panicum virgatum
  misc_feature: Ceres CLONE 1795229
  misc_feature: Encodes the peptide sequence at SEQ ID NO. 17940
atccgactctcgggagcctcgccgccgccgccgccgccgcggtcgcctccttgcgccatggcggagaagtcaccggcggccgacgtggaggccggactcctcgcccacctcaactccacgggcgaggtccccgactcccgctccttcgcctcttccctcggcgtatctcacctcgagcttgagggcgtcatcaagagtctctcagctttccgcatcgtcgacaccaccgacatcatcaaggaaacatgggtgctcaccgacgaggccaagggctatgccgccaggggatcccccgaggcgcagctcgtcgccgccatcccaccggagggcgcctccaaggatgcactcaaagcgaaattgggggatgccttcgatgtcagcatgaaggcagctgcgcggaacaaatggatagggtttgagaagggcaacaaggatttggtcctcaggaaggttgacaacgtcaaggatgagttgcaagagcagcttaaaaagctagagaaaggggaggttgttcctgataaagtgattgatgatttgaagagaaggaagcttattacgaaagagaaatcaatttggtactcactaaagaaagggcctgagtttgttgtaaagagaaaaactttggcaactgatgtgacaacagaacaccttaggagtggtgactggaaggaccttgaattcaaagactacaattatggagctcagggacaacctatagccaaaggttatgtgcagcctttgatggaggttcgtgaggcaatcgagaacatctttattatgatgggattcacagagatgccaaccaacaattttgttgaaagcaggtgtgtgtggtctaatatttgcacccaaccagaaacaaccatagctttctacgagatgatgttgtgctctaaaaaaagaaatgcagctcaatacgagccccattttatcagtaattgtgttccttaatgctgcatgtaatcgctgcttttttgctatagcttctggaatttcgatgcactgttccagccacaacagcatccttctcgggattcacatgacacctttttcctgaaaggtttttttttagatattgtacagtctcataatcaaagtttgcgtatattaatggtccatcaaatttttgcagcccctgcagcaacgagtcacttgcctgaggactatctagagaaagtaaagcaagttcatcagtttggtggttatggctctaaaggatatggttatgactggaagcgggatgaagcagagaaaaatcttcttcgtactcatacaactgctgtttccacgagaatgttatacaagcttgctcaagagaaaccttttgcccccaagagatattactccattgatcgagttttccgtaatgaagctgttgaccggactcatcttgctgaattccaccagatagaaggtcttatctgtgattatggtttgacgctaggtgatctcattggtgtattggaggatttcttctcgagcctaggtatgtcaaagctgcgtttcaagcctgcctataatccatatactgaaccgagcatggaaattttcagttaccatgacggtttaaagaaatgggtggaagttggtaattcaggcatgtttaggcctgagatgttgcttcccatgggattgccagaaggtgttaatgttattgcatggggtctttcacttgaaaggccaacaatgattctatatggaattgacaacattagggacctctttggaccaaaggttgatttcaacctcatcaagagcaacccactatgccggttgggtatctagtgcgctggacgctggcgatcctgaggacccccccccctcttttttttgttgtactgtgtactgttaagttttgacaggtggcccaaattgcaaaatgtaacaaattcgattgtatgaaattgttgaaggaagaagatggttatgtcgaaaatctatagttgtgcattgcaattctgaatgatattgctagcaaaagagatgttggtttatgttc

SEQ ID NO: 17940 - protein, 297 aa, Panicum virgatum
  misc_feature: Ceres CLONE 1795229
  misc_feature: SWISSPROT Homolog: EC 6.1.1.20 Phenylalanine--tRNA ligase
MAEKSPAADVEAGLLAHLNSTGEVPDSRSFASSLGVSHLELEGVIKSLSAFRIVDTTDIIKETWVLTDEAKGYAARGSPEAQLVAAIPPEGASKDALKAKLGDAFDVSMKAAARNKWIGFEKGNKDLVLRKVDNVKDELQEQLKKLEKGEVVPDKVIDDLKRRKLITKEKSIWYSLKKGPEFVVKRKTLATDVTTEHLRSGDWKDLEFKDYNYGAQGQPIAKGYVQPLMEVREAIENIFIMMGFTEMPTNNFVESRCVWSNICTQPETTIAFYEMMLCSKKRNAAQYEPHFISNCVP

SEQ ID NO: 17941 - DNA, 1746 bp, Panicum virgatum
  misc_feature: Ceres CLONE 1795237
  misc_feature: Encodes the peptide sequence at SEQ ID NO. 17942
agccgaccaccaccaaacccaccgcgggcacgcacccgtccgtttcgttccgcggattcgccaccgccgacgacgaactcgaccgaaaccctaattgtaggtggtaagtaagccatgaggccgcacgccacggggacgagcggcggcggcgtggggagacggaaagcgggggccgccgctgccgccgcgagccgagagtggatggtggtgcgggcgtcgggcccggcgagggtggaggaagccgggaagtacgcggtgatggcacggacggggcttcctgcgcgcgatctcagggtgctcgacccgttgctctcctacccgtccacgatcctgggccgtgagcgcgccatcgtcgtcaacctcgagcgcgtcaaggccgtgatcaccgccgccgaggtgctgcttccaaattctaaggaccccgccttcgcgcgcttcgtccgtgacctccagacccgcgtcctcgcatcctcttcggaccaggctgcagatctcaccgacatggagggtgaatcatcagctgttgcttcaccatttcctggtccgaattcatccaaaggacacgaattggagatgactaagaagtctactattgtagtgccagaaatgacaagcagcaccagtatgcctaatttggctgctgcaaaagacggatatgccaaggttttaccttttgaattccgagcacttgaagtttgccttgagtcagcctgcagatctttggaagaggaaacttctactctggagcaagaggcatatccagcattagatgagctgacatcgaagatcagtacattaaaccttgagcgagttaggcaaatcaagagccgcctggtggcgatatctggtcgtgtacagaaggtgagggatgagcttgagcatttgctggatgatgaaatggatatggctgaaatgtacttgacagaaaagcttactcaacaagaaatcagtgaggcttcatctagagttgaggttgatgatccatctcagactgaggaggacagggctgaagattatagaagtgagccagatggaagcaatggtagctttattggttataagcctaacattgaagaactggaaatgcttcttgaggcttactttgtgcagattgatggcacacttaacaagctatcacatctgagggagtatgttgacgacacagaagattatatcaacataatgttggatgacaagcagaatcagcttctacagatgggggttatgctctcgactgcaactgtcgtcattactgctggagtggctgttgttggactttttgggatgaatattggcatatcactttacgacgatccaacaactgaggaggagaaaagggcggcaaacatgaaattctgggagaccactttggggaccgttgctggctgtatgattttgtacattgtagccatgggttgggggaagagaagtgggttgctgcaatgatggcagaagcgttcatcttgacttcacccaaagaaaactagattgacaaagttctccaatagcgagattggcatgcagctcggtacataatcggggcaaacatcttctgtactgctagtaaacgggtaatgggagcaacagaaaactgttgtaaatttgctgctgcacagttgacgcggcaactcagttattttgtctcgcacctggtgtgcgactgtttaccatactagtgcggtttctgcacttgctattgtaatcgtttctggagcagttgtatatgtactgtacctagttacctgt

SEQ ID NO: 17942 - protein, 443 aa, Panicum virgatum
  misc_feature: Ceres CLONE 1795237
  misc_feature (24)..(442): Pfam Name: CorA Pfam Description: CorA-like Mg2+ transporter protein
MRPHATGTSGGGVGRRKAGAAAAAASREWMVVRASGPARVEEAGKYAVMARTGLPARDLRVLDPLLSYPSTILGRERAIVVNLERVKAVITAAEVLLPNSKDPAFARFVRDLQTRVLASSSDQAADLTDMEGESSAVASPFPGPNSSKGHELEMTKKSTIVVPEMTSSTSMPNLAAAKDGYAKVLPFEFRALEVCLESACRSLEEETSTLEQEAYPALDELTSKISTLNLERVRQIKSRLVAISGRVQKVRDELEHLLDDEMDMAEMYLTEKLTQQEISEASSRVEVDDPSQTEEDRAEDYRSEPDGSNGSFIGYKPNIEELEMLLEAYFVQIDGTLNKLSHLREYVDDTEDYINIMLDDKQNQLLQMGVMLSTATVVITAGVAVVGLFGMNIGISLYDDPTTEEEKRAANMKFWETTLGTVAGCMILYIVAMGWGKRSGLLQ

SEQ ID NO: 17943 - DNA, 752 bp, Panicum virgatum
  misc_feature: Ceres CLONE 1795239
  misc_feature: Encodes the peptide sequence at SEQ ID NO. 17944
acgagcaaggcagggaaggccgtcccaatcccctcaaaaccctagcgagcgagcagcaagggaagcggaggaggaaggcgatggatgcatccaaggcccgcgagctccgggagttcgtggaggcgtgcaagaaggacccttctctcctcgccgaccccaacctcgccttcttcagggactacctcgaaagtttgggagccaaaatccccgccgcctccgccgccaaggccgcctccgccgccaaggccgcctccttcgacaagcccaagagatcttccatggacgacattgatgatgatgatgacgacgatgatgatgaagatctggatatgagggatgccactcctgagccagacgagctcgatgaagagattgttgagtctgatcttgagcttgaaggagacactgtacaatctgaccatgatgacccaccacagaagatgggagatccttcagttgaggtaactgaggaaaatcgtgatgcctctcaagaagcaaaagggaaggctatggaggctatgtcagaaggaaaactcgatgaggctattgaacatcttaccaacgcaatagtgctgaatccgctctcagcaatcatgtatggtactagagcatctgtgtttataaaaatgaagaaaccagctgctgccattcgtgatgcaaatgctgctctagagattaacccagactccgcgaaaggatataaaacacgtggaatggcttatgccatgcttgggcaatgggagggagctgct

SEQ ID NO: 17944 - protein, 223 aa, Panicum virgatum
  misc_feature: Ceres CLONE 1795239
  misc_feature (170)..(203): Pfam Name: TPR_1 Pfam Description: Tetratricopeptide repeat
  misc_feature: SWISSPROT Homolog: EC 3.1.3.16 Phosphoprotein phosphatase
  misc_feature: Functional homolog of the protein sequence given in SEQ ID NO 50198
  misc_feature: Useful for making plants with altered terpenoid content
MDASKARELREFVEACKKDPSLLADPNLAFFRDYLESLGAKIPAASAAKAASAAKAASFDKPKRSSMDDIDDDDDDDDDEDLDMRDATPEPDELDEEIVESDLELEGDTVQSDHDDPPQKMGDPSVEVTEENRDASQEAKGKAMEAMSEGKLDEAIEHLTNAIVLNPLSAIMYGTRASVFIKMKKPAAAIRDANAALEINPDSAKGYKTRGMAYAMLGQWEGA

SEQ ID NO: 17945 - DNA, 702 bp, Panicum virgatum
  misc_feature: Ceres CLONE 1795239-R
  misc_feature: Encodes the peptide sequence at SEQ ID NO. 17946
gtgagaaaagtgagggaggaaaagagggctgagcgtgatcgttttcgtcgacgcgcagaggcacaggctgcttatgaaaaagccaagaggaaggaagaatcgtcaagccgctcatcaggaggctttcctggagggatgcctggtggaggtttccctgggggaatgcctggaggagctttccctggagggatgcccgggggtttccctggaggtgccatgccaggggcgttccctgggggtggtcctggtaatgtcgatatgagtaaaatcctgaatgaccctgacctgatggcggcattcagtgacccagaggtcatggctgctctacaggatgtgatgaacaatcctgccaactttgccaagcaccaagcgaatcccaaggtgggccctatcatagcaaagatgatggccaagttcagtgggtcccagtgaaggttgtgtgccagtcaggttttgtgggcagcaagcaaaagttccttggacagtcaacaggtattctctttttgtgcatctgggtgtgtttagcttgtgatgaagaacatgagtgtttttttttctgggcatctgatctggaggtgcgttgagcttgtgatgaaaaacactagtgggctcggtggggatactagctcattcacttctgttagtgcctatgcctacgactagcagagatacaggaatgatttcacaggtggtattacggtt

SEQ ID NO: 17946 - protein, 143 aa, Panicum virgatum
  misc_feature: Ceres CLONE 1795239-R
  misc_feature: Functional homolog of the protein sequence given in SEQ ID NO 50198
  misc_feature: Useful for making plants with altered terpenoid content
VRKVREEKRAERDRFRRRAEAQAAYEKAKRKEESSSRSSGGFPGGMPGGGFPGGMPGGAFPGGMPGGFPGGAMPGAFPGGGPGNVDMSKILNDPDLMAAFSDPEVMAALQDVMNNPANFAKHQANPKVGPIIAKMMAKFSGSQ

SEQ ID NO: 17947 - DNA, 736 bp, Panicum virgatum
  misc_feature: Ceres CLONE 1795240
  misc_feature: Encodes the peptide sequence at SEQ ID NO. 17948
ccctctcctctcttcctcccgcccgccccctgccctcgagctccctcccccgcgcgcgctctcgtcggcgacgatctccagccagagtgaggtagatcaggggctctgtcccggctgcgggagaaacggatggaggactccgcgggcttgcgtggcggcgggggatgcggcggccttgacgcgcagatcgagcagctcatggagtgccgcccgctcccggagacggaggttaaaacattgtgtgagaaggccaaggagatattgatggaggaaagcaatgttcagccagttaaaagcccggtgacaatttgtggtgacattcatggacaattccatgatcttgtagaacttttccggattggcgggaagtgtccagacacaaactatttgtttatgggagattatgtggatcgtggctattactctgttgagaccgtaactcttttggttgcactgaaggtgcggtacccacaacatattactattcttcgtggaaaccatgagagtagacagatcacacaggtgtatggcttctatgatgaatgcctacgaaaatatggcagtgccaatgtctggaagatcttcaccgatctttttgactattttcctttgacagcattggtggaatcagaaattttttgcctccatggtggtttatctccttccattgagaatctcgatagtgttagaagcttagatcgtgttcaagaggtccctcatgagggacctatgtgtg

SEQ ID NO: 17948 - protein, 202 aa, Panicum virgatum
  misc_feature: Ceres CLONE 1795240
  misc_feature (56)..(197): Pfam Name: Metallophos Pfam Description: Calcineurin-like phosphoesterase
  misc_feature: SWISSPROT Homolog: EC 3.1.3.16 Phosphoprotein phosphatase
  misc_feature: The sequence is a functional homolog of SEQ ID NO 13 in US patent 7271316
MEDSAGLRGGGGCGGLDAQIEQLMECRPLPETEVKTLCEKAKEILMEESNVQPVKSPVTICGDIHGQFHDLVELFRIGGKCPDTNYLFMGDYVDRGYYSVETVTLLVALKVRYPQHITILRGNHESRQITQVYGFYDECLRKYGSANVWKIFTDLFDYFPLTALVESEIFCLHGGLSPSIENLDSVRSLDRVQEVPHEGPMC

SEQ ID NO: 17949 - DNA, 2381 bp, Panicum virgatum
  misc_feature: Ceres CLONE 1795256
  misc_feature: Encodes the peptide sequence at SEQ ID NO. 17950
aaagcagcagccgccatcgcctacgtttgtggccgtgccgcaccgtgcacgagcgcgtcgcgcccctccaccacaacgagctgagacgacggcggaggagaggcggccatggccatggaggacgacgcgaggaacacgacgggcaggaagaagggcggcctcagaacaatgcccttcatcttcggtgagcgagttccctgatccagcagcatcgattggtaataaaacttgtgcctgtcgcgcgcgcgctcttctctaatggtcgtccggttttgcttttgcacgtacgctcgacgacggcgagcagccaacgaggtggcggagaagctcgccgtggtggggttctcgaccaacatgctgacgtacctcaccacgcagctgcacatgccgctcgccaaggccgccaccacgctcaccaacttcggcggcacctccgccgccacgccgctcgtcggcgccttcctcgccgacgcctgcatcggccgcttctggaccatcgccgccgcctccgtcgtctaccaaatcggcatggcgctgctgacggtgtcggcggcgctgccgcagttccgtcccccgccgtgcacgccggggggcgcggcggcgtgccaggaggcggcgccgtggcagctggcggtgctgtacgcgtccctgctcctcaacgcggtgggcgccggcgggtaccggccctgcatcgtggcgttcggcgccgaccagttcgacgagtcgcgggcggcggagcgcgcgcgctcctggggcttcttcaactggtactacttctgcaacggcgcgtccatgctggtcgccgtcacggcggtggtgtacgtgcaagacaacgtcggctggggctggggcctcggcgtgccggccgcctgcatgggcgtctccgtcgccgccttcgtctccgggtacccgatgtaccgccggctcgaccccgcggggagcccgttcacgcggctcgcgcaggtggtcgccgccgccgccaggaagcggcggctgccggcggccgacgtccacgccgcggcgctctacgagaacgacgacctcgacgcgcccatctccatgtacggcaagctcgtgcacacggaccagctcagcttcttggaccgcgcggcggtcgtcaccgacggcgacctggtcacgccggccgacgcctcctccggcaaaccatcgccaccgcccgtcccgaacccgtggcgcctgagcacggtgcaccgcgtggaggagctcaagtcggtgatccgcatgggccccatctgggcggcgggcatcctggtgatcacggcgtcctccacccagaacaccttctccctgcagcaggcgaccaccatggaccgccgcctcgcgccgggcctctccgcgttccggatcccggcgggctccatgaccgtcttcgtgctgctcgccatgctcctcaccctcttcgtctacgaccgcgcgctcgtcccgctggcgcgccgcgccacggggctggaccgcggcatctccttcctccaccgcatgggcgtgggcttcgccctcagcgcgctcgccaccctggtcgccggcttcgtggagcgccgccgcagggccgccgccgcggcggccggcgccgcggacgccggcacgtccccgctgtccgcctactggctggtgccgcagtacgcgctgcacggcgtggccgaggccttcacctccgtggggcacctcgagttcatgtacgaccaggcgcccgagagcatgcgcagcacggccacggcgctcttctggctgtccatctcgctggggagctacgcgagcacggcgctggtggacgccgtgcaccggtggagcgccggccccggcggcgccaactggctgcccgacaacatcaaccacggcaggctggactactactactgggtcgtcacgatgctgcagctcgtgaacctggcgtactacgccatttgcgccaagcggttcacgttcaagcccgtgcagctccataaggaagccgaggaagaagaagaagaaggcggcaaggcgctggtggagctgcaggagaaggtttgagcagcattgcacggacgtgcagctccacagatctacataggtacaaagcaggtaattagtgagcactaggcagattgtctgaaactcccagttgatgcatcagttgtagtcatgtactagatcagaaacagagggaggtgcaagcaacatcgaatttgtcaggaacagactgaacctccatgttgctgcaagcaacctaatttgtaaattgcaaaagctcaaagtggcaactcagttgtactgtgactagaaagcaggcactaggtaagtgtagtctgaaccttgatgttactgcatatttgtgtgtgtaagcatttgcttgtacattagggataaagagagattgttcaggc

SEQ ID NO: 17950 - protein, 589 aa, Panicum virgatum
  misc_feature: Ceres CLONE 1795256
  misc_feature (77)..(499): Pfam Name: PTR2 Pfam Description: POT family
MVVRFCFCTYARRRRAANEVAEKLAVVGFSTNMLTYLTTQLHMPLAKAATTLTNFGGTSAATPLVGAFLADACIGRFWTIAAASVVYQIGMALLTVSAALPQFRPPPCTPGGAAACQEAAPWQLAVLYASLLLNAVGAGGYRPCIVAFGADQFDESRAAERARSWGFFNWYYFCNGASMLVAVTAVVYVQDNVGWGWGLGVPAACMGVSVAAFVSGYPMYRRLDPAGSPFTRLAQVVAAAARKRRLPAADVHAAALYENDDLDAPISMYGKLVHTDQLSFLDRAAVVTDGDLVTPADASSGKPSPPPVPNPWRLSTVHRVEELKSVIRMGPIWAAGILVITASSTQNTFSLQQATTMDRRLAPGLSAFRIPAGSMTVFVLLAMLLTLFVYDRALVPLARRATGLDRGISFLHRMGVGFALSALATLVAGFVERRRRAAAAAAGAADAGTSPLSAYWLVPQYALHGVAEAFTSVGHLEFMYDQAPESMRSTATALFWLSISLGSYASTALVDAVHRWSAGPGGANWLPDNINHGRLDYYYWVVTMLQLVNLAYYAICAKRFTFKPVQLHKEAEEEEEEGGKALVELQEKV

SEQ ID NO: 17951 - DNA, 1389 bp, Panicum virgatum
  misc_feature: Ceres CLONE 1795259
  misc_feature: Encodes the peptide sequence at SEQ ID NO. 17952
ctaggcgccgccgctccgaggcgcgccagatcggcggcggcggcggcgggccgcggctgcggctgcggctgccccggatccaatgcagcggcggccgtagcgcgggggcggccgatctgaggcgccggcggccgcgggtggaacggggatgtcgtccgcgccggtggcgggggcggcgttcgagcggtaccagcagcgcggaggtggcggcgccgcggcggccaacggcagcacggttttcaagagcgggcctctcttcatatcatccaaagggattggatggaaatcatggaagaagcgttggttcatcctcacacgaacatcattggttttcttcaagagtgatcctaataccttgccccagagaggcattgaagtgaatgttactctaggaggaattgatttgaataattctggaagtgttgtagtcagagaagacaagaaattgttaaccgttcttttcccagatggccgcgatggtcgtgcattcacgcttaaggcagaaacttctgaagatttattcgagtggaaaacagcattggaagaagctcttgcacaagctccaaatgcagctcttgtgatgggacataatgggatatttcgtaatgagacagctgacacatatgaaggagctgttccaaactggagagagaagagaccaatcaaatcattggtgacaggcaggccaattctgcttgcacttgaggatattgatggcagtccttcttttttagaaaaggccctgcgctttcttgagaaacatggaataaaagtggaaggaattttgcggcaggctgcagatgtggaagaggttgacaggaggttgcaggaatatgagcaaggaaggactgagttttcagcagatgaggatgctcacattgttggtgactgtgtaaagcatgttctccgagagctaccatcgtcccctgtgcctgcttcttgctgtacagcattattagaagctttccgccttgaagctaaggatgctaagataaatgctatgcgttcagctatatctgagacatttcctgagcccaatcgaaggctgctgcagagaattttgaaaatgatgcacactattgcatctcatacttctgaaaatcgaatgactgcatcagcggttgctgcctgtatggcacctcttctgttgcgtccacttctggctggtgagtgtgagatggatgaggtatttgatatggatggtgacgattctgctcagcttcttgctgctgcaaatgctgctaacagtgctcaaggcatcatcgcaactcttttagaggaatatgagggcatttttcatgatgaacacctcagatgttccttgtcacccgagtctcaaattgaagatagtggtactgaagcatcaactgatgatgggaatttgaacgc

SEQ ID NO: 17952 - protein, 413 aa, Panicum virgatum
  misc_feature: Ceres CLONE 1795259
  misc_feature (192)..(339): Pfam Name: RhoGAP Pfam Description: RhoGAP domain
  misc_feature (30)..(136): Pfam Name: PH Pfam Description: PH domain
MSSAPVAGAAFERYQQRGGGGAAAANGSTVFKSGPLFISSKGIGWKSWKKRWFILTRTSLVFFKSDPNTLPQRGIEVNVTLGGIDLNNSGSVVVREDKKLLTVLFPDGRDGRAFTLKAETSEDLFEWKTALEEALAQAPNAALVMGHNGIFRNETADTYEGAVPNWREKRPIKSLVTGRPILLALEDIDGSPSFLEKALRFLEKHGIKVEGILRQAADVEEVDRRLQEYEQGRTEFSADEDAHIVGDCVKHVLRELPSSPVPASCCTALLEAFRLEAKDAKINAMRSAISETFPEPNRRLLQRILKMMHTIASHTSENRMTASAVAACMAPLLLRPLLAGECEMDEVFDMDGDDSAQLLAAANAANSAQGIIATLLEEYEGIFHDEHLRCSLSPESQIEDSGTEASTDDGNLN

SEQ ID NO: 17953 - DNA, 570 bp, Panicum virgatum
  misc_feature: Ceres CLONE 1795259-R
agtggagaaacatcaagcagcatgtgctaccttacggttcttcaaggccactcacccgtaagctttcatttgatgcctcttcgagtgaatcaagaggcacagaagcctcaacaagcatgccaacagagaacacctctgtggccatcaatgtcccaaagttagctgagggcattgaatatgggaggcaaccaatggtggcttcctccactttggtagaactaacgactagactagatttcttcaaggagcggaggtcgcaactgatggaacaactccatagtcttgatttaggacatgggtctgcttctcagggttttccattcaagccaccctctccttggaaccatccaaggtaggatgaccattcaattccatgattgtatattctttggtagtggttcttttctgtctatcaattgtagaaaactgcctatccgagtgtaaatctgttttgttcttcaatatgattttgctgtcgtgctgcgggagaatagcttctcaagtggggcatgtgatgtagtcttctgtatgtaatgttgtcatggaggtgcctcttagacaagcttttcc

SEQ ID NO: 17954 - DNA, 1600 bp, Panicum virgatum
  misc_feature: Ceres CLONE 1795260
  misc_feature: Encodes the peptide sequence at SEQ ID NO. 17955
atccgtttggcccacgcgctcccccctcttctctcaccccggcgtcgcccgtcgctagggttttgactcctaaaccgcgccgccatgatgcagccgccgccgccggcacagcagcagcagctatgggcaatggcgcccccgcccccgccgcagtactatcaggcggggcaccccccaccgccgcccccgcagttctaccaggcggggcctccgccgcccgccatgtggggccagccgccgccgcaggcggcgccagctccggcgcccgcgccggcaccgtccggaggtgccggaggggacgaggccaggaccctctggatcggggacctgcagtactggatggacgagaactacctctacagctgcttctcccaggccggcgaggttatttcggtgaagataattcggaacaagcagactgggcaacctgagggttatggttttattgaatttggcaaccatgctttagctgaacaagttctccagaattataatggccaaatgatgcctaatggtaaccaacctttcaaattgaattgggctacaagtggggctggtgagaaacgtggagatgatggttcagattatactatatttgttggggatctagcctcggatgttacagatttcattctacaaaatacgttcaagagtcgttatccatcagttaagggtgcaaaagttgtgtttgacagaactaccggccgctcaaaaggctatggttttgttaaatttggagatttggatgaacagacacgagcaatgactgaaatgaatggacaatactgttctagcaggcccatgcgccttggaccagcatccaacaagaagaatactggtggacaacaacagccaccaagtgctacataccagaatacacaaggacctgattctgacaatgatctaaacaatactactgtatttgttggtggtcttgacccgagtgtgactgatgagcttctgaggcaaaccttcagtccatatggagagcttctctatatcaaaatacctgtaggaaagcgctgtggatttgtccaatattctaacagggcatcagctgaggaggccataagggtgctaaatggaacccagttaggaggtcagagtgtaagactctcatggggtcgtagccctgcaaacaagcagcctcagcaagagcagaaccaatggagcagcggctactatgggtatccacaaggatacgatccatatggttatgctcggcctcctcaagatcctgccatgtatgcttatacagcatatccagggtatggaaattaccagcagcagccaccacagcagcccccaccacaacagtaagactaatggctcgggaggatcatcattcgcaatctggcaatggagtagttggggcagcaacttaggtgcatgggcatgagaaattttgtgactgttgcttgtgttatattgctccaacgtccttgtacacgtagccaactttagattttgctgaggcctagagtgactagtgtttcagctgtaactgggtcagacattttcccactgttcaagaagttttgtggtgaggatttattgtgttgctcgtgccatttaggaatactgagtctcgttttaattt

SEQ ID NO: 17955 - protein, 365 aa, Panicum virgatum
  misc_feature: Ceres CLONE 1795260
  misc_feature (233)..(298): Pfam Name: RRM_1 Pfam Description: RNA recognition motif. (a.k.a. RRM, RBD, or RNP domain)
  misc_feature (124)..(196): Pfam Name: RRM_1 Pfam Description: RNA recognition motif. (a.k.a. RRM, RBD, or RNP domain)
  misc_feature (31)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 536 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: Functional homolog of the protein sequence given in SEQ ID NO 50786
  misc_feature: Useful for making plants with altered terpenoid content
MWGQPPPQAAPAPAPAPAPSGGAGGDEARTLWIGDLQYWMDENYLYSCFSQAGEVISVKIIRNKQTGQPEGYGFIEFGNHALAEQVLQNYNGQMMPNGNQPFKLNWATSGAGEKRGDDGSDYTIFVGDLASDVTDFILQNTFKSRYPSVKGAKVVFDRTTGRSKGYGFVKFGDLDEQTRAMTEMNGQYCSSRPMRLGPASNKKNTGGQQQPPSATYQNTQGPDSDNDLNNTTVFVGGLDPSVTDELLRQTFSPYGELLYIKIPVGKRCGFVQYSNRASAEEAIRVLNGTQLGGQSVRLSWGRSPANKQPQQEQNQWSSGYYGYPQGYDPYGYARPPQDPAMYAYTAYPGYGNYQQQPPQQPPPQQ

SEQ ID NO: 17956 - DNA, 1616 bp, Panicum virgatum
  misc_feature: Ceres CLONE 1795292
  misc_feature: Encodes the peptide sequence at SEQ ID NO. 17957
gctagccgctgctgcttcgcgagctccggccagatccagagacccggcggccggcggcggcgatgaagcagccgaggggccggcaggagccgcgccggatgggcaacgccgccatggtcgtcaccatgctcgtctccctctgcgtcctcacctacatcaaggcgcgatactgctccaaccccttccccaagccggcggaggaggtggaggtggtggaggtggacgaggactacgacagcacgaggtacaagctggagggccccgtcggggaggaggacttcgaccccagccgcccgacctgctacaacacgagcaagcgctcggagcggtgcgcggcggtgggcgacatccgcgtcgacggcaaccactccaagatctacatcagcccgctggaccgcgagtggcgcaccaagccgtacgcgcgccggcacgaccccgtcgccatggacgacgtccgcgagtacacgctcgtgccattcggcggcgccaacgacaccgccgtgccgccgccctgcaccgtcaaccactccgtcccgggcttcctcttctccaacggcggcttcgcgggcaacctctaccacgactacaccgacgtcctcgtgccgctcttcaccagcacgcaccacctcggcggcgaggtccgcttcctgctcagcgggatgaaggactggtggaacgacaagttcacgccgctgttccggcagctgtcccggtacgacgtcatcgacgtcgacaacgaccgggaggtccactgcttcccgcggatcgtcaccggcgccaccttccaccggcccatgggcatcgacccctcgcgctcgccggggggcgtcaccgtcgccgacttcaagcgcctcctccgccgcgcgttccggctggagcgcgccgtagcgtcgcggtcgggggcgccgcgccgggaccggccgcgcctcctcatcatctcccgcaagagctcgcgccggttcttgaacgagcgcgccatggcgcacgcggcggcgcgggcgcgcttcgacgtgcgcatcgccgagccggacaaccacacggacatgcccaacttcgcgcggctggtgaactcggcggacgtgatgatgggggtgcacggcgccgggctcaccaacatggtgttcctgcccagccgcgccgtgctcatccaggtggtgcccttcggggggctcgagtggctcgccagggtcaccttcaaggacccggccagggacatggacgtcaactacatggagtacaacgtgtcgctggaggagagctcgctcagggacctctacccggaggaccatttctacctcaaccacccctacgacgtgcacaagaaggggtgggacgccatcaagacggtctacctcgacaagcagaacgtcaggctcaacctcaccaggttcaccaagacgctcgagcaggcgcgcgatctcctgcccgagccctgatcatagatcgatcctcatgctcatggatgccaatgccatgccttcagattggcccggcacctgccatgcaagtggtagataggctcgctcacaccatgtcttgaaacttgtttttgtttacttgttttctcctccttttttttctccttctcccctcttgtggcaagattcatttctttc

SEQ ID NO: 17957 - protein, 457 aa, Panicum virgatum
  misc_feature: Ceres CLONE 1795292
  misc_feature: Functional homolog of the protein sequence given in SEQ ID NO 50315
  misc_feature: Useful for making plants with altered carbohydrate content
MKQPRGRQEPRRMGNAAMVVTMLVSLCVLTYIKARYCSNPFPKPAEEVEVVEVDEDYDSTRYKLEGPVGEEDFDPSRPTCYNTSKRSERCAAVGDIRVDGNHSKIYISPLDREWRTKPYARRHDPVAMDDVREYTLVPFGGANDTAVPPPCTVNHSVPGFLFSNGGFAGNLYHDYTDVLVPLFTSTHHLGGEVRFLLSGMKDWWNDKFTPLFRQLSRYDVIDVDNDREVHCFPRIVTGATFHRPMGIDPSRSPGGVTVADFKRLLRRAFRLERAVASRSGAPRRDRPRLLIISRKSSRRFLNERAMAHAAARARFDVRIAEPDNHTDMPNFARLVNSADVMMGVHGAGLTNMVFLPSRAVLIQVVPFGGLEWLARVTFKDPARDMDVNYMEYNVSLEESSLRDLYPEDHFYLNHPYDVHKKGWDAIKTVYLDKQNVRLNLTRFTKTLEQARDLLPEP

SEQ ID NO: 17958 - DNA, 1803 bp, Panicum virgatum
  misc_feature: Ceres CLONE 1795305
  misc_feature: Encodes the peptide sequence at SEQ ID NO. 17959
ggagacggagaaataagctgctaggtcgccggccagaggcggcaggcaccactgagggcgcgccacgacgcgctgacgcagctcctgatgtcatgtcaatcgaataatcaatccatcgttgcatgggcgacaacaagctgggccagctgctggctctcgacgcgtcgccgcgcccgctcgccttgctccacctgccgccgagggggatgtcggcggaccaccacccagcaggcggaagcagcagcttaaggaggcagaggtcgtccgtcgaggtggacttcttctccgacgacaagcacaaggagggcgcgccgccgggcctcgccatcaacaaggaggacctcaccattaacctccttgcagccgcggctggggacagcagcataaacaaggaggacaccaagaagatggtgcagcagcagctgccggccttgcaggcggagcttggccgcatgaacgaggagaaccagcgcctgcgggggatgctcgcgcaggtcaccaccagctaccaggcgctccagatgcatctgctggcgctcatgcagccgcagccgcagccgatcccccatcttcctccgccgccgccgcgacagcccgaggagccggcgtccaactcgtcgacggaggtggtgggcagcccgcggcggtcgtcgtccaccggcaacaacaaggaccacctgcagctgcaggcggacagcccggacgccgcggggtggctgccggcggaggggcggcagcagcagcagcaggaggcaagcatgaggaaggctcgcgtctcggtgcgcgcgcgctccgaagctccaatcatcgccgatggttgccagtggcgcaagtacgggcagaagatggccaagggcaacccctgcccgcgagcctactaccgctgcaccatggccagcgcctgccccgtcaggaagcaggtgcagcgctgcgccgaggaccgctccatcctcatcaccacctacgagggcacgcacaaccacccgctgccgcccgccgccatggccatggcctccaccacctccgccgcggcctccatgctgctgtcgggatccatgcccagcgccgacggcacgcccatgacctccaacagcttcctggcgcgcgccgtgctgccctgctcctccagcatggccaccatctccgcctcggcgccgttccccaccgtcacgctcgacctcacccacggcccgcccagcgccgcagccgcacgcccggccccgctcgcgccgacgcagttccaccacctgccgctctacaaccagtccaccaagttctccggcctgcacatgtcctcgtcgccatcagcagcagacgcgccgccgatcgggatcggtggtctggccgacaccgtcagcgccgcggcggccgccatcacagcggaccccaacttcacggtgtcgctggcggcggccatctcgtccatcataggaggaggcggccagcagcagctgcacgggctgcagggcgccaacaacaacaataataacgtcacgagcagcagcaacaacaccaacagcgaaacccagtgaaggaaaccatttatatacatatatatcatcagattagtatagcagctcatcaaatgattttaatttgcattgcagcagcaaaagctagctatctagttgtattcattcattacgtcgtgtttaatttcttgctgattatatatattctagggtttattaattagttattagtttctgcatgctgccaaggcttagctagctagctagctaggtgttgatatacatacttcatactccttgtatgtaataataataacaggattaattactc

SEQ ID NO: 17959 - protein, 469 aa, Panicum virgatum
  misc_feature: Ceres CLONE 1795305
  misc_feature (229)..(289): Pfam Name: WRKY Pfam Description: WRKY DNA -binding domain
  misc_feature: The sequence is a functional homolog of SEQ ID NO 886 in the 10/666,642 US patent application
  misc_feature: The sequence is a functional homolog of SEQ ID NO 154 in the 10/666,642 US patent application
  misc_feature: The sequence is a functional homolog of SEQ ID NO 236 in the 10/714,887 US patent application
  misc_feature: The sequence is a functional homolog of SEQ ID NO 236 in the 11/435,388 US patent application
  misc_feature: The sequence is a functional homolog of SEQ ID NO 885 in the 10/666,642 US patent application
  misc_feature: The sequence is a functional homolog of SEQ ID NO 1372 in the 10/666,642 US patent application
  misc_feature: The sequence is a functional homolog of SEQ ID NO 258 in the 10/714,887 US patent application
  misc_feature: The sequence is a functional homolog of SEQ ID NO 258 in the 11/435,388 US patent application
  misc_feature: The sequence is a functional homolog of SEQ ID NO 94 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MGDNKLGQLLALDASPRPLALLHLPPRGMSADHHPAGGSSSLRRQRSSVEVDFFSDDKHKEGAPPGLAINKEDLTINLLAAAAGDSSINKEDTKKMVQQQLPALQAELGRMNEENQRLRGMLAQVTTSYQALQMHLLALMQPQPQPIPHLPPPPPRQPEEPASNSSTEVVGSPRRSSSTGNNKDHLQLQADSPDAAGWLPAEGRQQQQQEASMRKARVSVRARSEAPIIADGCQWRKYGQKMAKGNPCPRAYYRCTMASACPVRKQVQRCAEDRSILITTYEGTHNHPLPPAAMAMASTTSAAASMLLSGSMPSADGTPMTSNSFLARAVLPCSSSMATISASAPFPTVTLDLTHGPPSAAAARPAPLAPTQFHHLPLYNQSTKFSGLHMSSSPSAADAPPIGIGGLADTVSAAAAAITADPNFTVSLAAAISSIIGGGGQQQLHGLQGANNNNNNVTSSSNNTNSETQ

SEQ ID NO: 17960 - DNA, 1931 bp, Panicum virgatum
  misc_feature: Ceres CLONE 1795314
  misc_feature: Encodes the peptide sequence at SEQ ID NO. 17961
attcaccagcacacgatcggcgacctgctgtgaaaatggcatgtccttccttttgcacgagctcgtgggcgccacgcctcccatgcttcgacggcgacagtagcagcaggttccgaggccgcaacctctccgccggcgacctcccgccgtcgctgggcgcgacgacgcagcagcctcccaagctcaggaaacacctcgtgtcaccctacgatccccgttacaaggtgtgggagatatttctgatcctcctggtggtgtactcggcgtggatatgcccgctggagttcgcgttcctgaggtacctgcccagggcccctttcatcgtggacgatgtcgtcaacggcttcttcgccgtcgacatcgtgctcgccttcttcgtcccgtacgtcgacagcaagtcctacctcctcgtcgacgaccccaagaaaatagcagtcaggtacctgtcgtcttggtttgccttcgatgtctgctcgacgttcccgttccactccatcagcctcctgttcaaccggcacgagcacagccttggactcaagttcctcaatgctctcaggctttggcggctgcgtagggtcagctccttgtttgcaaggctcgagaaggacatccggttcaactacgcagtgatacgctgcacaaagctcatctcggtgaccctgttcgcggtccactgcgccgggtgcatcaactacctgatcgctgaccggtacccggacccgaggcggacgtggatcggcgcctccatgccggacttccgggaggccgggctgtgggcgcggtacgtgacgtccctgtactggtccatcacgaccatgaccaccacggggtacggcgacctccacgccgagaacacccgggagatgctcttcggcatcgcctacatgctcttcaacctctggctcaccgcctacctcatcggcaacatgaccaacctcgtcgtccacagcaccagccgcaccagggactttagggacatggtccaggcggcttcagagttcgcggcgaggaaccagctgccgcggcagatcgaggagcagatgctgaaccacatctgcctgaggttcaggacggaggggctcaagcagcaggagacgctggagatcctccccaaggcgatgcgcgccagcatctcgctctgcctcttcttcccggttgtgcaagggtcctacctgttcaaaggggtttccacaggtttcatccagcagctggtgacggagatgcaggctgagtactacgccccgaaggaggatgtcgtgctgcagaatgacaaaccgtcagacctgcatcttcttgtttcaggagcagtggacgttctggcattccttgacggaacagaacaggtctatggaaaagcagccgagggagagctactaggggagaccggagtcatgttcaaccagccacagccgttcaccttccggactacaaagctatctcaggttatgaggatcagcaggtccaagctcatggacatcatgcaagaaaacagagaggacggtgagatcatcagaagcaacttccagcaaaaactccggatggagcggagattgtacattacaacgcaccaagacgatcgggtcagtgcgtttgaacagagactggatccctgagaggctgaggcggtctcaccggtcgaagcgcgcatcatgttgaattaattgttccaacgaacttaccgctaaaacgcatatgctagggtaaaatcaacaataagttccaagtatgttgcgtgggggtatgaattttgttgtattttaagcgcaaactttgaagagtgtggtagcgccttcagttaaaatagcagccagcagaagaccaagaaaagatgggcggaaagtattgttagttttcggcttttcggccctggaatactgaacgggctcgattggcggttatcgttgaataacaagtttcatgggcatcttgac

SEQ ID NO: 17961 - protein, 525 aa, Panicum virgatum
  misc_feature: Ceres CLONE 1795314
  misc_feature (97)..(298): Pfam Name: Ion_trans Pfam Description: Ion transport protein
  misc_feature (207)..(304): Pfam Name: Ion_trans_2 Pfam Description: Ion channel
  misc_feature (398)..(487): Pfam Name: cNMP_binding Pfam Description: Cyclic nucleotide-binding domain
  misc_feature: The sequence is a functional homolog of SEQ ID NO 1838 in the 10/374,780 US patent application
MACPSFCTSSWAPRLPCFDGDSSSRFRGRNLSAGDLPPSLGATTQQPPKLRKHLVSPYDPRYKVWEIFLILLVVYSAWICPLEFAFLRYLPRAPFIVDDVVNGFFAVDIVLAFFVPYVDSKSYLLVDDPKKIAVRYLSSWFAFDVCSTFPFHSISLLFNRHEHSLGLKFLNALRLWRLRRVSSLFARLEKDIRFNYAVIRCTKLISVTLFAVHCAGCINYLIADRYPDPRRTWIGASMPDFREAGLWARYVTSLYWSITTMTTTGYGDLHAENTREMLFGIAYMLFNLWLTAYLIGNMTNLVVHSTSRTRDFRDMVQAASEFAARNQLPRQIEEQMLNHICLRFRTEGLKQQETLEILPKAMRASISLCLFFPVVQGSYLFKGVSTGFIQQLVTEMQAEYYAPKEDVVLQNDKPSDLHLLVSGAVDVLAFLDGTEQVYGKAAEGELLGETGVMFNQPQPFTFRTTKLSQVMRISRSKLMDIMQENREDGEIIRSNFQQKLRMERRLYITTHQDDRVSAFEQRLDP

SEQ ID NO: 17962 - DNA, 663 bp, Panicum virgatum
  misc_feature: Ceres CLONE 1795317-R
  misc_feature: Encodes the peptide sequence at SEQ ID NO. 17963
ccgggaggatgaagacggagtctgagctcctgtcgatagaggtgaagcccgggtggaagaagggcaccaagatcacgttcccgggcaagggcaaccagcagtggaaccagctccccgcggacttggtcttagtggtggacgagaagccccaccccgtgtaccggcgtgatggcaacgacctggtggccgaggcccgggtgactctcgctgaggcgctgggcggcacggtggtcgtcctcgccgcgctcgacggccgcgagctggcagtggaggtgggcggcgccgaggaggacgacgcccccgtggtgtgccccgggtacgagctggtggtgccggcggagggcatccccatcgcgcgcgagcccgggcgccgcggcagcctccgcatccggttagaagtcgagttcccggagcggctcacgggccggcagtgcgcgcagatcaagcgcctcctcgaggccggctgctagctacctagctacccgccggccggtcacctaaccggcggccaacgggatgtttggtcgtgctacatagtacatacccatgcacctcatgtggaactagcttgtaaaggagatgatcgatgctcatagataggtcaggcaaaacacgatccccattgtactagctaatccagacatttcttttcccgttcctgcc

SEQ ID NO: 17963 - protein, 155 aa, Panicum virgatum
  misc_feature: Ceres CLONE 1795317-R
  misc_feature (22)..(151): Pfam Name: DnaJ_C Pfam Description: DnaJ C terminal region
GRMKTESELLSIEVKPGWKKGTKITFPGKGNQQWNQLPADLVLVVDEKPHPVYRRDGNDLVAEARVTLAEALGGTVVVLAALDGRELAVEVGGAEEDDAPVVCPGYELVVPAEGIPIAREPGRRGSLRIRLEVEFPERLTGRQCAQIKRLLEAGC

SEQ ID NO: 17964 - DNA, 509 bp, Panicum virgatum
  misc_feature: Ceres CLONE 1795317
atccagaacttccaagatttattttcccttttgggcccgtgcccctgctgcacgccggcgcccctccctgccgcgctggaggggccgcgcgcctggagtccgcgccccaccctgccgcgcgcaggggaggaacaggcgcctggagtcctatggaggagggaaccaccgcgcgcctggagccacaggaggagggcgacggggagaggctgggatggcgccgccacaaaccctaggtcggagcggccatggacggcgatggggaggaggcagggaatcacgccacgaagagtgacggcgacgaggataaagaaacgagataggtgctcgtctttttcttacactacccggaagtacggcactatctgctaaccgctcggacacccgagttcctggagctccacggcatcgatgcgctgttcacgcaaatgcgcgtctgcatcgacatcatcatcaggatgctcgacaccggcgtgtggccggagaggaccacctactacaaccagaggttc

SEQ ID NO: 17965 - DNA, 1859 bp, Panicum virgatum
  misc_feature: Ceres CLONE 1795318
  misc_feature: Encodes the peptide sequence at SEQ ID NO. 17966
agtgccagtcccgattctctggcctccaacccaaccagttcgccgaatcgccgccccgacccgcggcgacctcaactcctcgcggtaaccaaacggatgggagcggcagcctgacgcgatgagcccgcccgccatgctgctgcccgtcgtctgctccgccgcgcccagctgctccccgctctgcccggtgacggcgtcgcacgtcgtcgcgcgggtgccgcggagggtggacgtgggcgccgcgctcaggtcctacgccgacccgctcgtcgcgcaggtacccgaccgcccgccgctcgccgactcctccatcctctccccctaccccgccgcgccggacgacatcgcccgaggcttcggcggcgcggcctccgagctgcccagcgccgacgcgctatgctgcaccggggccgaccagccgctgacgttcgtcgcggccctggccgctccagagcaaactgctaccgccgtcactgccgcgctcgactcggcccccagcgacgccgcggagcgcgccctgtcggacgcgccgttccccaccacgttcccgtccgacgcgtccgaggtcgaggactccgtggccaggctcatcgataagctcggcaagcaggtcttccaggcggaggacgcgctcaccgaggcctacgacaagctgaggctgtcggcgtacgacgcgctcgggacctggaggaagacggtgcgcgacgcgatcggtgggctcaaggcctcggtcgatgccagtaaggacaaggccgccggaggggtcacggacgcttccggggcgttgcaggagaaggtggcgggagctggcgccgtggctgttgatgttcttaggaaggcaattgttgctgcagaggattcactgggcagtgcggcaacgttcctcgtgtattcttacagatccgcaaaggagtctctgccaccaaatgtaagagatctgttgagcacgtctgaggagaaagctagtcaagttctgagaccaatcggaaatgctcttcaacaggcatatgtaattgttgaaggtgttgaaaagaatgttggtttggacccaagtgatcctattgttcaattggcagttgtgcttggaggttcagtgacaatagggacatcgtactggctcttcacatacggtggttattcaggagacctgtcaccagaatcagcattggagctattgaaaaatgatgacaaagccgtacttattgatgttcggcctgaggatttgagggaaaaagatggtgttcctgatttacgccttggggcaaggtctaaatatgcaagtgtagtttcacctgagatcaaaggcccaataaggaatatgcttaaaagtggaagagatgttaatgatgccttacttgctgttgtcatccgaaacttgaaattggttaagggtgattcaaaggtcatagttatggatgctaatggagcccgatcaaaagccgttgctaggttactgaagaagcttggtgtgcagcgaccttacctagttaaaggtggtttccaagcatggtcaagggaccttcgtgtcaaagaactgaaacctgagactgcattaacggcaataaacgaggacgttgaagaaatcattgaacaaataaagcccaccccaactcttgtgttcggatctcttctgggcctctcagcactttcctatgctatactagaatgggagacgactctgcaatacatcgccgttctaagcattgggctgactatctactcgcgattcactacatacgagagctccgaggatttggagcaggacctaaagtaagttatcctggagcttgtgcctgttttttgtatcaaaatatccttttaggttgaattgaagtcttagattaacaaaaagatcattt

SEQ ID NO: 17966 - protein, 546 aa, Panicum virgatum
  misc_feature: Ceres CLONE 1795318
  misc_feature (340)..(462): Pfam Name: Rhodanese Pfam Description: Rhodanese-like domain
  misc_feature: SWISSPROT Homolog: EC 2.8.1.1 Thiosulfate sulfurtransferase
MLLPVVCSAAPSCSPLCPVTASHVVARVPRRVDVGAALRSYADPLVAQVPDRPPLADSSILSPYPAAPDDIARGFGGAASELPSADALCCTGADQPLTFVAALAAPEQTATAVTAALDSAPSDAAERALSDAPFPTTFPSDASEVEDSVARLIDKLGKQVFQAEDALTEAYDKLRLSAYDALGTWRKTVRDAIGGLKASVDASKDKAAGGVTDASGALQEKVAGAGAVAVDVLRKAIVAAEDSLGSAATFLVYSYRSAKESLPPNVRDLLSTSEEKASQVLRPIGNALQQAYVIVEGVEKNVGLDPSDPIVQLAVVLGGSVTIGTSYWLFTYGGYSGDLSPESALELLKNDDKAVLIDVRPEDLREKDGVPDLRLGARSKYASVVSPEIKGPIRNMLKSGRDVNDALLAVVIRNLKLVKGDSKVIVMDANGARSKAVARLLKKLGVQRPYLVKGGFQAWSRDLRVKELKPETALTAINEDVEEIIEQIKPTPTLVFGSLLGLSALSYAILEWETTLQYIAVLSIGLTIYSRFTTYESSEDLEQDLK

SEQ ID NO: 17967 - DNA, 721 bp, Panicum virgatum
  misc_feature: Ceres CLONE 1795324
  misc_feature: Encodes the peptide sequence at SEQ ID NO. 17968
gctggtcaacgagcacgcacagctccttctgttcctcatggccttctcctccatcctccccctcctcgtagccgccgcgctcgtcctccggcttgccgccgcggcgccgcaggagcatctcgtcacgcgcctcccgggcttccacggcggcgccagcaacttcccctccaggcactacgccgggtacgtgacggtggacgaggccagcgagcggagcctcttctactacctcgtgctctcggagcgcgaccccgccgccgaccccgtcgtgctctggctcaacggcgggcctggctgctccagcttcgacggcttcgtctacgagaacgggcccttcaacttcgagcccggccggaggagcacgagcacgccgccgggcggcctgcccaggctgcgcctcaacccctacagctggtcaaaggtctcaaacatcatgtacctggactctcctgctggtgttgggatgtcatactcgttgaacaaatcggattacatgactggagacctgaaaactgcagctgatgcacacaagttccttttgaagtggtttgagctgtaccccgagtttcagtcgaaccccttctacatttcaggggagtcatatgcagggtattatatccccacactcacagatgaagttgttaaagggatcaagaaaggtgtggagccaaggatcaatttaaagggctatctgataggcaatggagcaactgatgtgaac

SEQ ID NO: 17968 - protein, 227 aa, Panicum virgatum
  misc_feature: Ceres CLONE 1795324
  misc_feature (33)..(227): Pfam Name: Peptidase_S10 Pfam Description: Serine carboxypeptidase
  misc_feature: SWISSPROT Homolog: EC 3.4.16.5 Carboxypeptidase C
MAFSSILPLLVAAALVLRLAAAAPQEHLVTRLPGFHGGASNFPSRHYAGYVTVDEASERSLFYYLVLSERDPAADPVVLWLNGGPGCSSFDGFVYENGPFNFEPGRRSTSTPPGGLPRLRLNPYSWSKVSNIMYLDSPAGVGMSYSLNKSDYMTGDLKTAADAHKFLLKWFELYPEFQSNPFYISGESYAGYYIPTLTDEVVKGIKKGVEPRINLKGYLIGNGATDV

SEQ ID NO: 17969 - DNA, 1431 bp, Panicum virgatum
  misc_feature: Ceres CLONE 1795326
  misc_feature: Encodes the peptide sequence at SEQ ID NO. 17970
agaaattggaaattccccattcagaaaggagactgctccgcttcacacgcaggctttgctctgcccgaaatctctcgctcccatcaatggcgtcgccgacggcctgagcagctccccagctccgtcggcggcggcgcgactccgcaccgggctcgctagtcttcgccgcagggaggaggaagtggaggaggaagggaggccgcgaagatggtggggggaggcggcggcggcggcggggcgctgcggcgggtgggcaagtacgaggtcggccggaccattggggagggcaccttcgccaaggtcaagttcgcgcagaacaccgagaccggggagagcgtcgccatgaaggtgctcgaccgctcctccatcctcaagcacaagatggccgaacagattaaaagggagatatccataatgaagcttgtcaggcatcccaatgttgttaggctacacgaggttctggcaagccggaagaagatatttataatcctggagttcatcactggtggtgaactatttgataaaattattcgtcatgggagacttaatgaagcagatgcacgcagatactttcagcagcttattgatggtgtcgatttttgtcacaacaaaggagtctaccatcgagatctgaagcccgaaaatctcctccttgattcccagggcaatcttaaaatttcagactttggattgagtgcatggcctgcccagggatcttccctcctacgtacgacatgtggaacgccgaattatgttgccccagaggttctcagtcataaaggatataatggagcacttgctgatacatggtcatgtggagttattttatatgtactgttagcaggttttcttccattcgatgaagtggacttgactaccctttatggaaagattgagagtgcagaatattcattcccaccctggtttacaggtggtgcaaagtcactgattcgtagaattcttgatccaaatccagatacacgaatcaggatagaagagatcagaaatgacgaatggtttcagaagaattacgagcctatcaaagaaatagaaagtgaagaagtcaaccttgatgatgttaatgcagcttttgataatcctgagatgagggtggaaggtctaaatgcagacaagactagtcatctctcaatcatggttgaggttttcgaagttgctccatcaatcttcatggtagaactacaaagagcagccggagatacttcagagtataacatgtttgtaaataactactgcagcaaattagatgatatcatctggaaatatccaacagaaaagggcaagtcaaggatatcccggttatcaaagtgctgatttgttctcaacctccatcatacgtctcatgcatagtctagtgctttgttgtatcaagtatcaacttgatgtatctgtgtatcacacttgatctctaat

SEQ ID NO: 17970 - protein, 374 aa, Panicum virgatum
  misc_feature: Ceres CLONE 1795326
  misc_feature (18)..(271): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
MVGGGGGGGGALRRVGKYEVGRTIGEGTFAKVKFAQNTETGESVAMKVLDRSSILKHKMAEQIKREISIMKLVRHPNVVRLHEVLASRKKIFIILEFITGGELFDKIIRHGRLNEADARRYFQQLIDGVDFCHNKGVYHRDLKPENLLLDSQGNLKISDFGLSAWPAQGSSLLRTTCGTPNYVAPEVLSHKGYNGALADTWSCGVILYVLLAGFLPFDEVDLTTLYGKIESAEYSFPPWFTGGAKSLIRRILDPNPDTRIRIEEIRNDEWFQKNYEPIKEIESEEVNLDDVNAAFDNPEMRVEGLNADKTSHLSIMVEVFEVAPSIFMVELQRAAGDTSEYNMFVNNYCSKLDDIIWKYPTEKGKSRISRLSKC

SEQ ID NO: 17971 - DNA, 710 bp, Panicum virgatum
  misc_feature: Ceres CLONE 1795327
  misc_feature: Encodes the peptide sequence at SEQ ID NO. 17972
gatctccttccaccctcttccctacccttcttcttcccatctcgcgctgctcgaggaagtggacggcgggaggacgcgagggggtgagggagcggggcggcgacgatggtggacgtctcgcgcgtgcagaaggagctcaccgagtgcaaccgcgaccgggaggtctcgggcgtctccatcgcgctgcacgacggcgctaacatctcccacctcaccggcaccatcgccgggcccgccgacagcccctacgagggcggcaccttcgtcatcgacatccgcctccccggtggatatccctttgaacctccaaagatgcagttcgtcactaaagtatggcatcctaacatcagcagccaaaatggagcaatttgcttggacattctgaaagatcagtggagcccagctcttactttgaagactgcgttgctttcccttcaagctctgctttcttctcctgcacctgatgatcctcaggatgctgtcgttgcacaacaggtctgaactctgaactggttgtttcctgtttggttttatttatagtgcgctatatattttatttagccagtgaagctacagttggtagggagttaaactaacatagactgccctttgtggattcctatgaacagtgagtcagaatgactgtttatccagaaaatatgtttatgtacttatgcataactacatcatcatgccctttggttgaaatt

SEQ ID NO: 17972 - protein, 131 aa, Panicum virgatum
  misc_feature: Ceres CLONE 1795327
  misc_feature (6)..(131): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
MVDVSRVQKELTECNRDREVSGVSIALHDGANISHLTGTIAGPADSPYEGGTFVIDIRLPGGYPFEPPKMQFVTKVWHPNISSQNGAICLDILKDQWSPALTLKTALLSLQALLSSPAPDDPQDAVVAQQV

SEQ ID NO: 17973 - DNA, 638 bp, Panicum virgatum
  misc_feature: Ceres CLONE 1795327-R
gtgacgtggcctgctcatgcgccggctgccggcagccggcgatttctattatccttgctcttagtaactctcttctagacctggacgcactgccagtccagttatgcagagtgtaagcataagctcagagaattcactgcaataatgaatggaacagtaggcctataaagctgcagatgaacttatgaatcattattcccgaccttctcccattaatttctttgcgttgactcttttctgcagtacctgcgtgattatccaacattcgctgctacagctcgctactggacaaaggccttcgcaaagagcacgtccactggcatggaagagaaggtgcagaagctggttgagatgggcttcccagaggatctggtgagaagtaccctgaatagtgtcgatggtgatgagaacatggctctcgaaaagctctgctctggctgaaccacccttatggtggatatatgaactgtaaattgcatccccattggttattatattatataagataagagaacaatgcctgctaattcccctgctctgccatttcagtgtggccatttatcgagacaatatatataggggattggaccatgggactcgtgaaaaccgcctttatgataacttcagagttcgttcag

SEQ ID NO: 17974 - DNA, 696 bp, Panicum virgatum
  misc_feature: Ceres CLONE 1795337
  misc_feature: Encodes the peptide sequence at SEQ ID NO. 17975
cttctctgttctctctcacacaatcttccgaccgccctcacctcccccctccgccaactccggggaccagctctccgcccccgacgcctcgagcccgatgctcgcgagcaggagcgaggagtacaggcttctgttccggctgccgcccgacgaggttctcgttcaagattttaactgtgctctccaagaaaatattctgcttcaggggcatatgtatttatttcttcaccatatatgcttctactcaaacatatttggatatgagacgaagaaaacaatacctttgcaggaggtaactgatgttcgtaaagcaaagacagctgccatttttcctaatgccattgaaattgttgctggtagtaaaaggcacttttttggatctttcttgtcacgtgatgaagcttatcgaattatagtggatggttgggaacagcatgttagtgatgcaaaattgctccttgaacgtcaggagacaaagtcagcaagtaccagtgaagaaaatggttatgttttattggaaggaacaaaggaatctaaacaagatgaagagccatcaccacaggacaggtctgtcaatggcacagctgtctcaagtagtagtgctgatggtgatgattccaacgtcaatatttccaaaaggttttcaaaagttgaggagaatggaaccgaagataacatcattgcactaaacccatt

SEQ ID NO: 17975 - protein, 231 aa, Panicum virgatum
  misc_feature: Ceres CLONE 1795337
  misc_feature (39)..(105): Pfam Name: GRAM Pfam Description: GRAM domain
  misc_feature: SWISSPROT Homolog: EC 2.4.1.173 Sterol 3-beta-glucosyltransferase
FSVLSHTIFRPPSPPPSANSGDQLSAPDASSPMLASRSEEYRLLFRLPPDEVLVQDFNCALQENILLQGHMYLFLHHICFYSNIFGYETKKTIPLQEVTDVRKAKTAAIFPNAIEIVAGSKRHFFGSFLSRDEAYRIIVDGWEQHVSDAKLLLERQETKSASTSEENGYVLLEGTKESKQDEEPSPQDRSVNGTAVSSSSADGDDSNVNISKRFSKVEENGTEDNIIALNP

SEQ ID NO: 17976 - DNA, 1825 bp, Panicum virgatum
  misc_feature: Ceres CLONE 1795339
  misc_feature: Encodes the peptide sequence at SEQ ID NO. 17977
atctcctcacctccctcttgtctggctcgcgcgagtgagtgagcagcttcgcttcctcgtcttcctcatctccggcgctccggtggccgagatcctggtccagcagagctgaccggaaaggctgcgttcgttctgttctctgcaggcggttggtgcgcgacctgagagcaccaggggcggcgagaagatggccggagcagcggcggtcgacgtgccggcgccggcggcggccaacggcggggcgtgctgccacgccgcgaaggggcccgggtacgcgacgccgctggaggccatggagaagggcccgagggagaagctcatctacgtcacctgcgtctacaacggcacaggcattaacaagccagattaccttgcgacggtggatttggatcccaactctcctacatactcccaagtgatccacaggctcccggtgacccacattggcgatgagctgcatcactctggctggaattcttgcagctcctgccacggcgatccatcagcggaacgccgcttcttgatcctgccttcattgctgtcaggtcgtgtgtatgttgttgacactgctacagacccgagagcgccgtccttgcataaggtggtccaggccgaggacattgctgagaagactggacttgggtttcctcacacatcgcattgccttgcatctggtgacattatgatatcttgccttggggacaaggaggggaatgcagccggcaatggcttcctcctgttggattcagagtttaatgtcaaagggcgttgggaaaagccaggtcacagccccttgtttggctatgacttctggtaccagcctcgtcacaagacgatgatcagttcaacatggggagcccctgcagccttcaggacaggtttcaatcttcaacatgtccaggatggtctctacggaaggcatcttcatgtgtatgactggcctggtggtgagctcaagcagacccttgatttaggagacacgggacttcttccccttgaggtgaggtttttacatgacccatcaaaggacactggttacgttggatgtgctttgacaagcaacatggttagatttttcaaaactgcagatggatcatggagccacgaggttgctatcgatgtaaaaccactgaaggtccgcaactggattctgccagaaatgccaggattgataactgattttgttatttctcttgatgaccgctatctctacttggtcaattggcttcatggggatatcaggcagtacaacattgaggaccctgccaagcctgtcttggcgggacaagtatgggttggtgggcttcttcagaagggcagcgatgtcgtctatgttactgatgatggccaagaagaacagtataatgtgccccaggtcaaggggcatcgacttagaggtggacctcagatgattcagctgagcttggatggcaagaggatatatgtaaccaactcacttttcagccgttgggatgagcagttctatggtgatgatcttgtcaagaagggctcccacatgctgcagatcgatattgacactgagaaaggaggactggctatcaaccccaacttcttcgtagattttagcaaggagcctgatggtcctgccttagcccatgagatgagatatcctggtggggactgcacgtctgatatatggatctaaggtcatggattggcataatagtctgctggaggtccttgttgtatgcactgtaattaagatggtattatacagtgtttcatcttgtactgtgactactgccactggaataagccatggtttcatgagagcttgagcttaataaaagatgtctcggttctg

SEQ ID NO: 17977 - protein, 492 aa, Panicum virgatum
  misc_feature: Ceres CLONE 1795339
  misc_feature (23)..(492): Pfam Name: SBP56 Pfam Description: 56kDa selenium binding protein (SBP56)
MAGAAAVDVPAPAAANGGACCHAAKGPGYATPLEAMEKGPREKLIYVTCVYNGTGINKPDYLATVDLDPNSPTYSQVIHRLPVTHIGDELHHSGWNSCSSCHGDPSAERRFLILPSLLSGRVYVVDTATDPRAPSLHKVVQAEDIAEKTGLGFPHTSHCLASGDIMISCLGDKEGNAAGNGFLLLDSEFNVKGRWEKPGHSPLFGYDFWYQPRHKTMISSTWGAPAAFRTGFNLQHVQDGLYGRHLHVYDWPGGELKQTLDLGDTGLLPLEVRFLHDPSKDTGYVGCALTSNMVRFFKTADGSWSHEVAIDVKPLKVRNWILPEMPGLITDFVISLDDRYLYLVNWLHGDIRQYNIEDPAKPVLAGQVWVGGLLQKGSDVVYVTDDGQEEQYNVPQVKGHRLRGGPQMIQLSLDGKRIYVTNSLFSRWDEQFYGDDLVKKGSHMLQIDIDTEKGGLAINPNFFVDFSKEPDGPALAHEMRYPGGDCTSDIWI

SEQ ID NO: 17978 - DNA, 867 bp, Panicum virgatum
  misc_feature: Ceres CLONE 1795341
  misc_feature: Encodes the peptide sequence at SEQ ID NO. 17979
actgatcctcctccccgcgctcttcgcaagacatagaagaatcccctactactactactactactactactactactcatgcatgagcaccgcctcctcgcgccgcatatgaatcagacatgaataggggccacagcagcagctcctcgaagctcatcaacgagaagcttgaggaacaccggatctccaccgccaagcactgcccccactgcggcgagaaaatcgacagcaagccggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgaccagggatggcctgagcaagcacttcttccaccggccatcaaaggcctatacgacgggcacgaggaagaggaggaagatacagacggagtgcgacgtccacaagggcgagacgaggtggcacaagaccggaaagacgcggccggtaatggtgaacggccggcagaaggggtgcaagaagattctggtgctgtacaccaacttcggcaagcaccgcaagccggagaagacgaactgggtgatgcaccagtaccacctcggcgacctcraagagaagaagkagcgtgagctgcatttttgctagatctttcataccaaaccagacctcgatggtgtacttgtccttacaaacgtgactgcgacgccgctgccctcgatcccacgacggtgtagcagctgctcatgaacgatatcatgctgttctgatcgtcttcgcggaataaatagga

SEQ ID NO: 17979 - protein, 200 aa, Panicum virgatum
  misc_feature: Ceres CLONE 1795341
  misc_feature (44)..(187): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 1713 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Functional homolog of the protein sequence given in SEQ ID NO 50710
  misc_feature: Useful for making plants with altered carbohydrate content
  misc_feature: The sequence is a functional homolog of SEQ ID NO 562 in the 11/435,388 US patent application
  misc_feature (190)..(190): Xaa is any aa, unknown, or other
  misc_feature (194)..(194): Xaa is any aa, unknown, or other
MNRGHSSSSSKLINEKLEEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLXEKKXRELHFC

SEQ ID NO: 17980 - DNA, 660 bp, Panicum virgatum
  misc_feature: Ceres CLONE 1795341-R
  misc_feature: Encodes the peptide sequence at SEQ ID NO. 17981
gtataggtggtgatcaggtgccatctaatcagcttggacgatcagaacagcatcatgccgtccaggagcagcagccacaccgtccggtgatcgcgaccatggccgtcccagccacggctttcctgatcagtaggccatcgaaccctgtttcgactattgtgccacctgcaatgcagcacacgtcagttgttctcgatcatgatcagttccatgtgccagcaatccttctacatcaccacgacaaatttcagcatcaacaccaacagcaacaaccacagcaaaagcttgaccgcaggtctgccggcttggaagaattgataatgggttacacgtcatccacaagcacaaaaggggaaacttcaatccctcagtcccaagagacagaatggccttacccttactggccgcctgacaaccaagatcatcatggatagtatcaacaaggctgttaaatagtggcaatcaataccaaaactaaccacaccactttcaatgggttggtatttgtccccttgaatatactgggcgttgctttaatttcttggagaatgtactgccgaagataaagaaaacagatctatgcagatctctccctcaatgaaaagaagatgataaaattaattgttgtgaactcttcaaggcagaagatcagaaagcgtg

SEQ ID NO: 17981 - protein, 143 aa, Panicum virgatum
  misc_feature: Ceres CLONE 1795341-R
  misc_feature: The sequence is a functional homolog of SEQ ID NO 1710 in the 10/374,780 US patent application
  misc_feature: The sequence is a functional homolog of SEQ ID NO 1713 in the 10/374,780 US patent application
IGGDQVPSNQLGRSEQHHAVQEQQPHRPVIATMAVPATAFLISRPSNPVSTIVPPAMQHTSVVLDHDQFHVPAILLHHHDKFQHQHQQQQPQQKLDRRSAGLEELIMGYTSSTSTKGETSIPQSQETEWPYPYWPPDNQDHHG

SEQ ID NO: 17982 - DNA, 1618 bp, Panicum virgatum
  misc_feature: Ceres CLONE 1795346
  misc_feature: Encodes the peptide sequence at SEQ ID NO. 17983
agggtctaaatctgagcccagtacgacactgcctgcctcgtcatcgtctcgtctccccgtcttctcgtccgactcctgattaaagctcgtaaaaacctcgcgagaagcggcgagagcacagtttctagtttgttcgctgtttccgccccaaatctgctgcgggctcaagccgaattgaagccgatcggagcggcggcggcaatggcggggctgtcgctgcggtgcggcgactgcggcgcccagctgcggagcgtggaggaggcgcaggcgcacgccgaggtcaccaaccacgccaacttcgtcgagtccaccgaggccgtcctcaacctcgtctgctccgactgcggcaagccatgccgctcccagaccgaggtggacctgcacaccaagcgcacgggccacaaggatttcgcggacaagaccgccgaggcggccaagcccatcgatctcgaggcgccgctcaagccggcctcctcctcggaggccatggacgtcgacgccctggcctcggcaagcgaggagcctcaagagatggtggtgccggaggtgaacaaggagatgctcgccgacctcgaggccatggggtttgccactgcgcgtgccactagggcacttcatttctccggtaatagcaccatcgaaggtgccatcaactggctttctgagcaccaggaagatgcagatattgatgaaatgcctctggtaccagctacttcaaagacggaggctaacaaacccagcctgactcctgaggaaatgaagattaaagcgcaggagctaagggaacgcgctcgtaagaagaaagaggaagaagagagaagaatggaaagagaaagggaaaaggaaagaatacgaattggtaaagaacttcttgaagccaaaagaattgaggagcagaatgaaagaaaacgcatgattgagttgcgaagacttgagaaagaagaggagaaaagggctagagaaaaaatccgccagaaactggaagaagataaggctgaaaagagaaggaaactaggattgccaccagaagacccagcagcttccaaaccaagtgcaccacctcctgttgaagagaagaagagtgcattgcctatcaggccagccacaaaggcagaacggatgagggattgtctacgaaatcttaagcaacagaacaaggatgatgatgccaaagtgaagagggcatttcaaacactccttacttatattggaaatgttgctaaaaatcctgatgaggagaaattcagaaagattagactcacaaatgctacatttcaggagagggttggaaatctgcatgggggcatagagttccttgagctctgtggatttgagaagcttgaaggcaacgagttcttgtttctaccaagggacaaggttgacaaggccatcctgaacacggctggagccgagctgaactctgcaatcaccaatcctttcttcggagtcctttgagttgtcgagaacctcaatgtatacacaaacctcttggcttcacctttacttttgcatgcaagtaacatacatatttcacgaatgattgcagtctacatccatacatattccttccgtacattatactattgatgaggcgaattttaccctgctatagcatcag

SEQ ID NO: 17983 - protein, 417 aa, Panicum virgatum
  misc_feature: Ceres CLONE 1795346
  misc_feature (116)..(153): Pfam Name: UBA Pfam Description: UBA/TS-N domain
  misc_feature (108)..(181): SWISSPROT Homolog: EC 3.1.2.15 Ubiquitin thiolesterase
  misc_feature (332)..(404): SWISSPROT Homolog: EC 3.5.1.52 Peptide-N(4)-(N-acetyl-beta-glucosaminyl)asparagine amidase
MAGLSLRCGDCGAQLRSVEEAQAHAEVTNHANFVESTEAVLNLVCSDCGKPCRSQTEVDLHTKRTGHKDFADKTAEAAKPIDLEAPLKPASSSEAMDVDALASASEEPQEMVVPEVNKEMLADLEAMGFATARATRALHFSGNSTIEGAINWLSEHQEDADIDEMPLVPATSKTEANKPSLTPEEMKIKAQELRERARKKKEEEERRMEREREKERIRIGKELLEAKRIEEQNERKRMIELRRLEKEEEKRAREKIRQKLEEDKAEKRRKLGLPPEDPAASKPSAPPPVEEKKSALPIRPATKAERMRDCLRNLKQQNKDDDAKVKRAFQTLLTYIGNVAKNPDEEKFRKIRLTNATFQERVGNLHGGIEFLELCGFEKLEGNEFLFLPRDKVDKAILNTAGAELNSAITNPFFGVL

SEQ ID NO: 17984 - DNA, 1837 bp, Panicum virgatum
  misc_feature: Ceres CLONE 1795350
  misc_feature: Encodes the peptide sequence at SEQ ID NO. 17985
aaagcttattagaccgtccacaacggccggagtatccggtggagcaaaatgctcctttccctcctcgtttcccgtgcctccactgtttacagtgccaaacagtacatctacagtacatatacagtacaaatgctcctccatttgctccatccaatgtggatagccttacaggcatttgcttctagtctagtagtccccaagcacgaactgatttttccggttctggtggagcagcggattaagctcgcaggataattaaccagatttcctctagctaaccatctcttttcttgagcttggtgatcggctcgacttgtgtgtacatacacacatacgcactctacctggtaggacggttgattgatccatcgataggcataggaagaagatgatgcgcggagccagagagcagagggtggccttctcgccgatgaaggaggccgcggcggtgcccaaggaggaggtgtgggaggtccggccggggggcatgctggtgcagaagcggagccccgacgcggacccgccccccggcggcgcgcccgtgcccaccatccgcgtcaaggtcaagttcaacggcgtctaccacgagatctacatcaacgcccaggcctccttcggcgagctgaagaagctgctgtcggagaagacgggcctgcacccggacgaccagaaggtggtgtacaaggacaaggagcgcgactccaaggcgttcctcgacatggccggcgtcaacgaccgctccaagatgctcatgctcgaggaccccgccgccaaggccaagcgcctcctcgaggagcgccggaccagcaaggccgagcgcgccgccaaggccatcgcgcgcgtcgcgctcgacgtcgacaagctcgccaccaaggtgtcggcgctggagacgatcgtgagcaagggcggccaggtggtggacgccgacgtggtggcgctgacggaggccctgatgaacgagctcgtgaagctggactccatcgccgccgacggcgaggtgaaggcgcagcggcgggcgcaggagaagcgggtgcagaagcacgtggagacgctggacgccatccgcgccaagcagagcaaggcgagcggcaaggcgcggccgccgcgccagcccccggcggcgcagcagcagcagcagcgccggcagttccggccgccggcgcccaccaccgcgacggccccggcgccgcagacgcagacggcgagctgggagacgttcgacctgctgtcgtcggtgccgtcgacgtcggcggtccccgtgacgaccatggcccccgcgaccaccaccacgccgtccccgcggttcgagtgggagctcttctagaacggaggcgcccgcctgctgctgctggtcccccctctcccgcgccccgccacatgtgtgtgcctgcctgtccattggctcggccggtacctttcttcttgtccattcacctcggcaatggtgcaagtcaatcgccattgcttctttctttcttctcctctttattcgttctttctttctttctctccgtcctttgttgagtgtatattgatctgatctccacaaaagagaaggaaaaaaaggcaagaactgcatagtgaggtgaagaaactagaagcaagcacatccatggtgttgttgtctgtctgtctgtctgcaaaataagtggtggcctggccttgcgatcgattgacaaaggatttttcccatgccatatgtgtacagtagcagtacaatgtacagtgtacatgaatcaaaacaatctcccaacacacacatttgtttgtgccgtgtgtactgtagatggatggatggatggttcttcctgttggaaataaatatttcagttaagac

SEQ ID NO: 17985 - protein, 311 aa, Panicum virgatum
  misc_feature: Ceres CLONE 1795350
  misc_feature (145)..(226): Pfam Name: BAG Pfam Description: BAG domain
MMRGAREQRVAFSPMKEAAAVPKEEVWEVRPGGMLVQKRSPDADPPPGGAPVPTIRVKVKFNGVYHEIYINAQASFGELKKLLSEKTGLHPDDQKVVYKDKERDSKAFLDMAGVNDRSKMLMLEDPAAKAKRLLEERRTSKAERAAKAIARVALDVDKLATKVSALETIVSKGGQVVDADVVALTEALMNELVKLDSIAADGEVKAQRRAQEKRVQKHVETLDAIRAKQSKASGKARPPRQPPAAQQQQQRRQFRPPAPTTATAPAPQTQTASWETFDLLSSVPSTSAVPVTTMAPATTTTPSPRFEWELF

SEQ ID NO: 17986 - DNA, 1618 bp, Panicum virgatum
  misc_feature: Ceres CLONE 1795352
  misc_feature: Encodes the peptide sequence at SEQ ID NO. 17987
ggattgaccgattgagggagccgcccacttctgcatcgaccgccgccgtgatggcgagagacagatctccgacgaattcgccgccggcgaaacgccgcatggactccagcaccaccactaccgtcgcttccctcggcgaggacatcctgctcgagatcttcctccgcctcccctgcctcgccacgctcgtccgcgccgccctcacctgccgcgggtggcgccgcgcggtggcctcctctccggccttccgccgccgcttccgccagcttcacccggcgcccctcctgggcctcttcttcaacccccccggcgccgtccaggagcccgcgctccccgccttcccctccttcgtccccacccgcggcaccgaccgggaccaagccgccgccgtccggggcggcgacttcttcctcacctccctccagcagcgccgccccggagtccacaacggctgggacatccacgactgccgcggcgggtacgtcctcctcgccaatggtgatcaggaaacaatggcggtggtcaatcccttggcgcggcggagcgaaaggttcttcgattatggccacggggacacccttgaaggtcaccgcgtctacgccgtgggacatagagcctgcttgctctgctccgacgaaaaccccacgtcgttccgggtggtcattattgcccatgacaagtccagggtgcgggctactgtcttctgctcggacaccggcgagtggtccattcgcccgtgggtgcatatcccggggaagccacggcggggccgcggagaagggtggattcggagttgcaacgtgcaggctcaaggattcttgtactgggtttacaagaatcgcaagcatatgctcacactggacactgcaacaatggatttctctgtcgatgagctcccaattttcctgcagaatcgatcctgcagctttgttgtgggtgaaatgaaaaatggtgagccctgcattgtctatgctattaacttcacagtcggcgtgctgttgcgcagagcagagaatcatggtgttgataggtgggtgctggacaaggccgaactcttggagacacagcttggtcaggtccttggcaatgtaatggaggactacaataaggtggaggttgtgggagtaagggatggctttgtgtacttggcaacattagatgagttaaatgattctagtactcctagttggttcttgtctctctgcttggaaaccatgatattggagaagctttttcagaggacgtacgacagttcagtgcatccctacattatgccatggccgccttctttagtaggtaactaggggaggtttgcactgaagatggtacgtgaaatgcatgggcatcactacccaacaaatgtgatacaaggaagaagaggggcagctagtagaaccaacctcctacagtgagatgccataacaactgcattcctctgaagctgcatcatgctgaagagtcacatctaattccatgatgctgaagattctgtcgccagttaatcatacaagttgatcttttgcgcttgttatttttgttcaattaccagttttcatgattggtgtgatggttctgaacttgattctatttcataagttcgctactgagccttttttag

SEQ ID NO: 17987 - protein, 417 aa, Panicum virgatum
  misc_feature: Ceres CLONE 1795352
  misc_feature (23)..(71): Pfam Name: F-box Pfam Description: F-box domain
MARDRSPTNSPPAKRRMDSSTTTTVASLGEDILLEIFLRLPCLATLVRAALTCRGWRRAVASSPAFRRRFRQLHPAPLLGLFFNPPGAVQEPALPAFPSFVPTRGTDRDQAAAVRGGDFFLTSLQQRRPGVHNGWDIHDCRGGYVLLANGDQETMAVVNPLARRSERFFDYGHGDTLEGHRVYAVGHRACLLCSDENPTSFRVVIIAHDKSRVRATVFCSDTGEWSIRPWVHIPGKPRRGRGEGWIRSCNVQAQGFLYWVYKNRKHMLTLDTATMDFSVDELPIFLQNRSCSFVVGEMKNGEPCIVYAINFTVGVLLRRAENHGVDRWVLDKAELLETQLGQVLGNVMEDYNKVEVVGVRDGFVYLATLDELNDSSTPSWFLSLCLETMILEKLFQRTYDSSVHPYIMPWPPSLVGN

SEQ ID NO: 17988 - DNA, 2961 bp, Panicum virgatum
  misc_feature: Ceres CLONE 1795362
  misc_feature: Encodes the peptide sequence at SEQ ID NO. 17989
gaccagtggagtcgcgagccagacaaacccagcagcacatacacacacgtacacccccgcctctcctcagaataaacagcaaaaaaaggcaagccaagaagaatcaatcgccagcaccaagggcggagatccaaatcgccgcaaaaggagcctccaactcgcttcgcccgcaaggaaatccctccgcgcgatcgggagcaaaccagttgggggttagagaaaaggctaagaaatggaatcgacttatgccactgaagagagtaactacaatgactattctgcaaatgcatcttcatctccaacaggaagttcagaaacttcagtcgatttaccaacttctacagccaaggaagttcctggcaatattgcttatgaagggccaaggggacatgaggtcccagaaatgcggcttcctgatctaacagaagaccatgtggaatcaaatgcgccttcagatacaggtcctgaaatgctgactaattcaggacgaactgaggcattcataagctcaacaaatgataaggcagatcctcctccttcagcagatgcaattgaagtgatcagtatgcctgtaaatgtcccaaatggtactggagctattctaagagctgaaaggaaacccaaagaagataagacacattatcagactgatatggctagaaagatgaaaaggaaagatgattcagaaacagcacctgaaagtccataccgaggccttgttgatactgcagcaccttttgagtctgttagggaagctgtcaccaagtttggaggcattgttgattggaaagctcataaagctcagatgatcgagagatgcaagttcatacaacttgaacttgaaaagattcaaacagaaattccactttgcaaggaggaactagaagcagctgagacggctaaatcccaagttgttgatgagctagagcacaccaagagactcattgaggagctgaagcatcacctggagaaagtacaggttgaagaagctcaggcaaagcaagattctgagcttgcacaactcagggcacaagaaattgagcatggaatagctgatgaagctagtgcgatagccaagacgcaaatggaagtcgctaaagaaagacatgaaaaggctgttgctgaactcaagtcagtaaaagaggaattgaggtcagtacatgaacaatatgctaccctaatcgatgaaagagacactgcaatcaaaagagcagaagaggttatatctgcaggaaaggagattgagaagcgagtggaggaactgactttagaattgattgcatctaaaggatctcttgagttggcccatgctgcacatcatgaggcagaggaacgcaggatcagtgctgcattgttgaaggagcaggattgccttgcttgggagagagggttgcgtcaggcacaagaggagctgcaacaactagacagtaagctcgcgtccaataaaaatatgcagctcaatatagatgcaaatttgcgcaagttgcttaacctcaactcggagctgtctgcctatatggagagcaaactgattgaagaagctgaaggagcttccaaggagcatgagtctgaaggtgctaaacaaaatagcagttcgattaaggaagctctagcatcaaaacagaaagagcttcaggaggtcaaagagaacattgagaaggcaaaggctgaggccagtgtgttaagatttgctgccatgacactcagatcagaactagacaatgagaaagattcacttgtctcgttgcaacagggggaggctatggcatcagttgcagtttcttcactagaagatgaacttaaccggacgaaacaagagatagaatctgttaggtccaaggaagcagaggcccaagaaaagatggtggagcttcccatggttttacagcaagcaactcaggaggccgaggatgccaaggtagcagctcagttagctcaagaggagctgacgaaggccaaggaggacttcaagcaaacaaaggctgcggcagctacagcagagaccaggctatctgctgttgtaaaagaagcagaagcgtccatagcctcggagaggctagcgctcgcggcagttcaagcgttgcaagaaagcaaagaggcgagagacgttaagaattctccgagacaagtaacacttcctttaagcgagtattatgaactcagcaagagagcacatgaagctgaagaacaggccaatgagaaggtggcagaagcattggcacaggtggtgtcggcaaaggaatcagaatcaaggagccttgagagactaaagaaagtgtccggggaaatggatgagaagaaagaagctcttgaaatcgcattggagagagatgagagggcgaacgaagggaaactagctgcggagcaagaactgaggaaatggagagctgaccatgaacagcgccgcagagctctggaagccgcgaaatgtgcagtgaatcctttgaatggtccatctagggtatttgttgtacagaaagatccataccacaacgagcaggagtccaagctacagatgtcaggaagtagctacgagagccttgctccaaatcaaaagttgcagaggaagaaatcgctgttccctatgatgggttcggttctatccagaaagacccgggcacagacgtgagataacaatacctagactcctaggacttcagaaacttcattgctgtacattgctgtaataagttgattttttttctggtcttgtttcaaaagagcatttatttatttatttattttgtcttacaacttggtgtccggtggaaggtgtaatttgttggtataaacaccggacggcgtactagaatatgtgtataccattttttttgggtaactcagtaggtattcatgaattttgtgaggaaattgttcgtgtcatgcagtccagtggaggtgtacctctctattctgtaatgtttctctgaaactgaactgtttgaagtgagctggttacat

SEQ ID NO: 17989 - protein, 798 aa, Panicum virgatum
  misc_feature: Ceres CLONE 1795362
  misc_feature: SWISSPROT Homolog: EC 2.7.11.1 Non-specific serine/threonine protein kinase
MESTYATEESNYNDYSANASSSPTGSSETSVDLPTSTAKEVPGNIAYEGPRGHEVPEMRLPDLTEDHVESNAPSDTGPEMLTNSGRTEAFISSTNDKADPPPSADAIEVISMPVNVPNGTGAILRAERKPKEDKTHYQTDMARKMKRKDDSETAPESPYRGLVDTAAPFESVREAVTKFGGIVDWKAHKAQMIERCKFIQLELEKIQTEIPLCKEELEAAETAKSQVVDELEHTKRLIEELKHHLEKVQVEEAQAKQDSELAQLRAQEIEHGIADEASAIAKTQMEVAKERHEKAVAELKSVKEELRSVHEQYATLIDERDTAIKRAEEVISAGKEIEKRVEELTLELIASKGSLELAHAAHHEAEERRISAALLKEQDCLAWERGLRQAQEELQQLDSKLASNKNMQLNIDANLRKLLNLNSELSAYMESKLIEEAEGASKEHESEGAKQNSSSIKEALASKQKELQEVKENIEKAKAEASVLRFAAMTLRSELDNEKDSLVSLQQGEAMASVAVSSLEDELNRTKQEIESVRSKEAEAQEKMVELPMVLQQATQEAEDAKVAAQLAQEELTKAKEDFKQTKAAAATAETRLSAVVKEAEASIASERLALAAVQALQESKEARDVKNSPRQVTLPLSEYYELSKRAHEAEEQANEKVAEALAQVVSAKESESRSLERLKKVSGEMDEKKEALEIALERDERANEGKLAAEQELRKWRADHEQRRRALEAAKCAVNPLNGPSRVFVVQKDPYHNEQESKLQMSGSSYESLAPNQKLQRKKSLFPMMGSVLSRKTRAQT

SEQ ID NO: 17990 - DNA, 2368 bp, Panicum virgatum
  misc_feature: Ceres CLONE 1795363
  misc_feature: Encodes the peptide sequence at SEQ ID NO. 17991
aggaagagcttcgcagtcctccacacaacctcccgagctcttcttcttaccaccaccaccacacccaaaccccagctcctcctccttttctcctccgtagtcgaaatggcgagcaacacggccatctgcgagagcgacccgctcaactggggcaaggcggccgcggaaatggcggggagccacctcgacgaggtgaagcgcatggtggcgcagttccgcgagcccctcgtcaagatcgagggctccagcctccgcgtcggccaggtggcggccgtggccgccgccaaggacgcgtccggcgtggccgtcgagctcgacgaggaggcgcgcccccgcgtcaaggccagcagcgagtggatcctcgactgcatcgcccacggcggcgacatctacggcgtcaccaccggcttcggcggcacgtcgcaccgacgcaccaaggacgggcccgcgctccaggtcgagctgctcaggcatctcaacgccggaatcttcggcaatggttccgacggccacacgctcccgtccgaggtgtcacgcgcggccatgctcgtccgcatcaacaccctgctccagggctactccggcatccgcttcgagatcctcgaggccctcaccaagctcatcaacaccggcgtcagcccgtgcctgccgctccggggcaccatcaccgcgtccggcgacctcgtcccgctgtcctacattgccggcctcatcaccggccgccccaacgcgcaggccgtcaccgccgacggcaggaaggtggacgccgccgaggcgttcaaggtcgccggcatcgaggggggcttcttcaagctcaaccccaaggagggtctcgccatcgtcaatggcacgtccgtcggctcggccctcgccgccatggtctgcttcgacgccaacgtcctcgccgtcctgtccgaggtgctgtccgccgtcttctgcgaggtcatgaacggcaagcccgagtacaccgaccacctcacccacaagctcaagcaccacccgggctccatcgaggccgccgccatcatggagcacatcctggacggcagctccttcatgaagcacgccaaggaggtgaacgccatggacccgctcctcaagcccaagcaggaccggtacgcgctccgcacgtcgccgcagtggctgggcccccagatcgaggtcatccgcgccgccaccaagtccatcgagcgcgaggtcaactcggtcaacgacaaccccgtcatcgacgtccaccgcggcaaggcgctccacggcggcaacttccagggcacccccatcggcgtgtccatggacaacgcccgcctcgccatcgccaacatcggcaagctcatgttcgcccagttctccgagctggtcaacgagttctacaacaacgggctaacctccaacctggccggcagccgcaaccccagcctggactacggcttcaagggcaccgagatcgccatggcgtcctactgctccgagctccagtacctggccaacccgatcaccaaccacgtgcagagcgcggagcagcacaaccaggacgtcaactccctcggcctcgtctcctccaggaagaccgccgaggctgtggacatcctcaagctcatgtcgtccacctacatggtcgctctgtgccaggccgtggacctgcgccacctcgaggagaacctcaagagcgccgtcaagagctgcgtcacggcggtggcccggaaggtgctgaccaccagccccgacggcgacctccacaacgcccgcttcagcgagaagtccctgctcacggccatcgaccgcgaggcggtgtacggctactacgacgacccctgcagcgccaactcgccgctgatgaagaagatccgcgccgtgctggtggaccacgccctcgcgaacggagaggccgagaaggacgccagcgcgtcagtcttctccaagatcaacaagctggaggaggagctccgcgaggctctgcccagggagatggaggccgcccgcgtggccttcgagaccggcacggcgccaatcgccaacaggatcgaggagagccggtcgtacccactgtaccgcttcatccgccaggacctcggcgccgtctacctgaccggcgagaagctcaagtcccccggcgaggagtgcaacaaggtgttcctggccctcagcgagggcaagctcatcgaccccatgctcgagtgcctcaaggaatgggacggcaagcccctgcccatttgctaagctgagcaccggcgccgcgccgccaagaggaggaggagatcacactcaccgtacgcgaggaataaagatgggggggtttcagtattctgaaggcttcttattattgtttgtgactttgcagattattatatgttgcttgtctgttcgtccc

SEQ ID NO: 17991 - protein, 703 aa, Panicum virgatum
  misc_feature: Ceres CLONE 1795363
  misc_feature (41)..(540): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Functional homolog of the protein sequence given in SEQ ID NO 50787
  misc_feature: Useful for making plants with altered cell wall content and/or composition
  misc_feature: Useful for making plants with altered lignin content
MASNTAICESDPLNWGKAAAEMAGSHLDEVKRMVAQFREPLVKIEGSSLRVGQVAAVAAAKDASGVAVELDEEARPRVKASSEWILDCIAHGGDIYGVTTGFGGTSHRRTKDGPALQVELLRHLNAGIFGNGSDGHTLPSEVSRAAMLVRINTLLQGYSGIRFEILEALTKLINTGVSPCLPLRGTITASGDLVPLSYIAGLITGRPNAQAVTADGRKVDAAEAFKVAGIEGGFFKLNPKEGLAIVNGTSVGSALAAMVCFDANVLAVLSEVLSAVFCEVMNGKPEYTDHLTHKLKHHPGSIEAAAIMEHILDGSSFMKHAKEVNAMDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLANPITNHVQSAEQHNQDVNSLGLVSSRKTAEAVDILKLMSSTYMVALCQAVDLRHLEENLKSAVKSCVTAVARKVLTTSPDGDLHNARFSEKSLLTAIDREAVYGYYDDPCSANSPLMKKIRAVLVDHALANGEAEKDASASVFSKINKLEEELREALPREMEAARVAFETGTAPIANRIEESRSYPLYRFIRQDLGAVYLTGEKLKSPGEECNKVFLALSEGKLIDPMLECLKEWDGKPLPIC

SEQ ID NO: 17992 - DNA, 1250 bp, Panicum virgatum
  misc_feature: Ceres CLONE 1795366
  misc_feature: Encodes the peptide sequence at SEQ ID NO. 17993
atccatccgaatccccaattcccaatcatcccctccgcgaaattctccgcccgatcgaagcgaagccaaaggagcctagcccccatcctctcaggatgcagatcttcgttaagaccctcactggcaagaccatcaccctcgaggttgagtcctcggacaccattgacaatgtcaaggctaagatccaggacaaggaaggcatccccccggatcagcagaggctcatctttgctggaaagcagctcgaggatggtcgcactcttgcagactacaacatccagaaagagtccaccctccacttggtgctcaggctcaggggaggcatgcagatctttgtcaagaccctcactggcaagaccatcacgcttgaggtcgagtcttctgacaccattgacaatgtgaaggccaagatccaggacaaggagggcatccccccagaccagcagcgtctgatctttgctggcaagcagctggaggatggccgcacccttgctgactacaacatccaaaaggagtccactcttcacttggtgctccgtctgcgtggtggtatgcagatttttgtgaagaccctgactggcaagactatcacccttgaggttgagtcctcagacacgattgacaatgtgaaagcaaagatccaggacaaggagggcatccccccggaccagcagcgtctcatctttgccggcaagcagcttgaggatggccgcacccttgctgactacaacattcagaaggaatccacccttcaccttgtgctcaggctcaggggtggtatgcagatctttgtgaagaccctcaccggcaaaaccattaccctggaagttgagtcatctgacactatcgacaacgtgaaggcgaagatccaggacaaggagggaatccccccggaccagcagcgtctgatttttgctggcaagcagctggaggatgggcgcaccctggcggactacaacatccagaaggagtccaccctccaccttgtgctccgcctccgtggtggccagtaagttctgagggccatggagctgctgttatccctgggttcacaagtctggtgcttcctttgtctctcgaatggaggggttgtctctgtgtaccgtggtctgtcctggtcttgtggtgcgggtgtcttcgcctgtcctgatggaagtcctatgtggtctggttgtgtctgaacatttgctgctgtgcagcatgctacttggttgaattgtgatgaataagtgaaccctgaacttcgtgcg

SEQ ID NO: 17993 - protein, 336 aa, Panicum virgatum
  misc_feature: Ceres CLONE 1795366
  misc_feature (37)..(105): Pfam Name: ubiquitin Pfam Description: Ubiquitin family
  misc_feature (113)..(181): Pfam Name: ubiquitin Pfam Description: Ubiquitin family
  misc_feature (189)..(257): Pfam Name: ubiquitin Pfam Description: Ubiquitin family
  misc_feature (265)..(333): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
PSESPIPNHPLREILRPIEAKPKEPSPHPLRMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 17994 - DNA, 2254 bp, Panicum virgatum
  misc_feature: Ceres CLONE 1795382
  misc_feature: Encodes the peptide sequence at SEQ ID NO. 17995
agctaggctctctctctcccatccatctcgtccccattgcatgcgaaacaagcaagctagaggtcaaggagggagcgagcgagtggcgtttggtgtgaagtgaggactcgtggaggacgaagcgagcgagagggagtcatggcatggtgctaatcactttgcccctaggtaccgtactggcgtgcgcgcaggcatcagtcacctcccccctccaaactctcacctaatctcccctcctctccgctttctcctcctcccccagcttctccctccttcccgagctgctttcttgttttttttatccgtctcctagctctagattttgaaaaatattatctctggcgagcaacctagctaactactagctcagaccgaggccgtgctttctcgcttaatttccatgttaccactagtgctctaatcttagctaaagccttgctgagtgccttgcagtgctgggaggaggaggacaaggtctctgatcaactgagcttgtctggtcaaagccgagtccaagctcgacaggaccaccgccactgtgaagcacagcggcagcggcgacaagacaaggaggcggaagctgccaagcggatagatctacgcaaatggagaccaaggacgtggccccgctccccgccgccaccgccgccggcgccgccgcgcccgtgcccgcaccggcgtctcagccgccgcagtcttctatgccgccgccgcagcaacagcaccagcagcctccgccgccgccgttcgcgcagcagcaggcggccccggcgccgtcgcctggggctcccatgcccggcggcatgcgcctctcgttcgaccacatggcggggaagacggagcaccaccaccacgcggcgcccatgctgtacgcgccgccgccgcagtccactgcgggcgcgggagcgccgggcgcgccggggggcaatgtgctgggcatgggcgacctgatacgcaagaagcgcgggcggccgcgcaagtacgcgcccgacggcagcatggccctggcgctggcccccatctcctccgcctccgccggcggcgccgcggcccccggccagcagcagcacggcgggttctccatcagcagccccccgtccgaccccaacgccaagcgccgcggcaggcccccaggctccggcaagaagaagcagttcgaagccctgggttcttggggcatcgccttcacccctcacatcctcacggtcaaggccggcgaggatgttgcatccaaaataatgacgttctcacagcaaggtcctcgcacagtctgcatcctttctgctaatggtgcaattagcaatgtaactcttcggcagcctgctacatctggtggattagttacttatgagggccgctttgagatcatctcactatctggttctttcctgcttgcggaggatggtgacactcgcagcaggactggtggtttaagtgtggcacttgcaggatctgatggacgagttcttggaggatgtgttgctggaatgctcatggcagcaactcctgttcaggttgtggttgccagtttcatcgctgagggcaagaaatcaaagccagccgaggcacggaaggtcgaaccaatgtctgctcctccaccacagatgcctaccttcgttccacctccagtggccaccaaccctccatcggagggcacatccagtgcatcatctgatgactctggcagcctgatgaaccacagcgccatgcccttcaaccactccggccagcaccagcaccctcaccagcaccagcacatgccgcctgcctatgcgtctggtggctggtccctctcggcgcaccagcagaacaggcatgactctgacatgaagatgatgtcgaactaacactgctcgaccctaagtgccccatttctggttggggctggagaggaagctgctgatggggttgattggtactgctactatggatgatccttttgggtcgtctgctctgatcggtggtgacggtgtatctgctatagctaagctagctaggagagtagggttcatggtctcacctgctgttgtttccccgagtaagattaatttaattcgaattagccgccgttgtaatgctgtagttttgtcctaaaagtctgtctgtcaggccctaacgcgagttgtgatggatgcctgatgagatgttcacctcctaggctagttaaaataccattctctagtgttatggatcatggatttacttaaatgctctgtttaattcaggatggtatccagttttgtttcgttccctt

SEQ ID NO: 17995 - protein, 351 aa, Panicum virgatum
  misc_feature: Ceres CLONE 1795382
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: The sequence is a functional homolog of SEQ ID NO 374 in the 10/374,780 US patent application
  misc_feature: The sequence is a functional homolog of SEQ ID NO 604 in the 10/225,066 US patent application
  misc_feature: The sequence is a functional homolog of SEQ ID NO 1446 in the 10/666,642 US patent application
  misc_feature: The sequence is a functional homolog of SEQ ID NO 2606 in the 10/374,780 US patent application
  misc_feature: The sequence is a functional homolog of SEQ ID NO 296 in the 10/225,066 US patent application
  misc_feature: The sequence is a functional homolog of SEQ ID NO 74 in the 11/375,241 US patent application
  misc_feature: The sequence is a functional homolog of SEQ ID NO 878 in the 10/412,699 US patent application
MPGGMRLSFDHMAGKTEHHHHAAPMLYAPPPQSTAGAGAPGAPGGNVLGMGDLIRKKRGRPRKYAPDGSMALALAPISSASAGGAAAPGQQQHGGFSISSPPSDPNAKRRGRPPGSGKKKQFEALGSWGIAFTPHILTVKAGEDVASKIMTFSQQGPRTVCILSANGAISNVTLRQPATSGGLVTYEGRFEIISLSGSFLLAEDGDTRSRTGGLSVALAGSDGRVLGGCVAGMLMAATPVQVVVASFIAEGKKSKPAEARKVEPMSAPPPQMPTFVPPPVATNPPSEGTSSASSDDSGSLMNHSAMPFNHSGQHQHPHQHQHMPPAYASGGWSLSAHQQNRHDSDMKMMSN

SEQ ID NO: 17996 - DNA, 2151 bp, Panicum virgatum
  misc_feature: Ceres CLONE 1795384
  misc_feature: Encodes the peptide sequence at SEQ ID NO. 17997
ataaaaggataagctccttgagcaagcaaaagcccacagaacgagggaggaggaggcgacttcatactgctccctcgccgtctttccctcaatctctcgaccttcccagctgccggcaatcgctgggccacgcgcagccgcagggaacccccacgccatggcctttcaggggaagaagctcatcaacaaccccgacgatgtagtgacggagtttatcgaggggctggtggaaacttacccgggcctgcagtacctggacgggttccctcagattaaggtcgttcttcgtgctgatgtagagcgtggcgcctatgataaggttgctgtcatttcaggtggtggaagtggccatgagcctgcccatgctgggtttgttgggccagggatgttgaccgctgctgtttctggagatgttttcgcttctccgcctgtggattctattttagctgctattcgagctgtaactggtcctatggggtgccttctgatagtaaagaactacactggtgatagacttaattttggattagctgctgagcaggcaaaatctgaaggctataagatggagatggttattgttggagatgattgtgcccttcccccacctagagggatagctggtaggagaggtttagccggaacagttcttgtgcataagattgctggggctgcagcagatgctggtttatctcttgcagatgttgccgcagaggcaaaacatgcatctgaggttgttggtacaatgggagttgcactttctgtttgcacattgcctgggcaagtaacatcggatcgtttgggtccaaagcaaatggagcttggccttggaattcatggggagcctggtgttgctgttgttgagctccagccagttgatgtagtggttgaacatgttcttaagcagatactgtcacaggaaactcagtatcttcctatcacaagggggagcaatgctgttctcctaatcaatggattaggagccactcctatcatggaacttatgattgcagcaagaaaagcagttcctgaattacaattggagtatggaattgctgttgacagggtctacactggcacacttatgacgtcacttgaaatggctggattatctatcaccattatgaagtctgatgaaaacattttgaagagacttgatgctcccactaaagctccggcttggcctgttggttctgaaggaaaccgcccaccagcaaagtttcctgttcctgtaccaccatcaccttcaatgaaggatgacgagattcttaatcaacctcaagagttgagcaagcaagggtgtatcctggaggctgctattgaagcaagtgctacagaaattatcaatctgaaggacatcctgaatgaatgggacaataaagtgggcgatggtgactgtggaaccacaatgtatagaggagcaacagctatacttgaagatatgaaaaagcgttaccctatgaatgatgcagctggaacaataaatgaaatcggggctacaatccgaagggtgatgggtggaacaagtggaatcttgtatgatatactcttcaaggctgcatatacaagcttaaaacagagcaaaactgttactgcaaatgaatgggctgatgctttagaggcctctgttgctgctgttagcaagtatggtggtgccagcgcaggataccgcacaatgttggatgccctaattcctgcttctactgtgctgaaacagagacttaaggctggggaggatcctgtgactgccttcatcgcatcttctgaagcagcatcagctggtgctgaatccactaaacagatgcaggcaaaggctggacggtcatcatacatcgctccagacctcctggtgtcagtccctgatccaggagcaatggctgcagctgcctggtaccgagctgctgctcttgcagtgaagaacaagctgcacggttcaaagagctagtagcgtctgatctgcttcaataccatactgacaggaagaatggccggggcattttctcacccccacacttcgatttggtttccgcttgtgctttgcatgagccgagaaagagacttccgtattgtttcacccttctcacatcgtacaaagagatggtcaatgagtttgtagacgctacaagttaagtgaaaccatgcttttgcactgcc

SEQ ID NO: 17997 - protein, 594 aa, Panicum virgatum
  misc_feature: Ceres CLONE 1795384
  misc_feature (22)..(345): Pfam Name: Dak1 Pfam Description: Dak1 domain
  misc_feature (407)..(583): Pfam Name: Dak2 Pfam Description: DAK2 domain
  misc_feature: SWISSPROT Homolog: EC 2.7.1.29 Glycerone kinase
MAFQGKKLINNPDDVVTEFIEGLVETYPGLQYLDGFPQIKVVLRADVERGAYDKVAVISGGGSGHEPAHAGFVGPGMLTAAVSGDVFASPPVDSILAAIRAVTGPMGCLLIVKNYTGDRLNFGLAAEQAKSEGYKMEMVIVGDDCALPPPRGIAGRRGLAGTVLVHKIAGAAADAGLSLADVAAEAKHASEVVGTMGVALSVCTLPGQVTSDRLGPKQMELGLGIHGEPGVAVVELQPVDVVVEHVLKQILSQETQYLPITRGSNAVLLINGLGATPIMELMIAARKAVPELQLEYGIAVDRVYTGTLMTSLEMAGLSITIMKSDENILKRLDAPTKAPAWPVGSEGNRPPAKFPVPVPPSPSMKDDEILNQPQELSKQGCILEAAIEASATEIINLKDILNEWDNKVGDGDCGTTMYRGATAILEDMKKRYPMNDAAGTINEIGATIRRVMGGTSGILYDILFKAAYTSLKQSKTVTANEWADALEASVAAVSKYGGASAGYRTMLDALIPASTVLKQRLKAGEDPVTAFIASSEAASAGAESTKQMQAKAGRSSYIAPDLLVSVPDPGAMAAAAWYRAAALAVKNKLHGSKS

SEQ ID NO: 17998 - DNA, 1501 bp, Panicum virgatum
  misc_feature: Ceres CLONE 1795385
  misc_feature: Encodes the peptide sequence at SEQ ID NO. 17999
acaccagtttcaattgctcgctcgcacgcacgcgcaaacgccgcctcttcctcctcccgtcctccccccactcgccgcacccgtttccccagatcccaaggaacgaacccaccccgctcgccgcgggcattttcccgaacacccagcgcgcgcgcgcgcgcgggcgctctcccgccgccgcccatgggctccctcccggttaacgcctcgccggaatgcgccccgcaggggcgcgccacggtgtcggcgtcggacctggcgccgctcttctccgcgcagcgccggcacctggaccacttcttcgaccgcctcgacatgtcgcaggcggcggcgttcgcgcaggcgctgctcgacgcgcccggggccgtcttcttcacgggcgtcggcaagtccggcatcgtggcgcggaagatcgcgcagacgctggcgtcgctgggcttcgcgcgggcaggcttcctggcccccgtcgacgcgctccacggcgacatcggcgcgctcttcccgggggacgtcctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcttgcgacctcaatgtgcacctgccgctgcagggggaggtctgccccttcggcctcgcgcccgtcacctccaccgccatccagatggtgttcggggacaccgtcgtcgccgccatcatggaggcgcgccgactctccaggaaccagtacgcctgcaaccaccccgccggcaagattggcaagaccctcatcttcaaggttaaagatgttatgaagaaacagaatgaacttcctctgtgcaaggagggagatatgataatggaccaactcacagagctcaccagtaaaggttgtgggtgtctgcttgtggttgatgaagagcatcatttgattggcaccttcactgatggtgatctccggcgtacattgaaggcaagcggcccagctattttcaatctcacagttggagagatgtgcaacaggaatccaaggacaatcactgccgatgcaatggcagtcgaagccatggagaagatggaatcacgtccttcacctgtgcagttcttgcctgtcgtcgacgacaacaacgtcatgtgtgggatcattacactgcacggattggtctctgctggattgtagacttctgtggcatcatcaccttctgctggattacaaatttctgtaccagcttactgggttcttaatgattccgtttgtctacgtctatttggctctagactgccaattgcatgtattcttgccgttcagtttatacctgaacgtgttctgtcgctacagtattgtgtgtagcctagactgtcagtgtacccatatgtatagtgcatgataagaggaatatgcccgtgtacccatttgtatagtgtttggtaagaggaatatggccctagactatcggtgt

SEQ ID NO: 17999 - protein, 345 aa, Panicum virgatum
  misc_feature: Ceres CLONE 1795385
  misc_feature (224)..(345): Pfam Name: CBS Pfam Description: CBS domain pair
  misc_feature (54)..(191): Pfam Name: SIS Pfam Description: SIS domain
  misc_feature: SWISSPROT Homolog: EC 5.3.1.13 Arabinose-5-phosphate isomerase
MGSLPVNASPECAPQGRATVSASDLAPLFSAQRRHLDHFFDRLDMSQAAAFAQALLDAPGAVFFTGVGKSGIVARKIAQTLASLGFARAGFLAPVDALHGDIGALFPGDVLVLLSKSGASDELLALAPCARAKGAYLISLTSAASGADCPLAAACDLNVHLPLQGEVCPFGLAPVTSTAIQMVFGDTVVAAIMEARRLSRNQYACNHPAGKIGKTLIFKVKDVMKKQNELPLCKEGDMIMDQLTELTSKGCGCLLVVDEEHHLIGTFTDGDLRRTLKASGPAIFNLTVGEMCNRNPRTITADAMAVEAMEKMESRPSPVQFLPVVDDNNVMCGIITLHGLVSAGL

SEQ ID NO: 18000 - DNA, 689 bp, Panicum virgatum
  misc_feature: Ceres CLONE 1795400
  misc_feature: Encodes the peptide sequence at SEQ ID NO. 18001
ggagctcagtcccaaagctcgcaggcttggagagatgcggcaagagctgcaggctgagatggatcaactacctgaggcctaatctcaagaggggcagcttctccccgcaggaggaggacctcatcatcaacctccacaagatcctaggcaacaggtggtcccagatcgcgtcgcagctgcccggccggacggacaacgagatcaagaacttctggaactcgtgcatcaagaagaagctccggcagaggggcatcgacccggccacccacaagccgctcgaggacgacgacgacgctgccgccgccgccaacagcggggaggcggcacgggatgacagcaagcagctcccggcggcatccgacgaccactgcggcttcgccatgggcggcgcctgcagcgaccctctcgcgccgcactccccgactgtcagcttcgacccactgtccgtgactaacgtcccggaaatgcagggctcttacggcgcggcgcactcctttcgcccggacaacctctgcgactacggcggtgtggacgcggcctccgaaggcgccgccgcgtacagcgccgccgcctacacgggcggcagcgtcgacagctccagtaacagcaacgggacctggacctgcggcaatgtggtcggcggcgagccgatgcagcaattggacatgtgcggcgggccgtgaggcgta

SEQ ID NO: 18001 - protein, 226 aa, Panicum virgatum
  misc_feature: Ceres CLONE 1795400
  misc_feature (30)..(75): Pfam Name: Myb_DNA-binding Pfam Description: Myb-like DNA-binding domain
  misc_feature: Functional homolog of the protein sequence given in SEQ ID NO 50233
  misc_feature: Useful for making plants with altered carbohydrate content
  misc_feature: Functional homolog of the protein sequence given in SEQ ID NO 50733
  misc_feature: Useful for making plants with altered cell wall content and/or composition
SSVPKLAGLERCGKSCRLRWINYLRPNLKRGSFSPQEEDLIINLHKILGNRWSQIASQLPGRTDNEIKNFWNSCIKKKLRQRGIDPATHKPLEDDDDAAAAANSGEAARDDSKQLPAASDDHCGFAMGGACSDPLAPHSPTVSFDPLSVTNVPEMQGSYGAAHSFRPDNLCDYGGVDAASEGAAAYSAAAYTGGSVDSSSNSNGTWTCGNVVGGEPMQQLDMCGGP

SEQ ID NO: 18002 - DNA, 1694 bp, Panicum virgatum
  misc_feature: Ceres CLONE 1795408
  misc_feature: Encodes the peptide sequence at SEQ ID NO. 18003
gagtaacagctgatcccttccacgtcggtcagcgcagcggcgaccacaacccacccggccgcggcggccctcgtcctgccgcggtcgccgtcgctgcacgcgcgtcaccgcagaggcagcaggcacgaccgggagcgggccggtttggatgtggctggagaaggtgagggggagggagcgcggggagctgcgcgcccggaggttcgaggccgccgcccgggcgcgccgcgcggcctcgctcgcgctctccaaccgcaaggagttcgccaccccgcaccacggcgccgtcaactcgctacaggttgatttgacagaggggagatacctgctctccggggcatcggatgggtcggccgctgtattcgatgtgtggaacgcgaccgagtacgaaaccggcttcatagcgaagcacaggcacatactgcttgtggacaagcagcaccagaatggccacaagttcgccatttcggcggcagtttggtatcctgtggataccgggctgttcgtcacagcatcctttgatcagtacgtcaaagtttgggataccaattcgactcaagtcgtcatggattttaagatgcctggtaaagtgttcactgcagccatgtctccaattgcaacaacgcacatgcttatcgctactgggagcgcagatgttcaggtccgtctgtgtgacatagcttctggagcatttacccacacattgtccggtcaccgtgatggcatcatgtccttggagtggtctgcctcaagtgagtgggttttgatgagtggtggctgcgacggggcaatacgtttctgggacatcaggagagctggatgctttcgtgttcttgatcaatcacagtctcagcttggaaggagatctcctcttcttgaaagcacaacagagaatgatcacattgattccataggaccttcaacttccacaaggagcttacctcacaaaaggaccggaaattctaagaagaactcaccaacaatgcgcaaatgtcaaaatctgatacatggacatttgcaacagagattgcatcctggtttatcatccagtcaaaaccgtgcaacatctcattatggtgctgttactggattacgaacaactaaagatgggatgtacctacttagctcaggatctgattctcgtttaagactatgggacatcgattcaggatgcaacactttggtcaattttgaagctatgcgattgcagactggcaagccgttgcaattagcagtcactgatgatccatcacttgcatttgttccatgcatggcaagcatcaaggcatacaatttatggtctggtacgacatttcgggcattccggggtcactacgagcttgtgaattgctgctactatagtgaacaggaccaagaactttatactggcagcaatgatagacaaattcttgtatggtctccatcaactccagcttttactgaaatggaagatgatgagaagcggcatgggctttctgcagctgatgaggataactggagcgactgagaaggccaaccttttttccccgaaagcggaaggattgtattcgtgtatgctacattgatgtgacggatgccaacaagtttgaggctgtcagctcttgttagcagcccgaggaggttgtacatttgtcagttcgttgaattattggtaaatttatcttaaaaaaaggataagggattctcgggttgac

SEQ ID NO: 18003 - protein, 452 aa, Panicum virgatum
  misc_feature: Ceres CLONE 1795408
  misc_feature (180)..(219): Pfam Name: WD40 Pfam Description: WD domain, G-beta repeat
  misc_feature (93)..(132): Pfam Name: WD40 Pfam Description: WD domain, G-beta repeat
  misc_feature (386)..(424): Pfam Name: WD40 Pfam Description: WD domain, G-beta repeat
  misc_feature: SWISSPROT Homolog: EC 2.3.1.48 Histone acetyltransferase
MWLEKVRGRERGELRARRFEAAARARRAASLALSNRKEFATPHHGAVNSLQVDLTEGRYLLSGASDGSAAVFDVWNATEYETGFIAKHRHILLVDKQHQNGHKFAISAAVWYPVDTGLFVTASFDQYVKVWDTNSTQVVMDFKMPGKVFTAAMSPIATTHMLIATGSADVQVRLCDIASGAFTHTLSGHRDGIMSLEWSASSEWVLMSGGCDGAIRFWDIRRAGCFRVLDQSQSQLGRRSPLLESTTENDHIDSIGPSTSTRSLPHKRTGNSKKNSPTMRKCQNLIHGHLQQRLHPGLSSSQNRATSHYGAVTGLRTTKDGMYLLSSGSDSRLRLWDIDSGCNTLVNFEAMRLQTGKPLQLAVTDDPSLAFVPCMASIKAYNLWSGTTFRAFRGHYELVNCCYYSEQDQELYTGSNDRQILVWSPSTPAFTEMEDDEKRHGLSAADEDNWSD

SEQ ID NO: 18004 - DNA, 698 bp, Panicum virgatum
  misc_feature: Ceres CLONE 1795419
  misc_feature: Encodes the peptide sequence at SEQ ID NO. 18005
ataaaaaacaaggggaaaaaaaggcgaggggcgggtctcatggcgctagcctagccgcctccccaacctcctcaccgaggagagagagagagaggacagaggagagagagagaggaggttccatttccgcgtcgtctccgcccgcagccccaccctccacatggccgcgctgccgggtggggcccacgctgccggcgccgcggacccgatgcaggtggaccagccgcgccccgccgccgccgccgcagccgcagcagcaaccgcccccgcggacgccaagcatgccagttctatgattgaagggggtgatccagtcactggtcacataatctcaacaacgattggaggcaagaatggagagcctaaaaggactatcagctacatggccgagagagttgtgggaactggatcattcggaatcgtcttccaggctaaatgtctggagactggtgagactgttgccattaagaaggttttacaggacaagcggtacaagaatagggagctgcaaatcatgcgatccatggatcactgcaatgtcgtctccttgaagcattgcttcttctctaccacaagcagggatgaacttttccttaacttggtgatggagtttgttcctgagtcactgtatcgtgtattgaagcattacagcaatatgaaccagaggatgccgcttatatatgtcaagttatacacct

SEQ ID NO: 18005 - protein, 179 aa, Panicum virgatum
  misc_feature: Ceres CLONE 1795419
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
MAALPGGAHAAGAADPMQVDQPRPAAAAAAAAATAPADAKHASSMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYT

SEQ ID NO: 18006 - DNA, 619 bp, Panicum virgatum
  misc_feature: Ceres CLONE 1795419-R
  misc_feature: Encodes the peptide sequence at SEQ ID NO. 18007
atctacgatgcactgctcttgaagcatgcgcacattcattcttcgatgagttgcgagaaccacatgcaaggttgccaaatggtcggccattccctccactctttaactttaaacaggaactagcaaatgcttctcctgagcttatcaacaggttgatcccagaccatgctaggcggcatcttgggctcacttaaatccctgcaactggaccatagggaagctgtatggtgttttaccttgcgcttccgatgcttctttgtgccgaagggcaacctgcatgtcctcacatttaagatgtagaatctgaccattattggaaagccaaacgtgagctggtgccaatgtgttgcatgaggagaggtgtgtttcgcccagccagccctcgtcacttgttttaatgctccatccaatttagccgaagtagcgggagggaagggggtggtattgttaagctattgaaggaatctatactatcgtattacattctgcaatgctaaatgttgtagtgcgcctgtaagtgtcccgtatccctgggtcagtcaatgtaattctgtaaatgttattgatgggaaattatcttgtgttatggtaattatcaagtcgtttatccttggactcg

SEQ ID NO: 18007 - protein, 63 aa, Panicum virgatum
  misc_feature: Ceres CLONE 1795419-R
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
LRCTALEACAHSFFDELREPHARLPNGRPFPPLFNFKQELANASPELINRLIPDHARRHLGLT

SEQ ID NO: 18008 - DNA, 2003 bp, Panicum virgatum
  misc_feature: Ceres CLONE 1795450
  misc_feature: Encodes the peptide sequence at SEQ ID NO. 18009
agtagcggcggcggctattccttctcctcctcctgcttgttcgttgtgagcgcccgcagcagccagccaggcaggtgcggcgaaacggcgcccccccccccctccccacgatatttccgagctatttaagccccgcgcgggggaggaggtaggtgacaggtgcgcaactgctgtgctgtggtgtggtggcctcctctgcatcggcggcgcgattcacaccggcgatccttccccatccccagcggcgcaggccaaacaaggcggccaggagatggcgctcacaagaattggtcttgctggccttgctgtcatggggcagaaccttgccctcaacatcgcagagaaaggattccccatctccgtctacaacaggacgacctccaaggttgatgagactgtgcaacgtgccaaggcagaaggaaaccttcccctttatggtttccatgaccctgcatcttttgtgaactccattcagaagccacgcgttgtcatcatgcttgtcaaggctggtgcaccagttgaccagaccattgcaacactcgctgctcacttggagcagggtgactgtatcattgatggaggaaacgagtggtatgagaacacagagaggagggagaaggccatggcggagcgtggcctcctctatcttggcatgggtgtatctggaggagaggagggtgcccgcaacggcccgtccttgatgcctggaggctcatttgaggcgtacaagtacattgaggatattcttctcaaggtggctgctcaggtccctgacagtggcccgtgtgtcacatatattggcaaaggtggatctggcaactttgtcaagatggttcacaatgggatcgaatatggtgatatgcagctgattgctgaggcatacgatgtcctcaagtcagtcggcaagctcactaacagtgagctgcaccaggtgttctctgaatggaacaagggagagctcctcagtttcttgatcgagatcactgcggacatatttggcatcaaggatgaccagggtgatggctacttggtcgacaaagtcctggacaagactgggatgaaaggaaccgggaaatggacagtgcagcaggctgctgaactctccgtggctgctcctacaatcgaggcatcattggactccaggttcctcagcggtctgaaggacgagcgtgttgaggcttccaaaatcttccaaggtgactactccactggcttaccagttgacaaggcgcagctgattgaagacgtgaggcaagccctctacgcctccaagatctgcagctatgcgcagggtatgaacatcatcaaggccaagagctcggagaaaggatggggcctgaaccttggcgagctggcgaggatctggaagggagggtgcatcatccgcgccatcttcctcgaccgcatcaagaaggcctacgacaggaaccccgatctcgccaacctcctcgtggaccctgagttcgcccaggagatcatggacaggcaagcggcgtggcggagggtcgtctgcctcgccatcaacaacggcgtcagcaccccaggcatgtctgctagcctggcctacttcgactcatacaggagggacaggctgcctgccaacctggtgcaggcgcagagggactacttcggagctcacacctaccagagggtcgatatgccaggttctttccacaccgagtggttcaagatcgcgcgcagcaactcccagaactgagctgctccagaggtggcatgccatggcacgatattgacatggttgtcatatttttcattatcgttaatcgctgtgcggcgttgagtaatcggtaatgtaggggagctgctgtggttaaatttgatttttcaggcacggtgcttaatttaagtcaggaagttgctgttgttgtcttcaatcctttccgtgtataagcggtctgggatggagaacaatggtgtacttcttggaacttccatgttgatgtttgtaagtttgatctatgaataaataagagcattttgtc

SEQ ID NO: 18009 - protein, 481 aa, Panicum virgatum
  misc_feature: Ceres CLONE 1795450
  misc_feature (182)..(472): Pfam Name: 6PGD Pfam Description: 6-phosphogluconate dehydrogenase, C-terminal domain
  misc_feature (3)..(178): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MALTRIGLAGLAVMGQNLALNIAEKGFPISVYNRTTSKVDETVQRAKAEGNLPLYGFHDPASFVNSIQKPRVVIMLVKAGAPVDQTIATLAAHLEQGDCIIDGGNEWYENTERREKAMAERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDQGDGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPDLANLLVDPEFAQEIMDRQAAWRRVVCLAINNGVSTPGMSASLAYFDSYRRDRLPANLVQAQRDYFGAHTYQRVDMPGSFHTEWFKIARSNSQN

SEQ ID NO: 18010 - DNA, 1567 bp, Panicum virgatum
  misc_feature: Ceres CLONE 1795473
  misc_feature: Encodes the peptide sequence at SEQ ID NO. 18011
acgggcacaggcgcacagcgcgcgcggtgagctctgcgcttccactagccccctctctccaccgatctctcacccaagcacccaaccgccccgcactcgaactcgaactcaacgccctcgaggcttggcttggttccggcaacgtcggaggagcacggggatggcgatcgggctcccctcgcccgccttcctcacctgaacccttgatcccaccagcgcggcgcgaggggcgcgggcatggggtacctgccggccctgggcgggaaggcggcgcacctggtgtccgacctcgccaccgtcatcctcaaccccgtctccgagcgggagcgccagcggcaccacgcatcccacctcccggaagctgctgaaggaaaagacacactatttggtgatgaagattctgacaaaaattccgagactcctgatggtcctgacacatcttccttcagagcatttctgatgtcatttgtatcatccacaacctccagcaaggattcaatggagaccatacctgagcataatctagacgtggaatatccaactttaacacctgttggaaaggcaagcagtgtgagaaagggcttgctcagtagagggaagcattccattggaaggattattagcaaggcaggactcagtaatttcagacagaaacccacctacagcattgatggtgaattcacaggtcaaacagaatcagttgcacctaggtttgagatgaagggatcaaaggaattggctttgcatgagaagttgccagctatgtccgagccatctgttctgttgtcagaaatgatgcgatctgttctttattcatctcttcctgttcttgttcaaggaaggaactggatgttggtttacagtacctggagacatggaatatctttgtccactctgtatagaaggagcaggctttgtgctggctactcacttctgatagttggggatcgaaggggagcagtttttggtggtttggttgaggccccactgcagcctatcataaagaggaaatatcaggggactaatgaatgctttgtgttcaccaatgtagaaggccgtcctgttatatgccgtccaacaggtgctaataactattttacattttgctcaactgattatttggcaatgggaggtggtggtcacttcgccctttatctcgatggagacctactgaatggttctagttccacctcagagacttttaacaacccatgcttatcccatacccaggaattcaaaatcaaagatgtcgagctatggggcttcgtcaatgcttcaaaatatgaagagatgctcacgatctgccgcactgaaaagcaaggagtttggaatctgtgaccgtgcggactgcggagctcactgagttgttgatggttggtgccaacctatctcctggtgtggcctgtacagttttgtagtacataaaacgtatgtagaacatgaagaggagagtttcatatggaatagaaatgtgtagagctttgccgttcatgtttgtaaatattaacagtagaagatggtagtgtgtagtactactatatggtaaaaacaatttactttcatctgc

SEQ ID NO: 18011 - protein, 366 aa, Panicum virgatum
  misc_feature: Ceres CLONE 1795473
  misc_feature (206)..(344): Pfam Name: TLD Pfam Description: TLD
MGYLPALGGKAAHLVSDLATVILNPVSERERQRHHASHLPEAAEGKDTLFGDEDSDKNSETPDGPDTSSFRAFLMSFVSSTTSSKDSMETIPEHNLDVEYPTLTPVGKASSVRKGLLSRGKHSIGRIISKAGLSNFRQKPTYSIDGEFTGQTESVAPRFEMKGSKELALHEKLPAMSEPSVLLSEMMRSVLYSSLPVLVQGRNWMLVYSTWRHGISLSTLYRRSRLCAGYSLLIVGDRRGAVFGGLVEAPLQPIIKRKYQGTNECFVFTNVEGRPVICRPTGANNYFTFCSTDYLAMGGGGHFALYLDGDLLNGSSSTSETFNNPCLSHTQEFKIKDVELWGFVNASKYEEMLTICRTEKQGVWNL

SEQ ID NO: 18012 - DNA, 1631 bp, Panicum virgatum
  misc_feature: Ceres CLONE 1795477
  misc_feature: Encodes the peptide sequence at SEQ ID NO. 18013
gtgtttacgggtttatggggtggaaacagggcctggttgcctgtgtcgagtccagccacatccgccggcggcgatgtctccgtccgccgacgccgcggcgccgatccccacctcgtcgcccccgctcgcgcccctcgtcgccgcgcagctcagctacctactctcgcactccaagcttcccatcagggtggggcagatctggtccggctgccgcaacggccgccactccgatcgattcacgctctccatccccttctgcctcgactacgtccactgggatttcgtgtataatgccttgtctcccatggtggcgcccgacgtggtgttcggccaggacgacgaggggttccagccgctggttgattatgccgacgctggaaatgacaagagctgcttggcacgttgggattaccgcgatcccagaagactctttgctctcgtacatgagctccgggaattgtacattgaatgccacaagaagcaggttgccaaggttgatgatgcaagggtgacgtttgaattaagtacagttctcactaaggaggggattgaagtctgcatggtaccttccgctgataggccagatgaggtgaaatttgctgtaccacttctggacgtcgacttcaactttaacaaactggtgccaggctgtccttggagattacctcaaaagatccatctacaggtcatttttccaatcagtagaagttcaagttactcttctgttccttctgctccacgactcaaactaatctcaacatcagatttgaaatcacttttctcagttgaggatgtgaaactccctccatggtcaaatgggatgtgtttggcggagtatcttcctgccttagaagaaagtcttaacctgctggttgttgaggcatcagcttcaattggtgccaggagacgttttatcgaggcactggctcctacctttgggagaccaatagaggctgatccgatcttttgcaggagggctacagtgctttccatttcaggagttttcacatttctggtacactttgccatcccccttcagttcccaaagcaacaacctatcctcacattgcagagttctcagcactgcgatgccgatggggcacctattatgtcacccccaataaatgattatccctggagtcctagatgggatcaggcagaaatggttgaacggatctacgacttcctcgccgatgagtgccaaaatttcaagaagttctgcagcgacgctatcactcagcagaagtagctgttgtcactcagcagaagaagcattcgtggtcattttctcaagaacaagcttccttgcgcttagcaacctgaacccgtgcaacagtcgattgacctcctgtgctgcgatgctattcactgctttgtcagaatactcttgtcatgtgatgcgggaagttagaggaggaaatctcaggcggtagaaccccataggagcgcttctgacctaaagttcggcaagcatgatgtgtgtagcaaagcgtaacagcgctgttgttgattccagttcctcgctgttaagctgttgccttgtaaattgtttgggatgaatgcaatccagtcctttggacattgtaaatatggatagaatgagatctctacattgattgtggctcccttgt

SEQ ID NO: 18013 - protein, 391 aa, Panicum virgatum
  misc_feature: Ceres CLONE 1795477
  misc_feature (1)..(338): Pfam Name: BRE Pfam Description: Brain and reproductive organ-expressed protein (BRE)
MSPSADAAAPIPTSSPPLAPLVAAQLSYLLSHSKLPIRVGQIWSGCRNGRHSDRFTLSIPFCLDYVHWDFVYNALSPMVAPDVVFGQDDEGFQPLVDYADAGNDKSCLARWDYRDPRRLFALVHELRELYIECHKKQVAKVDDARVTFELSTVLTKEGIEVCMVPSADRPDEVKFAVPLLDVDFNFNKLVPGCPWRLPQKIHLQVIFPISRSSSYSSVPSAPRLKLISTSDLKSLFSVEDVKLPPWSNGMCLAEYLPALEESLNLLVVEASASIGARRRFIEALAPTFGRPIEADPIFCRRATVLSISGVFTFLVHFAIPLQFPKQQPILTLQSSQHCDADGAPIMSPPINDYPWSPRWDQAEMVERIYDFLADECQNFKKFCSDAITQQK

SEQ ID NO: 18014 - DNA, 1839 bp, Panicum virgatum
  misc_feature: Ceres CLONE 1795478
  misc_feature: Encodes the peptide sequence at SEQ ID NO. 18015
gtactccctctcgcctccgcgcacaggtttcgtccccctctccctctctcctcctcttctccagagagagagagagagaaagagagagagcgaggagagggagcgagagctacctgctgcgacctcgagtatcatttcgcaggagacttgcggaaagatgtgatagaagagtagaaactgtgtgaaaaggcttgatgtttgttcaaaggcagtgcctatctggtgaacgcaaagagtgttgattcgctgaacaagtgcagtagtcaagatgcctgcactgagaatgaagaggatgcttgaagatactgaatttgctaacgagttcagcacaaagtctgttaaatccatgaaaatttcgcattttcctgtcagtgagttagagcagtccgctgtgctaaactcgtcagataaagttcctctagatgagtcggatccaactattcagcttggtgaccaggatattaggataatggaagcttctggcttgcatgatctgcatggagggaaatccattggtgtgctcaaggatttaacatctggggtggtagtttcaccaaatacggaggctgattcctctgctaattatgatgacaatgagtctctgttacatgtagtgaattatgtaaacaaagagttttcagatgaaggtgtagattattcagcccagaatttatgtgctgttagtgatcatgaggcaagctgggttccaaatcagtgttgcaacctgctggatatttgcagtccagatgatgatttccgtttcttgttggataatccaaccaatcttcttcctagttatactggattttgtgacgaatttgtatcggttgatgcattgatgaacatgagcagcagatgtggtgtgtttccacttattgagagtgcctcagaagccagtattgataataagccatgctcatctgaggtggatttgtgctttagtaattctgaggtattagagtggcttaacccacacctatccgaggaggatttaccagatcttgttgattttgctgagttgacttcaaatgatgttcctgcaataaaagagcaacggaccagaaaggtcactcttgtacttgatttggatgaaacccttgttcattcaactatggagcaatgtgatgacgctgatttcacttttcctgtgttctatgatatgaaagagcatgtggtgtatgtgaaaaagagaccacacgtccatatgtttctccaaaagatggctaagatgtttgaggtagtgatattcacagccagccaaagtgtttatgcaaaccagttgcttgacgtgctggatccagagaacaaacttttctccaagcgatttttccgggaatcatgtctattcacagacagcggctacacaaaagatctgactgttgttggagttgaccttgccaaggttgccataattgacaacactccacaggttttccagctccaagtgaacaatggtataccaatagagagttggtatgacaaccctgtagatgaggctctacctcagttgatccctttcctggagatccttgctgtcgcggatgacgtccggcctatcattgccaagaagtttggcaacactatagatagttgctgaagattttgaataagttttagggttagtcttgtttgctcacatagtggaacaagaacctacatgacatgttaacaggactagtgggacttgattttctctttccagcaagttggtttcataggatgaagagtcttggtgcggggcaatttcttagaattgtacatatcctcaattttggtttgttttgtctttgtacatagaatgctactggaaatgaaagactgaaagtgaatctccttgcg

SEQ ID NO: 18015 - protein, 442 aa, Panicum virgatum
  misc_feature: Ceres CLONE 1795478
  misc_feature (257)..(433): Pfam Name: NIF Pfam Description: NLI interacting factor-like phosphatase
  misc_feature: SWISSPROT Homolog: EC 3.1.3.16 Phosphoprotein phosphatase
MPALRMKRMLEDTEFANEFSTKSVKSMKISHFPVSELEQSAVLNSSDKVPLDESDPTIQLGDQDIRIMEASGLHDLHGGKSIGVLKDLTSGVVVSPNTEADSSANYDDNESLLHVVNYVNKEFSDEGVDYSAQNLCAVSDHEASWVPNQCCNLLDICSPDDDFRFLLDNPTNLLPSYTGFCDEFVSVDALMNMSSRCGVFPLIESASEASIDNKPCSSEVDLCFSNSEVLEWLNPHLSEEDLPDLVDFAELTSNDVPAIKEQRTRKVTLVLDLDETLVHSTMEQCDDADFTFPVFYDMKEHVVYVKKRPHVHMFLQKMAKMFEVVIFTASQSVYANQLLDVLDPENKLFSKRFFRESCLFTDSGYTKDLTVVGVDLAKVAIIDNTPQVFQLQVNNGIPIESWYDNPVDEALPQLIPFLEILAVADDVRPIIAKKFGNTIDSC

SEQ ID NO: 18016 - DNA, 1690 bp, Panicum virgatum
  misc_feature: Ceres CLONE 1795479
  misc_feature: Encodes the peptide sequence at SEQ ID NO. 18017
gacgcacgcagccaaaaagcacacggggcagagctcgactgctcgatgaggcgggaggcaggggaggcgatcgggatggccgctcctcttgcgtagcagagtgttgcttgcctgctgcttccgtcacgtgccattgccactgcgtgagcgagaggaaggcggcgtgaagggagcagctaaggatcgaggaaatggcggcgcgcggccacgtgctggcgctgttcgtgctgctcgcgctcgccggggcggccgcggcgggcggcgggcggcaccagcaccggcaccggcacggcaggaagtcggcgcggctgaggctgatcccctccgcgccgggcgcgtccctcgccgaccgcgcgcgggacgaccggcaccggcacgcgtacatccggtccacgctggcgtcgcgccgccgcgcggcggaggtgggcgcgtcggcgttcgccatgccgctctcgtcgggggcctacaccggcacgggccagtacttcgtgcggttccgcgtgggcacccccgcgcagccgttcgtgctggtggcggacaccggcagcgacctcacctgggtcaagtgccgcggcgccggatcgccgccggacgcgcagccgccggcgcgcgagttccggcccgccgcctccaagtcgtgggcgcccatcgcgtgctcctccgacacgtgcacgtcgtacgtgcccttctccctcgccaactgctcgacgtcggccagcccctgcgcctacgactacaggtacaaggacggctccgcggcgcgcggcgtggtgggcacggactcggcgaccatcgcgctgtccgggaacggcgtcggcgcggacggcagcaggcgcgccaagctgcagggcgtggtgctgggatgcacggcctcgtacgacggccagagcttccagtcatcggacggcgtcctcagcctgggcaacagcaacatctccttcgcctcccgcgccgccgcgcgcttcgggggccgcttctcctactgcctcgtcgaccacctcgcgccgcgcaacgccaccagctacctcaccttcggcccggggcccgaggacgccgccgcgccggagcagacgccgctgctgctcaaccgccggatgagcccgttctacgccgtgacggtcgacaccatctacgtggccggcgaggcgctcgacatccctgcggacgtctgggacgtcgacaagagcggcggcgcgatcctcgactcggggacgagcctcacgatcctcgccaccccggcgtacagggccgtggtcgcggcgctgagcaggcagctcgcggggctcccgagggtgagcatggacccgttcgagtactgctacaactggacggccggcgcgccggagatcccggagctggaggtgcacttcgccgggtcggcgcggctgctgccgccggcgaagagctacgtgatcgacgcggcgcccggggtgaagtgcatcggcgtgcaggagggggcgtggcccggggtgtcggtcatcggcaacatcctgcagcaggagcacctctgggagttcgacctcagggaccggtggctccggttcaagcacacgcgctgcgtcgcccaatgattctgacaggcgcacacgattaatccatccatcgtcttgataaatttgtaacggccttcgagtgaatggtttctctaaatggaaagataagctgtagcgcgatgggaaaatgttcagcc

SEQ ID NO: 18017 - protein, 459 aa, Panicum virgatum
  misc_feature: Ceres CLONE 1795479
  misc_feature (97)..(454): Pfam Name: Asp Pfam Description: Eukaryotic aspartyl protease
  misc_feature: SWISSPROT Homolog: EC 3.4.23.12 Nepenthesin
MAARGHVLALFVLLALAGAAAAGGGRHQHRHRHGRKSARLRLIPSAPGASLADRARDDRHRHAYIRSTLASRRRAAEVGASAFAMPLSSGAYTGTGQYFVRFRVGTPAQPFVLVADTGSDLTWVKCRGAGSPPDAQPPAREFRPAASKSWAPIACSSDTCTSYVPFSLANCSTSASPCAYDYRYKDGSAARGVVGTDSATIALSGNGVGADGSRRAKLQGVVLGCTASYDGQSFQSSDGVLSLGNSNISFASRAAARFGGRFSYCLVDHLAPRNATSYLTFGPGPEDAAAPEQTPLLLNRRMSPFYAVTVDTIYVAGEALDIPADVWDVDKSGGAILDSGTSLTILATPAYRAVVAALSRQLAGLPRVSMDPFEYCYNWTAGAPEIPELEVHFAGSARLLPPAKSYVIDAAPGVKCIGVQEGAWPGVSVIGNILQQEHLWEFDLRDRWLRFKHTRCVAQ

SEQ ID NO: 18018 - DNA, 1652 bp, Panicum virgatum
  misc_feature: Ceres CLONE 1795482
  misc_feature: Encodes the peptide sequence at SEQ ID NO. 18019
acttgtcccctcggccctccttccctgccttcccttttccccacgccacctcccacctccgttcgccgccgccagccgaccagctcgcccgccgcgccggcgatggcgacgacggaggggctcgtgcctatcacacgggcctacctcgcgcgctactacgacaagtacccgctggccccgctgcccgatgccgccactgacctcgccgcccggctgcgcgccctctccgccgacctcgccgccgtcactcccatcgcctccgatgaggaactcttggaacaagaagcagctggcatacctgctcacaaaattgatgagaatttgtggaagaacagagaacaaatggaagaaattctttttttgctcaatacatcccgtcgtcccgttgcacttcaacagaagttcgctccagaagatgctgagatagcttctaaacttgatgatattgaagctaaattgaaggacatgttgaagaagttagaacaatttcagataaaaaatgctgacaatgttttcaatacagttatgacatacatgccccacgattttcgaggcacactaatcaggcaacaacgagaacgctcagaaaggaataagcaagcggaggtagacactttagttagtgctggcggaagcattcgcgatcgatatgcgttgttgtggaaacagcaaatggaaaggagggtgcaattagcacaacttggttccgcgacaggtgtatataagactcttgttaggtatttggttggtgttccgcaggttttattggattttattcgacaaataaatgatgataatgggcctatggaagagcaaagagaacgttatggcccagcactgtacacccttacaaaactggtgcttgctattcggttgtatctgcatgtctctttggcacgatatgaacaaaggaaaatagagcaggataacattgctatgctgcagcaagctgtaattatctacaccaaggagttttggaagttcaccgaattcataggcgaggtctttgtgaacgcaccattctttatatccgctgaggatgccggtgccatggatgcaaggaaaagtgacgagtacaaagaaactattattcaagctggaaagacacatgaggtcattttgactgttgaagccgtaaactcatacattgcatgggacttctccttgcaacaaggggccctcaacgtggtattgaacattggatttcatgtggagtacattagtccttcaggggagaaaactctaattcttccctaccgacggtatgaagctgaccaaggcaatttttgcactatttcagcgggatcatacaaacttgtatgggacaactcatattcatcattcttcaaaaagagcctccggtacaaggtggatgctgtgccaccggttgtcgagccggccatgcccaccgtagagcccttatgaggcctgccttaatattgatgcctgtcatgaattagacggtgcaggtgcatcagaagccccaaacggtcttgtaaccaatacttgtatcataatcgcagggttctggtgatccatacacgtagctcccagtctgagagcaatatgtactgcgtgcacatggttacggccagttggccagttttccactgatgaatgcctaattctataccagaaaagtgtactatagc

SEQ ID NO: 18019 - protein, 440 aa, Panicum virgatum
  misc_feature: Ceres CLONE 1795482
  misc_feature (342)..(425): Pfam Name: EMP24_GP25L Pfam Description: emp24/gp25L/p24 family/GOLD
MATTEGLVPITRAYLARYYDKYPLAPLPDAATDLAARLRALSADLAAVTPIASDEELLEQEAAGIPAHKIDENLWKNREQMEEILFLLNTSRRPVALQQKFAPEDAEIASKLDDIEAKLKDMLKKLEQFQIKNADNVFNTVMTYMPHDFRGTLIRQQRERSERNKQAEVDTLVSAGGSIRDRYALLWKQQMERRVQLAQLGSATGVYKTLVRYLVGVPQVLLDFIRQINDDNGPMEEQRERYGPALYTLTKLVLAIRLYLHVSLARYEQRKIEQDNIAMLQQAVIIYTKEFWKFTEFIGEVFVNAPFFISAEDAGAMDARKSDEYKETIIQAGKTHEVILTVEAVNSYIAWDFSLQQGALNVVLNIGFHVEYISPSGEKTLILPYRRYEADQGNFCTISAGSYKLVWDNSYSSFFKKSLRYKVDAVPPVVEPAMPTVEPL

SEQ ID NO: 18020 - DNA, 910 bp, Panicum virgatum
  misc_feature: Ceres CLONE 1795494
  misc_feature: Encodes the peptide sequence at SEQ ID NO. 18021
agggttgcttacactgctctactggtctctccgtctccctcacccatggcttcggcggcggcgacccaacaggtgggaacgtacttcctacggaactattacaacctgctgcagcagaaccccgatgtagtgcaccagttctacagcgaagccagcaccatggtccgcgtcgacgacctcgccggcacgaacaccactgtcagcagcatgatggacatacactcactcattatgtccttgaatttcacccaaatcgagatcaagacagcaaactttatcaactcatggggtgatggtgtgctagttatggtctctggccttgtgcagaccaaggagtacagccaccaaagaaaatttatccagatgttcttccttgctccacaggagaagggttactttgtcctcaacgattactttcacttcgtcgaccaagaacaggtgcagcctgcacaactgatttctcatgatgactacgagaacaatttggcctctaacgcagctgtcgaaactgttccagagtacattcatgaggaagaaactcaaacagcacaaataacatctgaaggacatgatgtggtcgagaattatgcttattctgagccaccacagcaagtggtggtgccatctgacaactggggggaggaacctcttcctgaagaaccgccttcttccttctcaaatgaaattgcagcggcaccagaggagccagtgcaacctcctcctgtgccacctcatgtggaggagcctgttggtgaaccagtgaagaagacttatgcttccattctaaaaacggcaaaggctccacctgcattcccggtagcccagcaagtccctgtgagtaagccttctcaccctacaacagagttgaaccaggcccagcattcagttatggcttcatcaacagcagccg

SEQ ID NO: 18021 - protein, 288 aa, Panicum virgatum
  misc_feature: Ceres CLONE 1795494
  misc_feature (10)..(126): Pfam Name: NTF2 Pfam Description: Nuclear transport factor 2 (NTF2) domain
MASAAATQQVGTYFLRNYYNLLQQNPDVVHQFYSEASTMVRVDDLAGTNTTVSSMMDIHSLIMSLNFTQIEIKTANFINSWGDGVLVMVSGLVQTKEYSHQRKFIQMFFLAPQEKGYFVLNDYFHFVDQEQVQPAQLISHDDYENNLASNAAVETVPEYIHEEETQTAQITSEGHDVVENYAYSEPPQQVVVPSDNWGEEPLPEEPPSSFSNEIAAAPEEPVQPPPVPPHVEEPVGEPVKKTYASILKTAKAPPAFPVAQQVPVSKPSHPTTELNQAQHSVMASSTAA

SEQ ID NO: 18022 - DNA, 678 bp, Panicum virgatum
  misc_feature: Ceres CLONE 1795494-R
  misc_feature: Encodes the peptide sequence at SEQ ID NO. 18023
agccgagaaaccgagatctgatgtctacggtgaagttgcggcccatgacgatgaagagagcaagtctgtttatgttgggaatgtgccatcatctgtaagtgaggctgatcttgaaaacaagttcaaaaagtttgggcggcttattcctgacggtgttgctatcagaagccgaaaggagactggtggctattacgcttttgtggaatttgaggagctaagtggtgtgcacaatgcgttaaaggcttcaccaatcgaaataaatgagcggcagatatatgttgaggagaggaagcctaacagcggaataagaggtggaaggaggggcggaagaggccgtttcggcggtggaggtcggggatatgccagaggtggaggtgatgagtacaatggtggcaaccgggggaggtcgaacggttatgggcgtgttcctcaccaagagaggggcatccttgggagccatgctcaaaggaactgatatggtgcagcaaagagcaagcataaggttttgatctgtcgtcagagggagagagatcctgaacaaagcagcctatatgctgctaggttgcatttgggattttggggcctgttttgtcgatgaatgtgtgtgtgtgtcgacctatgcgacatccaacttttgctagactgatgttgcctgttgttattaagagctgttctgtt

SEQ ID NO: 18023 - protein, 157 aa, Panicum virgatum
  misc_feature: Ceres CLONE 1795494-R
  misc_feature (23)..(93): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
AEKPRSDVYGEVAAHDDEESKSVYVGNVPSSVSEADLENKFKKFGRLIPDGVAIRSRKETGGYYAFVEFEELSGVHNALKASPIEINERQIYVEERKPNSGIRGGRRGGRGRFGGGGRGYARGGGDEYNGGNRGRSNGYGRVPHQERGILGSHAQRN

SEQ ID NO: 18024 - DNA, 1567 bp, Panicum virgatum
  misc_feature: Ceres CLONE 1795499
  misc_feature: Encodes the peptide sequence at SEQ ID NO. 18025
gaccttccagtgatcctattctccctctctctctttctccccggcggcaaatcccggcggccgcagcttatcctccgcggccggggctcgtcgtccggccatcgctgcccctcccctccgcgcccctcccctcccctttgctccggccaccgccacccctcacctcccatcgacgccggcgcggaggaggacgagcgcccctaggtgcgcggccggggctcggcggcggcgagggcgagctccccagggcggcgcggccgggcctcggcggcggcggggccggggctcggcggcggccggagctccctcccctgacagcgggggcgagctctcccgggtggcgcggcgggggcgagctcccctgggttgggtcgtatcccacaggcatctggaatagctgcactggatgtgaaaaagctcaaagattctggtctccacactgtggaggctgtggcttacactccaaggaaagatcttctgcaaatcaaaggaataagtgaagctaaagttgacaagatagttgaagcagcatcgaagatagttcccctggggtttacaagtgccagccaacttcatgcacagcggctggagattattcaagttacaactggatcaagagagcttgacaagatcttggagggggggatagaaacaggatctatcacagagatatatggtgagttccgctctggaaagactcagttgtgtcacaccctttgtgttacatgtcagcttccattggaccaaggtggtggtgaaggaaaggctctatacattgatgcagagggtacttttagaccacaaaggctcttgcagattgctgacaggtttggactgaatggttctgatgtattagagaatgtggcttatgccagagcttataatacagatcatcaatccagacttctgctggaggcagcatccatgatgatagagaccaggtttgctctcatgattgtagacagtgccacagctctgtacagaactgatttctcaggaagaggggagctatcagcaaggcaaatgcatatggctaagttcttgaggagccttcagaagttagctgatgagtttggagtagctgtggttatcaccaatcaagtagtagcacaagtggatggctctgctatgtttgccggacctcagatcaagcccattggtggaaacatcatggcccatgcttccacaacaaggcttgctcttcgcaagggaagaggggaggagcgaatctgtaaagtaataagctctccctgcctggctgaagcggaagcaaggtttcagatagcttctgaaggtgtcgcagacgtcaaggattgagaccaatagaccgtctatctcggcttactgctggccaaagcacttgagctccattgctggcctgctgcttgttttgttactgctgggtcaactgctttgttgcccctcttcgatgtacagagcactcggcagatgggaatgcacatctgctttgacgttgaatgtcactgttgtataaaacaatgtatgtactgcattgcatgtaatgtgacatctgctactgaattgaatcattctagtttgttctgcc

SEQ ID NO: 18025 - protein, 130 aa, Panicum virgatum
  misc_feature: Ceres CLONE 1795499
  misc_feature (1)..(129): Pfam Name: Rad51 Pfam Description: Rad51
MMIETRFALMIVDSATALYRTDFSGRGELSARQMHMAKFLRSLQKLADEFGVAVVITNQVVAQVDGSAMFAGPQIKPIGGNIMAHASTTRLALRKGRGEERICKVISSPCLAEAEARFQIASEGVADVKD

SEQ ID NO: 18026 - DNA, 815 bp, Panicum virgatum
  misc_feature: Ceres CLONE 1795505
  misc_feature: Encodes the peptide sequence at SEQ ID NO. 18027
atccaaaaaaatccccaatctctcgaaacagttctccgggcgaccgaagcgagtcgaaggagtctctcacgatcctctcaagatgcagatcttcgttaagaccctcactggcaagaccatcacactcgaagttgagtccttggacaccattgataacgtcaaggctaagatccaggacaaggaaggcattcctcctgaccagcagaggctgatctttgctggcaagcagcttgaggatggccgcaccctcgctgattacaacatycagaagaagtcgaccctycacctrgtgctccgyctrcgtggtggtatgcagatcttygtcaagaccctcactggcaagaccatcaccctsgaagttgaatcctckgacaccattgacaacgtgaaggcaaagatccaggataaggagggcatccccccagaccagcagcgtctsatctttgccggcaagcagctggaggatggccgcaccctggcggactacaacatccagaaggagtccacccttcacctggtgctccgcctccgtggtggccagtaagtccctggccatggagctggcttttgtccctgggttcacaagtacggtgcaggtgcctcctgtgtctctggagattttctgtgttttgtgtcttggttgagtcgtggtcttttgtctgtccgatgttgagtcatgtgtggtccggttgtatttgtgaacattagctgctgtgcagcagcttcgttgaactatgtgatgaataagtgaaccctgaacttcatgtggtaatcagattgttcatgttttctgcctttctagatatatctttgtt

SEQ ID NO: 18027 - protein, 153 aa, Panicum virgatum
  misc_feature: Ceres CLONE 1795505
  misc_feature (82)..(150): Pfam Name: ubiquitin Pfam Description: Ubiquitin family
  misc_feature (6)..(74): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESLDTIDNVKAKIQDKEGIPPDQQRLIFAGKQLEDGRTLADYNIQKKSTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 18028 - DNA, 1659 bp, Panicum virgatum
  misc_feature: Ceres CLONE 1795515
  misc_feature: Encodes the peptide sequence at SEQ ID NO. 18029
ctcccctctctcgtgtcctcgcgtctgttctggggtgtggcagtctggttgccgcaacaagaggtcttggaaaggttctgatgggttgcttcgggtgcttcgcaccggaggcggaggagggagacgaggaccacaagccctccaagcccgatgattcatcaggggctgatgcgaggaggaaggtggccccggatgtggccaacggctacgcgcacagcttcaccttcaaggatctgcttgtggcgaccggctacttcaacgaggccaatttcattggagaaggtggatttgggaaggtgtataagggcaagatcaatggccagatggttgcagtgaagcagctcgctcaagatggtgtgcaggggaggaacgaattcttggtggaggtgcttatgctgactgtgctcaaccatcccaatctagtcagcttggttgggttctgcgcgcagggggacgagaggcttctcgtatacgagtacatgccgttcggcagcctggagaaccatttgtttgatgtgcctcttgacaagaaaccacttgattggaatacacgtgtgagaatagctgttggagtagcagaagggctttcttacttgcacaatctagctgatccacctgtcatttaccgtgatatgaaagctgctaatattctgctgggtgaggatttcagtccgaagctttctgactttggacttgcaaaagttgaaccagttggtgacagaactcatgtctccacaagagttatgggtacctatggctactgtgctcctgactatgttgtgactggtaaacttaccatgaaatcggacatctacagttttggtgttcttctgttggaactgataaccggcaggaggatttatgatgcgtcaaggcctaaaccagagcaaaatttgctagcatggtcaaggccatttctgcatgacaagaggaagttctaccggcttgctgatccgaatctgctgggctgctacccgtcatcggctctgaaccagttagttgtgatcagcataatgtgcctccaggaccaggcccatgtccgcccaatcatcgctgatgttgtgataggcctgaatcatgttgcaagccagccatatgcacctgagcgtccaccagtagctataagctcccctgcgaacagcgggtcaccacagttcatccgcacgccatccagaaggagaggctctaggaggactgcacagtatgcgtagccaagattgcctgcttgtctagaagaagagcaagatatctcaatcagatgagaccgttaaacctgctgacactgaagccgtcaaatttccattcagtcttgtgcctttttgattgaggaagcggtcttgagtgacctgcttgacagagagttatcttctatgaggcagatggtaggagttcgagctgaccatgactattgctcttttcctgcgctttattgttttcagttaaagttccgtagccagtgtacatagaatcagtgccttctgtgggggtaaactagtgcacaagtccaggcaaaaaagggcaagtgtgtgtgaccccctatcgggatgttcatcaagttatcagtcatgtacaaagttatcatggttggtgcatgttggcccgtaggcacagtaagtaattcacaatggttggtttagttgaaaaggcagaagatatatc

SEQ ID NO: 18029 - protein, 376 aa, Panicum virgatum
  misc_feature: Ceres CLONE 1795515
  misc_feature (59)..(329): Pfam Name: Pkinase Pfam Description: Protein kinase domain
  misc_feature: SWISSPROT Homolog: EC 2.7.11.1 Non-specific serine/threonine protein kinase
MGCFGCFAPEAEEGDEDHKPSKPDDSSGADARRKVAPDVANGYAHSFTFKDLLVATGYFNEANFIGEGGFGKVYKGKINGQMVAVKQLAQDGVQGRNEFLVEVLMLTVLNHPNLVSLVGFCAQGDERLLVYEYMPFGSLENHLFDVPLDKKPLDWNTRVRIAVGVAEGLSYLHNLADPPVIYRDMKAANILLGEDFSPKLSDFGLAKVEPVGDRTHVSTRVMGTYGYCAPDYVVTGKLTMKSDIYSFGVLLLELITGRRIYDASRPKPEQNLLAWSRPFLHDKRKFYRLADPNLLGCYPSSALNQLVVISIMCLQDQAHVRPIIADVVIGLNHVASQPYAPERPPVAISSPANSGSPQFIRTPSRRRGSRRTAQYA

SEQ ID NO: 18030 - DNA, 445 bp, Panicum virgatum
  misc_feature: Ceres CLONE 1795517
  misc_feature: Encodes the peptide sequence at SEQ ID NO. 18031
aacggcaagcacctgagggtgctgctccctttctcttgcgacagcctgcgcattcccgacgagcttgccgaggggatctgcgccggggaggcccgcgtcgtcagcccgtccggcggcagggtcaaggtctggcgcgtagaagtcgggcgggacggcggcggcgcgttcctggggcacgggtggtcggagttcgccgccgcgtgcggggccggggccgggtggctcttggtcctccggcaccacggcggcggcgtcctaaccttcgcggcgttcgatgccagcggctgtgtgagggacctcggcaccccacctgctgaggcaaccgcaagcagctaagatgaatcccgtacgccgcagttcgtcagcgtgcttgcccaatatttcaaggaaaagatgctaattccagcgaagtttgtgcaacatcatatctctgaagagcaccggg

SEQ ID NO: 18031 - protein, 111 aa, Panicum virgatum
  misc_feature: Ceres CLONE 1795517
  misc_feature (4)..(96): Pfam Name: B3 Pfam Description: B3 DNA binding domain
NGKHLRVLLPFSCDSLRIPDELAEGICAGEARVVSPSGGRVKVWRVEVGRDGGGAFLGHGWSEFAAACGAGAGWLLVLRHHGGGVLTFAAFDASGCVRDLGTPPAEATASS

SEQ ID NO: 18032 - DNA, 683 bp, Panicum virgatum
  misc_feature: Ceres CLONE 1795517-R
tttctttttttctattcaagtatcagacatagaagcatcttatagattagaacaagatgatgcagctgtaggcaccgcactactgcagtagaacctggtgaggtagctagaagtgcaggagtaagattgtgtaggcaaagctctaattttttacaagcatagatttagatactgaaatcattttattttagatctagtatcaggaacaatagtagtttgtttcactgatcattaggcaataatatgcttctgatttaggcaacttatgctacaccaataagcatttttatctactatggttcaagtgttcaacacttccatgttctagttctaggaatcttttcatatgttgctgaattttgctattttggtctattgatcaatttctgaagcaagaattcattcttactttaccattttatattctgatattttccttatttattaataccgattcaattctttattttggtgccacagcaggctcacacaaatatgatgatggtgcccgtccatatttttttggtgctagtgaatgaggcctgacgacttactttgtatgaatgtttagatgagtgaaaaatgcttttgtacctgttgaggtctcaaaaaactgcttatgaggtcaaaaaaaattgcttcatgtaaccattgagttgaattggtagtgtacaattgctcgt

SEQ ID NO: 18033 - DNA, 1855 bp, Panicum virgatum
  misc_feature: Ceres CLONE 1795521
  misc_feature: Encodes the peptide sequence at SEQ ID NO. 18034
aggccggacaaacccgcgtcggcctgccccgaccctcccccgtgctctggtcctcccgcgaccgttccaaattcctcctcgcgttcgtattccacgcggcgacgtcgccatcgcggccgccgctccgctcctcttccttcgcctatacgtaggaacccgccgctgcggccgcctccccaaaccctaagcctttttccctcccacccgcacgctccggtgcgacgcggctcgctcttcaccccgcagatcgccagcgatgggatccaaggaccagggcggaggggccgcctcctcgggcggcggcttcttctcgtcgttcgccgccggcatgcgcacctggggcaccgccgtgcacaaatccgtcaacgggttgctcggttatgagggccttgaagttattaaccctgatggaggttcggatgacgctgaagaagaggccttgagggggcgatggaagcaggaggatcgtgatagttattggaagatgatgcataaatacataggatcagatgttacatcactggtgacacttccagtcatcatttttgaaccaatgacaatgcttcagaaaatggctgagttgatggaatactgtgagttgttggacaaagcagatgaatgtgaggatccatacatgcgtatggcctatgctgctgcatgggctgtttcggtctactttgcatttcaacgtacatggaagcctttcaacccgatccttggagagacttatgagatggttaaccaccagggcatcacatttcttgcagagcaggtaagccatcatcctccaatgggtgttgctcattgtgagaacgagcattttacttatgacatcacatctaagttgaagaccaaattcttgggaaattcagtggaagtttacccagttggaaggactagggtgacactgaaaaaatctggcattgtttttgatttggtgccaccactaacaaagattaacaacctgatatttgggcgcacttggattgattcacctggagagatggtcatgacaaacctgacaactggagacaaagttgtgctatatttccaaccatgtggttggttcggggctggtcggtatgaggtggatgggtatgtgtacagtgcacaggaagaacccaaaataatgattacagggaaatggaatacatctatgagttgccaaccatgtgatcaagaaggcgaacctcttccaggcaccgagctgaaggagatctggagactcgcccctaccccaaagaatgacaaataccagtacacacactttgctcacaaaataaatagctttgacacagcacctaagaagctgttgccatctgattcccggttgaggcctgatagatatgcccttgagatgggtgacatgtcgaagtctagctctgaaaagagcaggctcgaggaacaacagagagctgagaaaagagttcgcgaggccaagggtgagcaatttactcccaaatggtttaacttgacagatgcagtcagccctaccccatggggtgacttggaggtttatgaatacaatggcaaatacaccgagcaccgagctgccatagacagctccaatgtcgccgacgagacagatatcacttcgatcgagttcaacccatggcagtacggcagctcgtcctcccaatgatttctcatggtctgaactcagaagctggcaagctttattgttattgtgtaaaacgctcccaggcctcggtttgcgctgattgttgtgctgtcagcggttttcatgcctctttgtagtattattatgaccttcctcgtgccccgtgctataactattcaggaagtaatgtatttgctgtagtccatgtactgtcattaatctagcagaacttgc

SEQ ID NO: 18034 - protein, 461 aa, Panicum virgatum
  misc_feature: Ceres CLONE 1795521
  misc_feature (30)..(433): Pfam Name: Oxysterol_BP Pfam Description: Oxysterol-binding protein
MGSKDQGGGAASSGGGFFSSFAAGMRTWGTAVHKSVNGLLGYEGLEVINPDGGSDDAEEEALRGRWKQEDRDSYWKMMHKYIGSDVTSLVTLPVIIFEPMTMLQKMAELMEYCELLDKADECEDPYMRMAYAAAWAVSVYFAFQRTWKPFNPILGETYEMVNHQGITFLAEQVSHHPPMGVAHCENEHFTYDITSKLKTKFLGNSVEVYPVGRTRVTLKKSGIVFDLVPPLTKINNLIFGRTWIDSPGEMVMTNLTTGDKVVLYFQPCGWFGAGRYEVDGYVYSAQEEPKIMITGKWNTSMSCQPCDQEGEPLPGTELKEIWRLAPTPKNDKYQYTHFAHKINSFDTAPKKLLPSDSRLRPDRYALEMGDMSKSSSEKSRLEEQQRAEKRVREAKGEQFTPKWFNLTDAVSPTPWGDLEVYEYNGKYTEHRAAIDSSNVADETDITSIEFNPWQYGSSSSQ

SEQ ID NO: 18035 - DNA, 2091 bp, Panicum virgatum
  misc_feature: Ceres CLONE 1795524
  misc_feature: Encodes the peptide sequence at SEQ ID NO. 18036
aacgactcgttccccggcgagacgaggcgagggaatagcagaggcgggcgcccgcagcccgcagcccgcagcccgggccaggccatcccattctcacccctctcttctccaccacctactctcccctcttctctctctaggtaggatcgccgacagccaaccacgcgcgtgcgcgcgcgcccgtccccccgctctttccactgcgcgcgcacaaatactgccgggagaggaacaggaggaggaggaggagcgctgcagtgccggcctgacggcctgtctcttccctgctgctgctgctgccggtggctccgttctcggcctccccccggccatgtcctccatgggcgcagatgagggctacggccctacttgggacagcgacgacgaatacgacaacttcatacgcaagatgaacccgccgaggattgtgatagataacgagtcctcagcagaggccacaattgtcagggtacattcctttggttcactgaatcgcttaaatcccatttctgcgctattgaaaattaaggttctgatgtatcctggctccatgttattacgattgtaggtggatagcgcaaatgaatatgggatattgctagaagtgatccaagttatgattgatctcaaccttgtcataggcaaggcatatattacctctgatggtggatggttcatggatgtcttcaatgtgaccgataaggaagggaagaagatcaaagatgaggaaaccctggcgcagattgaagactacatcagaaagtccttgggcgccgattcaagatacataccttcaagacggagatcagtaggcgttgctgccgcagctgaccacaatgtcattgagttgacggggacggaccggccaggccttctctcagaagtcagcgcggtgcttgccagcctcaagtgcaatgtggtcagcgccgagatctggactcacaagaccagagctgcagccgtgatgcgggtcactgacgaggacaccgggctggctgtcacagatgccgagaggctggagaggatcagggagaggctttcatacctgctccggggaggcgacctctccaggggagctgccatggcggtgtcgtccgggactgccaccacgcacaccgagaggaggctgcaccagatgatgcttgacgacggcgactatgagcagctccagcggcaggctccagagcagtctcagaggcctaatgtcacagtgagaaactggaacgacaaggactattcggtggtgaccatccggtgtaaggacaggtccaagcttctgtttgacacggtttgcactctgacagacctgcaatatgttgttttccatgcaaacattgatgccaaggataatcaagcttaccaggaattctatgtaaggcatgtgaatggatcaccgatgaacactgaaactgagagattgcgagtcatccagtgccttgaagcagctattgaacggagggtatccgagggtgtcaagcttgagctgtgtactactgacaaggtcggcctgctatctgaggtcacccgcatcttccgtgagaacagcctgactgttactagagcagaggtgaccacaagaggcaggatggctgtcaacgcgttctacgtccgcggttctgcaggcgaggcggtcgatcagaagacaatagactccatcaggcaagccatcgggcagaacctccaggtgaaaggccagcctgagccaccggagccacagaagaacgagtcccccacatggttcctcttcgccaacttgttccggccgaggtctctctacagctttggtttgttcatgcgctgatcatatcgccgcgtcctgaaaaccaccatgtaaattcattagccatgaagcaaagttcaggaaaaccgggggatcagaaataacaagcgttctctcatcagctctagtagtgcaggatatattggggtctagatagcatatggggatgttcattcatatatcatggttctctgtaaatatagtcagtttcgccatcctcgtgttgtacatacatttagaatgtagataaaggatgtaaatataagctgtacagtacagaatatgattgaatcccagatggttaccacctc

SEQ ID NO: 18036 - protein, 394 aa, Panicum virgatum
  misc_feature: Ceres CLONE 1795524
  misc_feature (74)..(146): Pfam Name: ACT Pfam Description: ACT domain
  misc_feature (286)..(352): Pfam Name: ACT Pfam Description: ACT domain
  misc_feature: SWISSPROT Homolog: EC 2.7.7.59 [Protein-PII] uridylyltransferase
MIDLNLVIGKAYITSDGGWFMDVFNVTDKEGKKIKDEETLAQIEDYIRKSLGADSRYIPSRRRSVGVAAAADHNVIELTGTDRPGLLSEVSAVLASLKCNVVSAEIWTHKTRAAAVMRVTDEDTGLAVTDAERLERIRERLSYLLRGGDLSRGAAMAVSSGTATTHTERRLHQMMLDDGDYEQLQRQAPEQSQRPNVTVRNWNDKDYSVVTIRCKDRSKLLFDTVCTLTDLQYVVFHANIDAKDNQAYQEFYVRHVNGSPMNTETERLRVIQCLEAAIERRVSEGVKLELCTTDKVGLLSEVTRIFRENSLTVTRAEVTTRGRMAVNAFYVRGSAGEAVDQKTIDSIRQAIGQNLQVKGQPEPPEPQKNESPTWFLFANLFRPRSLYSFGLFMR

SEQ ID NO: 18037 - DNA, 1434 bp, Panicum virgatum
  misc_feature: Ceres CLONE 1795555
  misc_feature: Encodes the peptide sequence at SEQ ID NO. 18038
accacctcccaaatccggaagcgaataaacaaggcaggattccggccgcggtccgtaccccagcgtcggcgtcccctccaaaccttgcggcttgattcgcgcgatcggagctcgtttggcgggaaggctctcgctctcctgccggcgcttcagctggagcacttgcggggtcgcttagtgttcgggtgggggcgtcagagttgtcggccttttcttttcgtttcggagcaaatttctcgctgccgcagccaatcgggactgctcctgttccctatctattgcccaatcgatttagcttttgctctgatttccccccaaaatcgcgtctctgcctattttttacccaaattgctatcctgatttcgctgtgttagtctggcgatgcaaactgcagctgatttcgggaatattttcagcttaccctgatttcgctgcaatttgctgaaaccgctgagccgtcgctgctcgcgtgatctgatagctgctgaagcgggggcagttgccgctggctgctggttgggggctgaatttggatagacaagtcttggaaaggcgcaaccttttttggtgaccatgacgctacttgaggagttgatccgggcgatagagctctggctgcggattgtcaaggagcaggtgcccttggtcgatccaacccttgacccggtgctacttgttcctggtattgccggctccatccttgaagctgttgatgaggctgggaataaggagagggtgtgggtgcgcatccttgctgcagagcatgagttccgagagaagctctggtccagatttgatgcctccactggtaaaactgtatctgtgaataagaaaacaagaataactgtccctgaggataggtatggtttgtatgccattgacacattagacccagacatgatcataggcgatgagactgtgtactactatcatgacatgatagtggaaatgattaaatggggatataaagaaggaaaaactctctttgggtttggttacgatttccgccaaagcaacaggctctcagagacacttgacagattttccaaaaagctggagtcagtttacgcagcttctggtgggaaaaagataaatcttattactcactcaatggggggattgcttgtcaaatgtttcatatctcttcacagcgatgtatttgaaaaatatgttaagagttggattgcaattgctgcaccattccaaggtgcccctgggtacataactactagtctgctgaatggaatgtctttcgtcgaaggatgggaatcaaaattctttatttccaagtggtgtatgcagcaattgctacttgagtgcccatcaatctatgagttgttggcaaacccaaacttccagtggaaagacaccccacggctacagatttggagagaaaatttggacaacaatggtaagaaaagtgccctgttggag

SEQ ID NO: 18038 - protein, 286 aa, Panicum virgatum
  misc_feature: Ceres CLONE 1795555
  misc_feature: SWISSPROT Homolog: EC 2.3.1.43 Phosphatidylcholine--sterol O-acyltransferase
MTLLEELIRAIELWLRIVKEQVPLVDPTLDPVLLVPGIAGSILEAVDEAGNKERVWVRILAAEHEFREKLWSRFDASTGKTVSVNKKTRITVPEDRYGLYAIDTLDPDMIIGDETVYYYHDMIVEMIKWGYKEGKTLFGFGYDFRQSNRLSETLDRFSKKLESVYAASGGKKINLITHSMGGLLVKCFISLHSDVFEKYVKSWIAIAAPFQGAPGYITTSLLNGMSFVEGWESKFFISKWCMQQLLLECPSIYELLANPNFQWKDTPRLQIWRENLDNNGKKSALL

SEQ ID NO: 18039 - DNA, 670 bp, Panicum virgatum
  misc_feature: Ceres CLONE 1795555-R
agtcacctcttatatgctcagggaaaatatgtctatgttgatggtgatggatctgtcccagtagaatcagcaaaggcggatgggtttaatgcagtggcaagagttggtgttgcagctgaccaccgaggaatcgtctgcagccaccatgtattccggattgtccagcactggctgcatgctggagaacctgatctgttctacaaccccctgaacgactatgtcatactcccaacagcctatgagatcgagaagcatcatgagaaatgtggggatctcacatcagtttccgaggactgggagatcatctccccaagcgatgacaaaaccacaaggccagccgagtttcctcctatggtcggcacgttaactgcaagtcgggaaggcaaggagggcatgctggaagaggcgcaggcaacaatcgttgttcacccagagaacaaggggcggcagcatgtggaagttagggctgttggtgtcagccatggtgggtaggcgtaggaaccacgttggttgtttggcagctaaacctctgggcacagtggcacacaatgtaaagtgcatgtacatatggactacggggctctgtaggaaatctgtgtttagagctgtaaaaatgtttattctgcgtgtaaatgttcactcagaactaaatgagcaaagtggtgtttgg

SEQ ID NO: 18040 - DNA, 2534 bp, Panicum virgatum
  misc_feature: Ceres CLONE 1795557
  misc_feature: Encodes the peptide sequence at SEQ ID NO. 18041
atcaatgaattgatcatcgccgctctccattccgacaaggaaaaaccattcctttgatcctgcaggttctccgagcgtatatttttttatatatatatacttctcccttcccgcggacgcggcggcggccggcggcgctcgatccccgcgcgaccttgttgctcacgcccgcgcccggcgacccggcccggcggcgtcctcggcctggggacaaatgcggcggccccggtgggaagcttgagcggccggcgctccgtttgctcgcacgacgcgcgcccacggcctccctccctcgaattgctcggcaggttaattaggagttattttattacccaaagatggttaatcagaagccagatggagcgacagcagatgaaaccagcatctccacacagcctccctcctataatatatctcaagcgccacctgtgtacaaagttgggtatcctcctcagaagaacctcaccacagagtttacaaacacactgagggagacattcttccatgacaatccactaaagcaatataaggaccaatctggatcaacaaagtttaaaatgggtttgcagttcttgttcccagtctttgattggggtaggacctacaacttgaacaagttcaaaggtgatctgattgccggattgacaattgcaagtctctgcattcctcaggatattggctactcaaagcttgcttatctggatccgcagtatggactttactccagcttcgtccccccattgatatatgctgcaatgggtagctcaagggatatagcaattgggccagttgcggttgtatctcttttaataggttcactcctacaaaatgaagttgatcatgaaaagaacaaggaggaatacttgcgtcttgcttttacagcaaccttctttgctggtattacccaagcagccctggggtttctaaggttaggattcctcatagagttcttgtcacatgctgcaattgttggattcatggggggagcagcaatcactattgccctgcagcagctcaaatatgtgttgggaatcaggaacttcacaaaggaaactgatatagtttctgttatgaagtctgtttggggttcggttcatcatgggtggaactggcagacagttgtgattggcttcgctttcctggtttttcttctgcttgcgaagtacattgggaaaaggaataagaagtatttctgggtgccagctattgctcctataacttctgtcattcttgctaccctttttgtatatcttttccgtgctgacaaacatggtgttcagattgtgaataatatcaagaagggcatcaacccatcatctgtgcacaagatttatttcaccggtccatttgttgcaaaaggtttcaagatcggtgttgtctgtggcatgatcggtttgacggaagccgtggcgattggaaggacatttgctgccatgaagggctaccagttagatggaaacaaggagatggtagcacttggaacaatgaacattgtaggctcaatgacgtcttgctatatcgcaacaggttctttctcacgttctgcggtcaatttcatggctgggtgccgaacaccagtatctaatgttgttatgtcgatggttgtgcttctcaccttgttggttatcacaccgttgttcaagtatacgccaaatgcaatccttggatcaatcattatttctgctgtgattggtcttgtggactatgaagcagcaattctcatttggaaagttgataaaatggatttcatcgcctgcatgggagcattctttggtgtggttttcaaatctgttgagataggcctcttgattgctgtgtcaatctcattcgccaaaatccttcttcaagtaacaagaccaaggactgtactgctcggaaaccttccaggcaccacaatttacaggaacactgatcagtatccagatgcaaggcatgttccaggggtggtaatagtgagggttgattccgctatctatttctccaactccaattatatctgggagagaattcttaggtggttgacagatgaagaagagaaagtcaaggcagaggaactgtctaaaatcaatttcttgatagtggagatgtcacctgttatagatattgatacaagtggtatccatgcccttgaagatctgcacaagaatcttcagaagagaggcattcagctcctcctatcaaatcctggctccatcgtcattgagaagctccagtcgtcgaaactcactgagcacatcggaagcaatcacattttcctgacagttgctgacgccgtgtgtttctgcacttcaaagtcgatgcaagagccctgaattgaaatggatttacatcaggcatctgcattctagtatatgcatcatgcaatgatgatacaagatcacaaatcataggacattttcgaaggtagtgcccactgttgcttaacgcaaaagcgggcgatagcatttcaaactgatgtagttctgttgtttcgacttttgaacactgcttacagacaagtagatcgggtcaatgtatagctaaatgctgtgatc

SEQ ID NO: 18041 - protein, 657 aa, Panicum virgatum
  misc_feature: Ceres CLONE 1795557
  misc_feature (193)..(504): Pfam Name: Sulfate_transp Pfam Description: Sulfate transporter family
  misc_feature (527)..(645): Pfam Name: STAS Pfam Description: STAS domain
MVNQKPDGATADETSISTQPPSYNISQAPPVYKVGYPPQKNLTTEFTNTLRETFFHDNPLKQYKDQSGSTKFKMGLQFLFPVFDWGRTYNLNKFKGDLIAGLTIASLCIPQDIGYSKLAYLDPQYGLYSSFVPPLIYAAMGSSRDIAIGPVAVVSLLIGSLLQNEVDHEKNKEEYLRLAFTATFFAGITQAALGFLRLGFLIEFLSHAAIVGFMGGAAITIALQQLKYVLGIRNFTKETDIVSVMKSVWGSVHHGWNWQTVVIGFAFLVFLLLAKYIGKRNKKYFWVPAIAPITSVILATLFVYLFRADKHGVQIVNNIKKGINPSSVHKIYFTGPFVAKGFKIGVVCGMIGLTEAVAIGRTFAAMKGYQLDGNKEMVALGTMNIVGSMTSCYIATGSFSRSAVNFMAGCRTPVSNVVMSMVVLLTLLVITPLFKYTPNAILGSIIISAVIGLVDYEAAILIWKVDKMDFIACMGAFFGVVFKSVEIGLLIAVSISFAKILLQVTRPRTVLLGNLPGTTIYRNTDQYPDARHVPGVVIVRVDSAIYFSNSNYIWERILRWLTDEEEKVKAEELSKINFLIVEMSPVIDIDTSGIHALEDLHKNLQKRGIQLLLSNPGSIVIEKLQSSKLTEHIGSNHIFLTVADAVCFCTSKSMQEP

SEQ ID NO: 18042 - DNA, 2412 bp, Panicum virgatum
  misc_feature: Ceres CLONE 1795560
  misc_feature: Encodes the peptide sequence at SEQ ID NO. 18043
acgaaaggaacgcgcccaatctggtcctgctgctgctgctgctgcggtggtggaggtggttcccggcggcctccagggcagggcagccgctacccccgcgccggccccgacccgccgctgccacccgccgacgccaccgtcggagccatggcgggctccatggtggaccgggccaccagcgacatgctcatcggcccggactgggccaagaacatggagatctgcgacatctgcaaccgcgaccccgggcaatcaaaagatgttgtcaaggcgctaaaaaaacgaattgggcacaaaaatccgaaagtccaactccttgcactgaccctgttggaaactgttatcaagaactgtggtgatatactccacatgcatgttgcagagagagatatattgcatgagatggtgaagatagtgaagaagaagtctgatcctcgtgtcaaagagaaggtattggtgctaatagatacatggcaggaagcttttgggggaccacgtgcaagatatccgcaatactatgcggcgtaccatgagttgatgcgagctggagctgaatttcccaagagatctgagaaaccagcgcctttgtttaatggtcagtctcaagcagcaaggaatatgcgtagtcctgatcaacaagaggaagctgaatcttctgctgccaatgactttcctgctttgagcatgtcagagattcagaatgctcgcggtatcatggatgtgctagcagagatgctgaatgctttagacccaggaaacagagagggactaaggcaggaggtaattgtggagcttgtggatcaatgtcgcacttacaagcagagagtggtgcagctagttaatacttccacggatgaggaacttatgtcgcaggggcttgcactgaatgatgatttgcaacgtgttcttgcgaagcatgatgcaatagcagctggcattgcagtccgagtggagaaaaaaccaaagtctctgcaagcgcttgttgatactgaggactctgccaaccaggacgctaacagagacaaagagaaagaaaaaggactcatagatattgaggaccccacaagccaagattcaaaaaatgagccaaagcaaagtacaagtgaccaatctccttttgagcaattagcgcttccagcaccaccagtttcaaatggcacagcaacctctgcacccaaatccgatcttggcattgatcttctcagctgggacgatacccctactacagcagaaaatccgcttgcgcttgttccagtcactgatcctctcgctgactctactccatcaaatcaaaatgcgctagcaatcgtcgacgcattttcacaaaataacactgccaacagcaacgctcatccagctgatccctttggtctcaattcaagctccactatgccgggatcacagccatacaatactccagcacagcatccgttacagccacaacagcctcagcaggcagcaccgctctatccaaacgggggtgctgtgaatgttgggacatcttacgagcaggcaccccagtttaataacatgagttctggttggaatggtcaagttgccagtcctgcacccccaccacagcaagcccagagctatgatgaccaaagtggatcccttccaccacctccttgggaagctcagtcagcagcaaccaatgaattgccaaatggccaattggggggaggtatgcaacctctcccggctctgccagcaggccagatcggcagcatgcagcagccacagcaaccacagatgaaccatatgggagtcccacaaacccagccaatatacaaccaacaaggagtctcgttgcctcaagcgatgcagcctggccaagctgccggcttcgggaaccagcaatttggtttgttacctccagcctccatgccaggcatgcaattccccggcatgcaaccttcacaaatgtatggcggatcgcagccagccatgatgtatccacaacagatgccaggggcacagtacggagcaatgcctcaacagcaacccatgtatggtggccggttggcgggatacatgcagcatcccgcggtggctgctgcacactactacaaccagggaacgccgggaatgtatgggtaccctggtgcgaacaacctgtctcagaggatgtatggcctctccgtgcaggacaactcgtacatggggatgagctcgtcctaccagacggcaccctccacggggcaacctatgcggccgacgaagcctgaagacaagctttttggtgacctacttagcattgccaagacgaagaaagcttcatgagagaatgagcgagagcgcgggcggtctaatatattgtctcccctatttttgcgatttttcttgtttgatgatcttacacttgtaacattatttgaatgtataatcttttggttttcttttcacgctgcg

SEQ ID NO: 18043 - protein, 711 aa, Panicum virgatum
  misc_feature: Ceres CLONE 1795560
  misc_feature (1)..(134): Pfam Name: VHS Pfam Description: VHS domain
  misc_feature (173)..(271): Pfam Name: GAT Pfam Description: GAT domain
MAGSMVDRATSDMLIGPDWAKNMEICDICNRDPGQSKDVVKALKKRIGHKNPKVQLLALTLLETVIKNCGDILHMHVAERDILHEMVKIVKKKSDPRVKEKVLVLIDTWQEAFGGPRARYPQYYAAYHELMRAGAEFPKRSEKPAPLFNGQSQAARNMRSPDQQEEAESSAANDFPALSMSEIQNARGIMDVLAEMLNALDPGNREGLRQEVIVELVDQCRTYKQRVVQLVNTSTDEELMSQGLALNDDLQRVLAKHDAIAAGIAVRVEKKPKSLQALVDTEDSANQDANRDKEKEKGLIDIEDPTSQDSKNEPKQSTSDQSPFEQLALPAPPVSNGTATSAPKSDLGIDLLSWDDTPTTAENPLALVPVTDPLADSTPSNQNALAIVDAFSQNNTANSNAHPADPFGLNSSSTMPGSQPYNTPAQHPLQPQQPQQAAPLYPNGGAVNVGTSYEQAPQFNNMSSGWNGQVASPAPPPQQAQSYDDQSGSLPPPPWEAQSAATNELPNGQLGGGMQPLPALPAGQIGSMQQPQQPQMNHMGVPQTQPIYNQQGVSLPQAMQPGQAAGFGNQQFGLLPPASMPGMQFPGMQPSQMYGGSQPAMMYPQQMPGAQYGAMPQQQPMYGGRLAGYMQHPAVAAAHYYNQGTPGMYGYPGANNLSQRMYGLSVQDNSYMGMSSSYQTAPSTGQPMRPTKPEDKLFGDLLSIAKTKKAS

SEQ ID NO: 18044 - DNA, 2025 bp, Panicum virgatum
  misc_feature: Ceres CLONE 1795581
  misc_feature: Encodes the peptide sequence at SEQ ID NO. 18045
ctacctggcaaccttcgaaaccgggcgctcccggatccacccccgaagtccaaaagcgaagcccaccagcgccgcaacggcgaaaccatcggaaccctagatccctctcgcctgaggtccagaaccctagatccaccatgcaccagcccagagcccgctacccgcccggctacggcggaggcggcggcgtaggaggaggaggcggcggcggcggaaatcacaactactacggccgaaacccgcagccgcagccgcaccaccaccaacactaccagcaccagcagccgccaccgcagcaacaaccgcagcagcacgcgcataggaactcatcgcatcagcatcagcagtggctgcggcgagatcagggccccgcctccgccgcggggtctggagatgctgcggtgaggacggcggcgcagctcgacgctgtagactcgagttctcaagattggaaggcgcaattgaatataccagctccggatacacgctacaggacagaggatgtcactgcaacaaaaggcaatgagttcgaagattattttttgaaacgtgagctgcttatgggaatctatgaaaagggctttgaaaggccatcccctattcaagaagaaagcattccgattgcactgactggaagtgatattcttgcaagagcgaaaaatgggactgggaagactgcggcattttgcattccagcacttgaaaaaattgatcccgagaaaaatgccattcaagttgttatactggtaccaacaagggaactggctctgcagacttcacaagtctgtaaggagctcgggaagtacctgaacattcaagttatggtcagcactggtggaaccagcttgagggatgacatcatgcgtttgtaccaacctgttcatttacttgttgggactcctggccgtatactggatcttaccaggaagggcatttgtgtgctgaaagattgttcaatgcttgtcatggatgaggctgacaagctattagctccagagttccagccttctgtagaggcacttattcatttccttccacctagtcggcaactgttgatgttttcggcaacctttcctgttactgtcaaggaattcaaagagaaatacctgcctaaaccttacgttattaatcttatggatgaactgaccctgaaagaaatcactcaatactatgcttttgtcgaagaaagacagaaagttcattgcctgaatacacttttctctaagcttcaaattaatcaatccattatattctgcaactccgttaatagagttgagctactagctaagaaaataactgaacttggttattcatgcttctacattcatgctaagatgttgcaagaccacagaaaccgagtgtttcatgattttcgcaatggtgcttgcagaaaccttgtgtgtacagatctgtttaccagaggaattgacatccaggctgttaatgtggtcattaactttgacttccccaagacctctgagacatacttgcacagggttggtcgttctggtcgatatggacaccttggtttggcagtgaacttgatcacttatgaggatcgtttcaacttgtatatgattgagcaagaactcggaacagaaattaagacaatacccccacaaattgacctggccgtgtattgccaatgatcagcgctgcagtttccaaaacatcaatgcatttattttcatgaaaaacttgtcaggaaaatacagatgtacatagcacccatcaaggttcgctttggtgccttggtgatgtttctaagcttacttcaagtagtagaggaagggtttcctgtcggcactgataccattcagtttaactgagggcatgggcactgggcttgcttgagaggtccggaacatcgatcagagaaaacagttcttacttcatagatcctgttaacattttcattgtacttgtttgcctaagcacctcttgattcgtcagttttttttttcattttctttccttctgttatgacacatggatatttttttttagccagcttattttgtgttt

SEQ ID NO: 18045 - protein, 503 aa, Panicum virgatum
  misc_feature: Ceres CLONE 1795581
  misc_feature (153)..(319): Pfam Name: DEAD Pfam Description: DEAD/DEAH box helicase
  misc_feature (385)..(461): Pfam Name: Helicase_C Pfam Description: Helicase conserved C-terminal domain
  misc_feature: Functional homolog of the protein sequence given in SEQ ID NO 50788
  misc_feature: Useful for making plants with altered lignin content
MHQPRARYPPGYGGGGGVGGGGGGGGNHNYYGRNPQPQPHHHQHYQHQQPPPQQQPQQHAHRNSSHQHQQWLRRDQGPASAAGSGDAAVRTAAQLDAVDSSSQDWKAQLNIPAPDTRYRTEDVTATKGNEFEDYFLKRELLMGIYEKGFERPSPIQEESIPIALTGSDILARAKNGTGKTAAFCIPALEKIDPEKNAIQVVILVPTRELALQTSQVCKELGKYLNIQVMVSTGGTSLRDDIMRLYQPVHLLVGTPGRILDLTRKGICVLKDCSMLVMDEADKLLAPEFQPSVEALIHFLPPSRQLLMFSATFPVTVKEFKEKYLPKPYVINLMDELTLKEITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYMIEQELGTEIKTIPPQIDLAVYCQ

SEQ ID NO: 18046 - DNA, 748 bp, Panicum virgatum
  misc_feature: Ceres CLONE 1795591
  misc_feature: Encodes the peptide sequence at SEQ ID NO. 18047
atctctcgcgacccgaaagccccctccaaccctagccgcctcctgcaagcttcagagctcaggaatcaggccgccatggcgacggagacggagaccttcgccttccaggccgagatcaaccagctgctctccctcatcatcaataccttctactccaacaaggagatcttcctccgcgagctcatctccaactcttccgatgcgttggacaaaatcaggttcgagagcctcactgacaagagcaagctcgatgcgcagccggagctgttcatccacattgtccccgacaaggccagcaacacgctctccatcatcgacagcggcatcggcatgaccaagtccgacctcgtcaacaacctcgggaccatcgccaggtccggtaccaaggagttcatggaggcccttgccgccggcgcggacgtgtccatgattgggcagttcggtgttggtttctactccgcctacctcgttgctgagagggtggttgtgaccaccaagcacaacgacgacgagcagtacgtgtgggagtcccaggccggcggatcgttcactgttacccgtgacacgtccggggagcagcttggcaggggtactaagatcacgctcttcctcaaggacgaccagttggaatatcttgaggagcgccgcctcaaggatctggtcaagaagcactctgagttcatcagttaccccatctccctgtggactgagaagacaactgagaagggaatttctgatgatgaggatg

SEQ ID NO: 18047 - protein, 224 aa, Panicum virgatum
  misc_feature: Ceres CLONE 1795591
  misc_feature (28)..(182): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKDDQLEYLEERRLKDLVKKHSEFISYPISLWTEKTTEKGISDDED

SEQ ID NO: 18048 - DNA, 670 bp, Panicum virgatum
  misc_feature: Ceres CLONE 1795591-R
  misc_feature: Encodes the peptide sequence at SEQ ID NO. 18049
gctgaaggagaagtttgaggggctctgcaaggtcatcaaggaggttctgggcgacaaggttgagaaggtggtggtctctgaccgtgttgtggactcaccgtgctgccttgtaactggcgagtacggctggactgccaacatggagaggatcatgaaggcgcaggccttgagggactcgagcatggcgggctacatgtcgagcaagaagaccatggagatcaacccggagaatgccattatggacgagctccgcaagcgtgctgaggccgacaagaacgacaagtcagtgaaggacctggtgatgctgctcttcgagactgcacttctcacctccggcttcagcctggacgaccccaacaccttcggcaccaggatccaccgcatgctcaagctcggcctgagcattgacgaggacgagtctgctgaagcagatgctgagatgcctccactggaggatgacgctggcgagagcaagatggaggaggtcgactaagcgtctgcggtttatccttagttatctgtcgtagcttaatctgactactgttcgatgcttttggcacgttattggttttgtgtaagctagctacgagtgtggttaagctggtacctgtggtaccttgtcaaacagtttattgctatcacttaaattctatatgctagatatttctgc

SEQ ID NO: 18049 - protein, 163 aa, Panicum virgatum
  misc_feature: Ceres CLONE 1795591-R
  misc_feature (1)..(163): Pfam Name: HSP90 Pfam Description: Hsp90 protein
LKEKFEGLCKVIKEVLGDKVEKVVVSDRVVDSPCCLVTGEYGWTANMERIMKAQALRDSSMAGYMSSKKTMEINPENAIMDELRKRAEADKNDKSVKDLVMLLFETALLTSGFSLDDPNTFGTRIHRMLKLGLSIDEDESAEADAEMPPLEDDAGESKMEEVD

SEQ ID NO: 18050 - DNA, 1923 bp, Panicum virgatum
  misc_feature: Ceres CLONE 1795616
  misc_feature: Encodes the peptide sequence at SEQ ID NO. 18051
accagtcgaaagatccatccacaaagatttttcttctctgtccctctccgtctctccccctcctcacaaccctctccccctctcctctcccagcgaccaacatataaagcaggcacacacacacacacagcgcatcgagcaagaaccaagacaggcagcagggccatcagtctgcgggcaatcgcagctgatctgcttctcagcaagatcagttggttggatggccatcttcttcgtcctcgtgtgcagcctcatcttcgtagccatcgcctcgtacgtccactacgctcgccggcggcagggtgagggccaaggcggcggctacggcggcggccatgccaaggcggcttccccgaagctgccccctgggtccatgggctggccttacctcggcgagaccctgcagctctactcccaggaccccaacgtcttcttcgcctccaggcagaggcggtacggcgagatattcaagacgcacctcctggggtgcccgtgcgtgatgctggcgagcccggaggcggcgcggttcgtgctggtgacgcatgcgcacctgttcaagccgacgtacccgcggagcaaggagcgcatgatcgggccgtcggcgctcttcttccaccagggcgagtaccacctccgcctccgcaggctcgtgcagggcgcgctcggccccgacgcgctgcgggcgctcgtgccggaggtcgacgccgccgtgcgctccacgctcgccgcctgggacggccgcgtcatgagcacgttccacgccatgaagaggctgtcgttcgatgtgggcatcgtgacgatcttcggcggccggctcgacgaacggcgcaaggcggagctgaggaggaactactccgtcgtggagaaaggctacaactgcttccccaacagcctcccggggacgctgtaccacaaggcgatgcaggcgcggcggcggctgcacggcgcgctgagcgacatcatgcgcgagcggcgggagcgcggcgagccggggtccgacctgctgggttgcctgatgcagtcccggggcgacgacggcgcgcccctcctcaccgacgagcaggtcgccgacaacatcatcggcgtgctgttcgcggcgcaggacacgacggccagcgtgctcacctggatcatcaagttcctccgcgaccaccccaagctcctggaggccgtccgggcggagcaggcggcggtgcgcgaggccaccggcggcgggaggcggccgctgacgtgggcgctcgccaggagcatggcgctgacgcacagggtgcttttggagagcttaaggatggcgagcatcatctccttcacattccgggaggccgtggctgacgtggagtacaaagggttccttatccccaaggggtggaaggtgatgccgctcttcaggaacatccatcacaacccggactacttccaggatccacacaagttcgacccttgtagattccaggtggcgccgcggccgaacaccttcctgccatttgggagcggcgtgcacgcctgcccggggaacgagctggccaagctcgagatgctggtcctcatccaccacctggtcaccggctacaggtgggagattgttggatccagtgacgaggtcgagtacagcccattccccgtgcccaagcatggcctgcctgtcaggttatggagagagaacaggaccgcggaccggaagggtggttctaagagcgatgatgttgaggacatgatagtttgacattcaaattaggcattaatttaacctagctagctagagagtttttttgtttctttctcgttttcttttccttttctttgcttgcccttctcctgatcaaattaagttggaggacaagaaacgtcagctttctctttctctttttctttacttgttcctgataatggtgaaaaagtaagctaatgtagtaagctatgtgg

SEQ ID NO: 18051 - protein, 500 aa, Panicum virgatum
  misc_feature: Ceres CLONE 1795616
  misc_feature (48)..(475): Pfam Name: p450 Pfam Description: Cytochrome P450
  misc_feature: SWISSPROT Homolog: EC 1.14.13.93 (+)-abscisic acid 8'-hydroxylase
MAIFFVLVCSLIFVAIASYVHYARRRQGEGQGGGYGGGHAKAASPKLPPGSMGWPYLGETLQLYSQDPNVFFASRQRRYGEIFKTHLLGCPCVMLASPEAARFVLVTHAHLFKPTYPRSKERMIGPSALFFHQGEYHLRLRRLVQGALGPDALRALVPEVDAAVRSTLAAWDGRVMSTFHAMKRLSFDVGIVTIFGGRLDERRKAELRRNYSVVEKGYNCFPNSLPGTLYHKAMQARRRLHGALSDIMRERRERGEPGSDLLGCLMQSRGDDGAPLLTDEQVADNIIGVLFAAQDTTASVLTWIIKFLRDHPKLLEAVRAEQAAVREATGGGRRPLTWALARSMALTHRVLLESLRMASIISFTFREAVADVEYKGFLIPKGWKVMPLFRNIHHNPDYFQDPHKFDPCRFQVAPRPNTFLPFGSGVHACPGNELAKLEMLVLIHHLVTGYRWEIVGSSDEVEYSPFPVPKHGLPVRLWRENRTADRKGGSKSDDVEDMIV

SEQ ID NO: 18052 - DNA, 1633 bp, Panicum virgatum
  misc_feature: Ceres CLONE 1795618
  misc_feature: Encodes the peptide sequence at SEQ ID NO. 18053
aacccaactagcaaacccaccacttctgcatccgggccgaaacctttcctcgaacgcaagaaagaagaacccccccgagccggcgatggcgacggtggcgatggacatctcgaagcccacgccggcggcgtccggcgacgaggccgcggcagcggcgaaggggaggagcagcggcggaggcgagggcctccgccagtactacctgcagcacatccacaacctgcagctccagatccggcagaagacccacaacctcaaccgcctcgaggcccagcgcaacgacctcaactcccgagttagaatgctcagggaagagctgcagttgcttcaagagcctggatcatatgttggtgaggtggtgaaggtcatgggcaaatcaaaggttctggtgaaggtgcacccagaaggcaaatatgttgtggatattgataagagcattgatattacgaagatcacaccttcaacaagagttgctcttcgaaatgacagctatatgctccatctgatcctgccaagcaaagttgatccattggtcaacctcatgaaggttgagaaggttcctgattctacttatgatatgattggaggccttgaccagcaaattaaagagatcaaagaggtcatcgagcttccaatcaaacatcctgagctgtttgagagccttggaattgcccagccaaaggatgtcctcctttatggacctccaggcacaggaaagacattgctggcacgtgcagttgctcatcacactgattgcaccttcatcagggtttctggttctgagctcgttcagaagtatattggtgagggctcccgtatggttcgtgaactattcgttatggccagggaacacgcaccgtccattatatttatggacgaaatagattctattggatctgctagaatggagtcgggaactggcaacggtgatagtgaagtgcagcgtaccatgcttgagcttctgaaccagcttgatggttttgaagcatcaaacaaaattaaggttctgatggcaacgaacagaatcgacatcttggatcaagcccttctgaggcctggtcgcatagacaggaagattgaatttccaaatcccaatgaggattcacgtttcgatatcttgaagattcattcaagaaaaatgaacttgatgcgtggtattgatttgaaaaagatcgcagagaagatgaatggagcctcaggagctgagctgaaggcggtctgcacagaagctggcatgtttgcccttcgtgagagaagggtacacgttacacaggaggacttcgaaatggcggtcgctaaggtgatgaagaaagacacggagaagaacatgtccctgcgcaagctctggaagtgaggttcatgccagagatgtcccacaaccttcacagcctcgccaaagctcgctccttcatatcccgagctttttccgccttgccatagcagtggaatggtcacagcatgctccggacattcaccatgtgcttttttctttaactttatgccgtgcatgcatatgtttaaggttttctgataacagatgtagtatgttgttgcaaagttaaaatttatagatggatcagctagatacaggataatgcattgttcgctcgtgatgtaccacgttacaataccc

SEQ ID NO: 18053 - protein, 422 aa, Panicum virgatum
  misc_feature: Ceres CLONE 1795618
  misc_feature (200)..(388): Pfam Name: AAA Pfam Description: ATPase family associated with various cellular activities (AAA)
  misc_feature: SWISSPROT Homolog: EC 3.6.4.3 Microtubule-severing ATPase
MATVAMDISKPTPAASGDEAAAAAKGRSSGGGEGLRQYYLQHIHNLQLQIRQKTHNLNRLEAQRNDLNSRVRMLREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKDVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRFDILKIHSRKMNLMRGIDLKKIAEKMNGASGAELKAVCTEAGMFALRERRVHVTQEDFEMAVAKVMKKDTEKNMSLRKLWK

SEQ ID NO: 18054 - DNA, 1415 bp, Panicum virgatum
  misc_feature: Ceres CLONE 1795623
  misc_feature: Encodes the peptide sequence at SEQ ID NO. 18055
accgccactgtatagatcgccgccggtgacggtgatggccccggctgtggcagccgctgcgtcggctgcggtgagccaggccctgcgggaccgccagatcctcgacgctgtgggaaccggtgccgcggcgctctcgctggtgggctcctccttcatcgtgctctgctacctcctcttccgcgagctccgcaagttctccttcaagctcgtcttctacctcgccgtctcggatatgttttgcagcttattcactatactggggggcccatcgaatgcattttactgctttgcacttgactacagtgctcatttcttctgtctggcttcttttctatggacaaccactatagcattcactctgcatcgcacggttgtcaaacacaaaactgatgttgaagaatttggatctattttccacttatatgtctggggaacttcactagctaccactgtattacgttcgataggaagtgagtatggaaggccaggttcctggtgctggatccagcaaggaagcatggcaaaggttctgcacttgataactttttatcttccactttggggtgccattctgtacaatgggttcacatactatgaagtaaatcgcatgctgaacaatgcaacacggatggctgctggcataagtgatcgatcaaatcaatctgacattagggcagacagaaaggcatttaatcgatggggttattaccctctaattttgatcggttcatgggcttttgcaactatcaatcgactttacgactttaccaatccaggacacaagatattttggttgtcctttcttgatgttgggtttgctggacttatgggccttttcaattccattgcttacgggctcaactcttctgtgcgccgagctatttcagaaagaatcgacacgttcctacctgagagaattaaaaggagcctccctacattgtcaagattgagaagtcaacaggaaaatgaactgacctctctcatcgtcgagggaaactgatatgactatgcgagcaatacttaggagtttgaagcgtgctatgtttgtcaatatcttttgggttctacaatctttaaggtacatcgattaggagcaactgttcagcattgacaatttggttcgggtacttttggagtcagttccactgggctcattgttgaggttgttttctacactgttggtgtgccaaagttccattgcatagcatataggaggttaggagatagaaaccctcagtagatattctgatgttcatctctagcgtataggtcagattggcattctttcactccccctccctgatgtatttcttgaggatttgtttcttcagtaagcatgtgtaatcacctctatacaattcaatgacattgtttaaagatagagctgttcaattgcacctttttttttttgccag

SEQ ID NO: 18055 - protein, 321 aa, Panicum virgatum
  misc_feature: Ceres CLONE 1795623
  misc_feature (14)..(321): Pfam Name: Dicty_CAR Pfam Description: Slime mold cyclic AMP receptor
MAPAVAAAASAAVSQALRDRQILDAVGTGAAALSLVGSSFIVLCYLLFRELRKFSFKLVFYLAVSDMFCSLFTILGGPSNAFYCFALDYSAHFFCLASFLWTTTIAFTLHRTVVKHKTDVEEFGSIFHLYVWGTSLATTVLRSIGSEYGRPGSWCWIQQGSMAKVLHLITFYLPLWGAILYNGFTYYEVNRMLNNATRMAAGISDRSNQSDIRADRKAFNRWGYYPLILIGSWAFATINRLYDFTNPGHKIFWLSFLDVGFAGLMGLFNSIAYGLNSSVRRAISERIDTFLPERIKRSLPTLSRLRSQQENELTSLIVEGN

SEQ ID NO: 18056 - DNA, 826 bp, Panicum virgatum
  misc_feature: Ceres CLONE 1795637
  misc_feature: Encodes the peptide sequence at SEQ ID NO. 18057
ccacttttccttgagaggacggagctcttttttaaaggcagcaagcccaaccaaacccttctccttcgagaggtcgccgaggagagctgcgcctgcgagggaggaggaggagcttcggaggggaagaagaagaagaagaagaagaagaagaagagggggggagccatgctggaccatctcgtcgggctggtgagggtgcgcgtgctcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggaagtgtttgacaaggacacattcgtcgatgattcgatgggtaccgcagagctggacatccgcccgttggttgaggtcgtgaagatgaagctccaggatgttgccgatggaactgtggtaaagaaactggtgcccaacagacagaactgcctggccgaggagagctccatttacatctccgaggggaaggtgaagcaggacctggttatcaggctgaagaacgtggagtgcggggagatagagctccagcttcagtgggtcgacctccctggttccaagggtgtatgagctccgctctgccctgctgatctcaggggttctcgagtgaaagtaaagttcatgtgacgaatgtaaatgtaatctaaggatggttatggtacagcaagtgctgaactgctgattaggattttttatgttcttttatgattgtatataaggggttgtttggatc

SEQ ID NO: 18057 - protein, 165 aa, Panicum virgatum; identical to SEQ ID NO: 15808
  misc_feature: Ceres CLONE 1795637
  misc_feature (9)..(87): Pfam Name: C2 Pfam Description: C2 domain
  misc_feature: SWISSPROT Homolog: EC 2.7.11.13 Protein kinase C

SEQ ID NO: 18058 - DNA, 2558 bp, Panicum virgatum
  misc_feature: Ceres CLONE 1795638
  misc_feature: Encodes the peptide sequence at SEQ ID NO. 18059
atccccctacccgttcccctccctgcctccctttcacagccgccgccccctgctcccgtcccccgccgccgccgctagccagcccgcgccagcgcagcagcgctcctccaagccgccgccgccggcccgctcatccaagcggcggcaccgccagccctccctctaacgggtcccactcgggcgctcgccgagaccccgacggcccgaccccgccccccgccgccgccgctgcaagccagcccgctcctccaagccgccgccgccagcccgctcgccggcgtccgctccagccggggaggggcggtgggctggcgccaggcgcccaggcgagcagcggcttgcggccgcaggcacccgctctcagcggcggcgcggcacggcggcagccagaaggcagctcgcgctcatagcttgtgctgcgggcggcgcatgtatccgctaggcgccagcctccaatctctgctcatctcatcgacatcacctgttctttagtcaaacttggacagttgtaagccgccacgaagccttgcgggttgtgactcgtcaccgtagagctcgccgccgccgacgtgacgcttcctggcccccttccgccactcgagaccttccctcgctgacatctggtcgccgccgaaccgcccgatggcccacgacgccacgtccgagcctgaggagtggttggacaccgacctcgacgacgcctcggacaccgaggtgggcgacgccctggactggctggacgccgtggagggccccgacggctcggcgcggccctctgcggcgttctctgccgccggtggcgcgggcgcggcgcgcaggcccaacgcgcacggcggcgtgctctcccgccccctccagccgctctccaaccgcacccagaagctcgcctcacacatccgcgcggcgcccttggaggagtgggaaggtaggatgaacgtggggatgtccaattcggtaactaccgctatcagggatagcataagggaaacaacaattgggaagataaggaacacggagaaagctgaccgtgctacagtggaacaggctattgacccaagaacacgcatggttttgttcaagatgttaaatcgtggtgtttttaataacataaatggttgcatctctacagggaaagaggcaaatgtctatcatgcaacaaaggtggagggtcaggagttagcaattaaagtctacaaaacctctgtccttgtttttaaggatcgcgaccggtatgttcaaggagattatcgttttaggcatggttactgcaagcataatccacggaaaatggttaagacctgggctgaaaaggaaatgagaaaccttctacgagtgagagcagctggaatcagatgccctaaaccgttgctattgaggcttcatgtattggtgatggaattcatagggagaggaggttgggctgctcctcgtcttaaggatgctgctttgtcagatgacaagttgcgtgaaagttactttgagataattacaacaatgcggacactttaccaaaagtgcaagttggtccatggagatttgagtgagtacaacattctttatttcgagggccacttgtacattattgatgtttcacaatctgttgaccttgatcacccttcagcattggacttcttaaaggaagattgcctgcatgtttctgacttctttaagaaacgaggcattgcagtcatgacagtaacagatttatttaattttgttattgaccaaaacattgctgatgaggatgttgatggttacctggataaggttcagcaaaagatcgtggaaaacggtggtacagatacaaatgatgaaatttgtccaacagtcatggtgcaaactttggattatgtgaagcaatgtgaggcagatttagtcaacatgtcaatgatgcaacgctcatcctttggttacgagccaccagcggataagctttatgaccaaccactattaggatttgtacggacgaaaaatgcccacgctgaaaatcagcaaaaacaattgccacagaatacaatggaaaaccttggatctgcaaaataagtgctcattggaggacaaagtggaagatcaagaggacaatagtgaatcttgctcaagttctgatgaagacagttcgtgggaggaggctcccaaaatgggacctgaggaaaggaagactgctcggaaagagaacaagaagaaggtgaaggaagagaagagagaagctcgcaagacaaagatcccaaaggctgagaagaagaaaaggaagaaaatggcaaaagcaaagtgcaagcgttagagaaaatgatttcacaaaagtagtgcaaccagtagagtatgcggaacagacatacatctggaagctcagtgcttctccctatgaggcaaacaaggggtgctgattttccaatttagtttacctatcacttttctggttcattttgaattttgaatgtatacgcaagaaatcactttttgaataacttgtatcagggtatattgaactacaagaggccttttaggagtgtaatgcttctccttaagtctttaaagattgctttcttggatttgcattt

SEQ ID NO: 18059 - protein, 466 aa, Panicum virgatum
  misc_feature: Ceres CLONE 1795638
  misc_feature (167)..(355): Pfam Name: RIO1 Pfam Description: RIO1 family
  misc_feature: SWISSPROT Homolog: EC 2.7.11.1 Non-specific serine/threonine protein kinase
  misc_feature: Functional homolog of the protein sequence given in SEQ ID NO 50789
  misc_feature: Useful for making plants with modulated biomass
  misc_feature: Useful for making plants with modulated flowering time
MAHDATSEPEEWLDTDLDDASDTEVGDALDWLDAVEGPDGSARPSAAFSAAGGAGAARRPNAHGGVLSRPLQPLSNRTQKLASHIRAAPLEEWEGRMNVGMSNSVTTAIRDSIRETTIGKIRNTEKADRATVEQAIDPRTRMVLFKMLNRGVFNNINGCISTGKEANVYHATKVEGQELAIKVYKTSVLVFKDRDRYVQGDYRFRHGYCKHNPRKMVKTWAEKEMRNLLRVRAAGIRCPKPLLLRLHVLVMEFIGRGGWAAPRLKDAALSDDKLRESYFEIITTMRTLYQKCKLVHGDLSEYNILYFEGHLYIIDVSQSVDLDHPSALDFLKEDCLHVSDFFKKRGIAVMTVTDLFNFVIDQNIADEDVDGYLDKVQQKIVENGGTDTNDEICPTVMVQTLDYVKQCEADLVNMSMMQRSSFGYEPPADKLYDQPLLGFVRTKNAHAENQQKQLPQNTMENLGSAK

SEQ ID NO: 18060 - DNA, 499 bp, Panicum virgatum
  misc_feature: Ceres CLONE 1795646
  misc_feature: Encodes the peptide sequence at SEQ ID NO. 18061
ccccgggctctccgtcagccacttcgtccccatgctgcagctcgcccacgccctcctgaacgaaggctacgccgccaaggtggcccacatcgaccccgccctgaaaggggacatcgccctggccgccgtcatcggccgcgccgccgcctccaggccgtccgtcaccttctacgagctcccacggatccaggaccctcccaccgtcctccacgacgccgagttcctcgccacgtactccgacctcctaggccgccacaacgagcgctttttttttttcctccgctcgctgcctcccggcagcgtccacgcgctggtcctggacgtcctggccgccgaggcgctgggcgtcgcccaagagcttgggatcccggcctactccttcatccccaccaacgcctccgacttcgtcattttctcccagctcccttcgatccgcacggagggccagccgaccatgaaggagctcggagacacgcctctcgatttccatggcgtccca

SEQ ID NO: 18061 - protein, 165 aa, Panicum virgatum
  misc_feature: Ceres CLONE 1795646
  misc_feature: Functional homolog of the protein sequence given in SEQ ID NO 50592
  misc_feature: Useful for making plants with altered carbohydrate content
PGLSVSHFVPMLQLAHALLNEGYAAKVAHIDPALKGDIALAAVIGRAAASRPSVTFYELPRIQDPPTVLHDAEFLATYSDLLGRHNERFFFFLRSLPPGSVHALVLDVLAAEALGVAQELGIPAYSFIPTNASDFVIFSQLPSIRTEGQPTMKELGDTPLDFHGV

SEQ ID NO: 18062 - DNA, 2893 bp, Panicum virgatum
  misc_feature: Ceres CLONE 1795647
  misc_feature: Encodes the peptide sequence at SEQ ID NO. 18063
gcggcgtaccccttcttcttccccagacccaaaaccctcaccagcgcgcccacacgccgagacgcgagagccaatcgcccgaccggaagtcccagtccagatccggaagcttacggaaggcgccgccgtcggcgatggaggcgttcggcgggttcttcgtggacgaaaaggcggcgcgggtggagaacatcttcctcgagttcctcaagcggtttaaggagccggagggcgcgccggagccgttctacgagatggagatggaggcgatgcggtcgcgggagtccaccaccatgtacgtcgatttcgcgcacgtcctgcgcttcaacgacattctccagaaggccatcgccgaggagtatctcaggtttgaaccatacttaaggaatgcgtgcaagaggtttgtgttggagcaccgggccagtgagaatcgggcgccaatcatctctgatgatagtccgaacaaggatataaatattgccttctacaacatcccaatgctgaaaaggttgagagagcttgggacagcggaaattggtaaacttacatcagtcatgggtgttgtgacacggacgagtgaggtgcggcctgaactattgcaaggcaccttcaagtgcctcgactgtggaaatgttgtgaagaatgtggagcagcagttcaagtacactgagccgataatatgcgtcaatgcgacatgccagaaccgatcaaaatgggcacttctacgccaggagagcaaatttacagattggcagagggtgagaatgcaggagacatcaaaagagatacctgctggttcgcttcctcgctccctggatgtcatcttgcgacatgagattgttgagaaggctagagctggggacacggttatatttactggaactgttgttgcggttccagatgtattagcactaacttcacctggtgaaagagcagagtgtcgccgggaagctcctcagcgaaaaaatggaggtgttcaagaaggtgtaaagggcttgaagtcacttggagtcagggatctctcttatcgccttgcttttgtggcaaattcagtgcaggtggcggatggcaggagagaagtggacatcagagaccgggacacagatggcgatgacagtgaaagacagaagttcactgaagaagaggaagatgaggttgttaggatgaggaacactcctgacttctttaataagatagttgatagcatatgtcctactgtctttggtcatcaagaaattaagagggcggtcctccttatgcttttgggtggtgttcacaagataacacatgaagggatcaaccttaggggtgacatcaatgtctgtattgttggtgacccaagctgtgcaaagtctcagttcctgaaatataccgctggtattgttccaagatctgtttacacatcagggaagtcatcttctgctgctggtctgacagcaactgttgctaaagaaccagagactggtgaattttgtatcgaggcaggtgctctgatgttagctgataatggcatttgctgcatagatgaatttgataagatggacattaaggatcaggttgctattcatgaagcaatggaacagcaaaccattagcataacaaaagcaggaatacaggccaccttgaatgcacgaacttcaattttagctgcagcaaatccgacaggagggcgttatgacaagtctaaaccacttaagtacaatgtggcattgcccccagctattctttcaagatttgatctggtgtacatcatgattgatgaacctgatgaaaccacagactaccacattgctcatcacattgtaagagtccatcagaaacgtgaagaagcactggcccctgcatttagcactgcggaactgaagcgatatattgcatttgcgaagtctttgaaacctcagctgagttcagaagcaaagaaggttttggtggactcatatgttacccttcgtagaggtgacagtactcctggaaccagggttgcttacaggatgacagtaaggcaattagaagcattgattaggctatcagaagctattgctcgaagccacttagaaagaactgttctcccagctcatgtccgactggcagttaaattgcttaagacatccatcatcagcgttgagtcaagtgaagttgatctctctgagtttgaagatgctgaagatggaacaaatgtaccttctgataatgatgctggacagccagctgaagcagatgctgctcctcaacaagtgggtgcagaaaatgaccaagcagcagataacggtaagaagaaattggtaataactgaagaatacttccagagaattactcaagcgttggttatgagactacggcagcatgaagagtccatcatgaaagatggagatggtcttgctggcatgaagcaaggggatcttatcatttggtatgttgagcagcagaatgccaaaggtgcgtacagttctactgcagaggtgaaggaagaagtgaagtgcatcaaggccattatagagaggcttatacagcgggaaggccacctcatagtcatagacgaaggcacagcagccgcggccgaggacggcgctggcgcccgaagaacatcggagagcagaatattggcagttaacccgaactacgttattgattagcagcagcctgaaaccatgccgctaactcgggtgagttgatgtggttaaccaatagttgtgagctccctgtgccatgatgctctggcactgttgtaccatctccatctctgacgggctctttgcaatggagcgcatgttctccggaactgtataattagtttcttgcttctaggtttagtgaagtgtggtaactagtgtacctctgtaattttgaccctgtggccattgtggaaacgaagagaaggagcttatatattgaagcc

SEQ ID NO: 18063 - protein, 831 aa, Panicum virgatum
  misc_feature: Ceres CLONE 1795647
  misc_feature (336)..(660): Pfam Name: MCM Pfam Description: MCM2/3/5 family
MEAFGGFFVDEKAARVENIFLEFLKRFKEPEGAPEPFYEMEMEAMRSRESTTMYVDFAHVLRFNDILQKAIAEEYLRFEPYLRNACKRFVLEHRASENRAPIISDDSPNKDINIAFYNIPMLKRLRELGTAEIGKLTSVMGVVTRTSEVRPELLQGTFKCLDCGNVVKNVEQQFKYTEPIICVNATCQNRSKWALLRQESKFTDWQRVRMQETSKEIPAGSLPRSLDVILRHEIVEKARAGDTVIFTGTVVAVPDVLALTSPGERAECRREAPQRKNGGVQEGVKGLKSLGVRDLSYRLAFVANSVQVADGRREVDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDETTDYHIAHHIVRVHQKREEALAPAFSTAELKRYIAFAKSLKPQLSSEAKKVLVDSYVTLRRGDSTPGTRVAYRMTVRQLEALIRLSEAIARSHLERTVLPAHVRLAVKLLKTSIISVESSEVDLSEFEDAEDGTNVPSDNDAGQPAEADAAPQQVGAENDQAADNGKKKLVITEEYFQRITQALVMRLRQHEESIMKDGDGLAGMKQGDLIIWYVEQQNAKGAYSSTAEVKEEVKCIKAIIERLIQREGHLIVIDEGTAAAAEDGAGARRTSESRILAVNPNYVID

SEQ ID NO: 18064 - DNA, 2503 bp, Panicum virgatum
  misc_feature: Ceres CLONE 1795650
  misc_feature: Encodes the peptide sequence at SEQ ID NO. 18065
atcgtcatcgagcgcgctcggcatcgcacaacccgatccctatccacccatccatccattcggcggccatggcgccaaccgccgccgccgccttcctcttcctctccccgccgcggagccggagccacctgcactccaagcctaggcctaggcccaggcccaccgccaccgccgcctcctccctctccgaccagctcgagccgctctcccgcacgctcctccacgacaagcccacccccaccgccgaccgccccaccccggagcccacctgggtcaacccctcccgtcccaagcccaccgtcctctccctccgccgccaccgccgccggtccccctccgcccacccttcctccgccccgctccagccgctcctccgcgccatccgcgcgctgcccgacgacgccgacctcgccgacaccctccacgccttcttccccgcgggctccccgccctccccctccgacgcgctcctcctcctcaactacctccacccgtcctggccaaagtcgctctccctcctcgcctggctgcgcgcgctccccgacggcgccttcccgctcgacaccatcttcttcaacgtcgcccttaagtcgctccgcgccgcgcgccagtggccgcacgccgagcgcctcgcgctcgacatgctccgcgccggcatccccctcgacaacatcacctactccaccctcatcaccgccgcgcgccgctgccgccagttcaccaaggccatcgagtggttcgagcgcatgtacgccgccgacggcgtcctccccgacgaggtcacctactccgcggtgctcgacgtctatgcgcagctaggcatgaaggaggaggtgctcgcgctcttcgaccgcgccaggggcagcggctggaagcccgaccacgtcgccttcgccgtcctcgccaagatgttcggggaggccggcgactacgagggcatccgcttcgtcttcgacgagatgcgggaggtcggcatcaagcccaacatctttgtctacaacgccctgctcgaggcgctcggcaagaccggcaagcctggcctcgcgcgcaacctgttccaggaaatgaccgcccagggcgtcgagcccaatgcgcgcacgctcaccgccctcgccaagatctacgggagggcacgctggggccgcgacgcgctccaactctgggagcagatgagggagatgaagctgcccgccgataacatcctctgcaacacgctgctgagcatgtgcgctgacgtcgggctggtggacgaggctgagcagctgttcaacgagatgaaggacccagactgccgtgacgtccccgagccggacaagtggagctacacggccatgatcaacatctacgggagcaacggggacaccgaccgcgcgctccagctgtttgcggagatgctagagggcgggatagaacccaacatcatgagctacaccattgtcatccagtgcctcggcaaggcgcagaggatacagcaggcagtggaggtgcttgaggcgggcctggagaagggtctcaagcccgatgatcggctctgtgggtgcttgctttctgtcgtcgctctgagcagcggggaggagacggaaatggtgctttcttccctggaaaaggtcaaccgcaacctggtcaagctgatcagaatgctcggtgaggaccaggtggattttgatgatcttacaaaggagttgaagggcgtgttgaacgctgcagcccctgaagtacgccggccttactgcaactgtttgatcgacatatgccagaaccatggcttccctcctcagagggcaagagaagtcttccagcttgcccagacctacggtttgtactccaagattcatagcagaaaggatgaggagtggtcactggatctgcgatccctttccgttggtgcagccaagacagcattcgatgattggatgcggaccatctcagagcgcttggtgcagcacaaggatttgccagtctccttcagcgtgtacactgggtccagcacccacaagtttgcacaggggctgacaagtgctttcgcggctcatcttgagcaattggccgtgccattccgtccaagcgagtctcatgtcggcagcttcatcagttcaagggatgatctggtctcatggttgcagattagcagttcgtcagtggccattgctggatgactgcatatagtcacaatggcttactgcatgatgccacaagttccaaagttgggggttgaatgagcactgggtgatattagcgtttgttgacatatacttgtaggaagagaaccgaaacacataggaacttatctcttccatgcattgcaaaggtagcacgaaggggcactctgaaaacattggctgattattctgtatctgatgaatgtcacttcttaaataccgttgtagtagtggagtagtatatttttattatttttatttttgccttcttgcacggaatgtgccgaggtttggctgctaatgtactgccttggaactgtaaaaatcggaagggatttatctcc

SEQ ID NO: 18065 - protein, 695 aa, Panicum virgatum
  misc_feature: Ceres CLONE 1795650
  misc_feature (417)..(451): Pfam Name: PPR Pfam Description: PPR repeat
  misc_feature (308)..(342): Pfam Name: PPR Pfam Description: PPR repeat
  misc_feature (238)..(272): Pfam Name: PPR Pfam Description: PPR repeat
  misc_feature (452)..(486): Pfam Name: PPR Pfam Description: PPR repeat
  misc_feature (273)..(307): Pfam Name: PPR Pfam Description: PPR repeat
  misc_feature (343)..(377): Pfam Name: PPR Pfam Description: PPR repeat
  misc_feature (378)..(411): Pfam Name: PPR Pfam Description: PPR repeat
MAPTAAAAFLFLSPPRSRSHLHSKPRPRPRPTATAASSLSDQLEPLSRTLLHDKPTPTADRPTPEPTWVNPSRPKPTVLSLRRHRRRSPSAHPSSAPLQPLLRAIRALPDDADLADTLHAFFPAGSPPSPSDALLLLNYLHPSWPKSLSLLAWLRALPDGAFPLDTIFFNVALKSLRAARQWPHAERLALDMLRAGIPLDNITYSTLITAARRCRQFTKAIEWFERMYAADGVLPDEVTYSAVLDVYAQLGMKEEVLALFDRARGSGWKPDHVAFAVLAKMFGEAGDYEGIRFVFDEMREVGIKPNIFVYNALLEALGKTGKPGLARNLFQEMTAQGVEPNARTLTALAKIYGRARWGRDALQLWEQMREMKLPADNILCNTLLSMCADVGLVDEAEQLFNEMKDPDCRDVPEPDKWSYTAMINIYGSNGDTDRALQLFAEMLEGGIEPNIMSYTIVIQCLGKAQRIQQAVEVLEAGLEKGLKPDDRLCGCLLSVVALSSGEETEMVLSSLEKVNRNLVKLIRMLGEDQVDFDDLTKELKGVLNAAAPEVRRPYCNCLIDICQNHGFPPQRAREVFQLAQTYGLYSKIHSRKDEEWSLDLRSLSVGAAKTAFDDWMRTISERLVQHKDLPVSFSVYTGSSTHKFAQGLTSAFAAHLEQLAVPFRPSESHVGSFISSRDDLVSWLQISSSSVAIAG

SEQ ID NO: 18066 - DNA, 1463 bp, Panicum virgatum
  misc_feature: Ceres CLONE 1795656
  misc_feature: Encodes the peptide sequence at SEQ ID NO. 18067
atctctaacctaaccatattatcaatcatctactctagtctctagctgtatgcgtgcgtgcatagctgatggctcctgctagtctctcattcctaccaacttgcttgtgcatcggcgtcctcctcttggacagccaagggttcatcaccatgtctgctgctcccactcctccgagggcttgcgagtcgttcgatcggctgcagccgttcgaaccgattccgcagggacagatgagatcggaggctgggaccgtcgagtacttcgacgagacaaaccagcagctccgatgtctgggagtcttcgtcattcgtatcgccattgatcgtcagggcctcttgctaccacgctactgcgacgatggtgccctagccttcgtccaggaagggagtggtttcgtcggattcactttccccggatgcccagaggagtactaccggttcagacaaggtgatatcgttgcattgccgcctggcgttccgttttggttttacaacgacggcaacaaaccagccgagctcatcatcatcttcgacataaacaacgacgctgaccagattgaatcacaacatatggaattcgtgttggccggtagcagcagggacagaagcgacagcaaggggaagcttaggcatgtgggcgggccaaacatattcagtggattcactgatgacgagctgcttgccgaatcccttggcatcgacaaacgcctggccggaagccttcgtggtgaagatggccgagccggcggcaccatagtccacgcgccgcagattcgccttcctccaattgggccagctgatgggaagaacaaggacgacccgatgtgcaggatcatgaacaggaaggtgataatgaacttggaagaccctgctgctgccggcgtccacgacgacccgcgttatcagaacgtcacacgtctcaccgcccgcaacttccccatcctcgagtccctgcgattgagtcccgagagaggaactgtaagccagaacgcaattgttgcaccacactacaacataaactctcaagatgtggtgctgctgacccggggaagcgtccgagtgcaggttgttgataacgacggggtggcggtgttcgacggcgagcttcgtcaggggcagctgcttgtcataccacagtactacgtcgtcctacgcaaagcaggggcagatggttacgaatacatcttgttcaggaccaacgccaaccctctgataatcaacatggcagggccgggatccgtcctgctggccttgccggtcgatgtcatcgcagtttcctacaatgtctccacgacagatgccaagaagattaagaacagtgggagcaacgaggaacccatatgaactcgactgatatgattgcaacaatatatcagccaagtatgtacgtctagctatatgccaaagcgataggcgatattgcgatgaatactggctactaaagtaaataaatcatggcaagcg

SEQ ID NO: 18067 - protein, 424 aa, Panicum virgatum
  misc_feature: Ceres CLONE 1795656
  misc_feature (44)..(178): Pfam Name: Cupin_1 Pfam Description: Cupin
  misc_feature (270)..(412): Pfam Name: Cupin_1 Pfam Description: Cupin
MAPASLSFLPTCLCIGVLLLDSQGFITMSAAPTPPRACESFDRLQPFEPIPQGQMRSEAGTVEYFDETNQQLRCLGVFVIRIAIDRQGLLLPRYCDDGALAFVQEGSGFVGFTFPGCPEEYYRFRQGDIVALPPGVPFWFYNDGNKPAELIIIFDINNDADQIESQHMEFVLAGSSRDRSDSKGKLRHVGGPNIFSGFTDDELLAESLGIDKRLAGSLRGEDGRAGGTIVHAPQIRLPPIGPADGKNKDDPMCRIMNRKVIMNLEDPAAAGVHDDPRYQNVTRLTARNFPILESLRLSPERGTVSQNAIVAPHYNINSQDVVLLTRGSVRVQVVDNDGVAVFDGELRQGQLLVIPQYYVVLRKAGADGYEYILFRTNANPLIINMAGPGSVLLALPVDVIAVSYNVSTTDAKKIKNSGSNEEPI

SEQ ID NO: 18068 - DNA, 2067 bp, Panicum virgatum
  misc_feature: Ceres CLONE 1795666
  misc_feature: Encodes the peptide sequence at SEQ ID NO. 18069
gcaacagcacgagcgccccagcccacaggcaggcctagctcaccaccgcggcgcagcggcaatggcgacccgccggcagccccgccgcgcgttcccgctggtcccgctcctgctctccctcatggctgcggccgcgtacggccgcctcatctccgacggctccccgtcggcgccgctcgtctcggtgatccgcctcgcctcgccggccgcggcggcgacggcggtggcggagaagtgcgagcagtcgtacggcttcctcccctgcaccaccaccgtgctcgggaacctcttcctcgccctcgtctacggcttcctcatgttcaaggccgccacgtacctgtccgcgggcagcgagctgctgctcgagatcatggggccgggcctcgtcggcggactcctcctccccatcctcggcgccctccccgacgcgctcctcgtcctcgtatctggcctctctgggagtaaagagactgcacaaagtcaggtcctgatcggaatggggctgcttgctggttccactgtcttcctcatcaccctgctctggggaacctgtgttgttgttggtaaatgtgaccttgggccaaaccgtgaggcagttgatttaacgaacaccaagggcttcagcctgactggcactggtattacaactgatgtgcagaccagctatgcggcacggatcatggggttatctgttatccccttcatcattgctcagttccccaagatgttgaagacccaccatgggcagcgcctggctgtcttgttggcccttatcacgtcattcttgctcgtgctttcctactgcctgtatcaggttttccagccatggattcagaggaggaagcttgcatacgcaaagcacaaacatgtgatctccgggatcctgaggcatgcccaaatgcaggcactcggccgtctgctcaacgatgacggcacacccaatgaagacgtcatcagaaagttgttccgcaagattgacatagatgacagcggcaacctttcccattccgagctgcacgctctcatcgtcggtatcaacttcgaggagcttgactttgacaagatggacgcggtcgacaaggtcatgaatgactttgacacgtcccgcaacgacgtcttggaggaggatgagttcgtgcaggggatgaagaaatggctcaacgaggccaagcgcaccgtgccggcaagcggcgccttctccaacaagttcatcaacgagttccacgagaggacgaggcaggagcatgcccagctgattgacaagtccgacgaagcggtggagagcgtggagaaccccgggtggtgcatcgccaaggccgtggggttcctcctcctgggcgctgccatagccgccgcgttcgcggacccgctcgtggacgccgtccacaacttctccaacgccacgcacatcccatccttcttcatctcgttcatcgccctcccgctggccaccaactccagcgaggctgtctccgccatcatcttcgccagcaggaagaagcagaggacctgctccctcaccttctcggaggtgtacggcggcgtgacgatgaacaacacgctgtgcctgggcgtgttcctggcgctcatctacttccggaacctgacgtgggacttctcgtcggaggtgctcatcatcctggtcgtctgcgtcatcatggccctcttcaccagcttccggaccacgttcccgctatggacgtgcctcgtcgcctacatgctctaccccctctcgctggtcatcgtctacatcctcgactacgtcttcggctggtcataggcgcattggctctcctcaagtgaacgcctgttttctagcggccacaagtcggtttgatcctttaattttgactgctctgggcagactctgtttctcgtgttggtgtaatcacgctctactttctaccttgtgtatccaaaccacgtccttcacattctaacagctacattctcactgtagagccaaatcaaggtcctaaatcagtgtgggtgtcgattgtattttcttctcgagttaagtcagattctatcagataaaggtcttcagatcgtgaaccgtttgatcag

SEQ ID NO: 18069 - protein, 572 aa, Panicum virgatum
  misc_feature: Ceres CLONE 1795666
  misc_feature (84)..(254): Pfam Name: Na_Ca_ex Pfam Description: Sodium/calcium exchanger protein
  misc_feature (428)..(562): Pfam Name: Na_Ca_ex Pfam Description: Sodium/calcium exchanger protein
MATRRQPRRAFPLVPLLLSLMAAAAYGRLISDGSPSAPLVSVIRLASPAAAATAVAEKCEQSYGFLPCTTTVLGNLFLALVYGFLMFKAATYLSAGSELLLEIMGPGLVGGLLLPILGALPDALLVLVSGLSGSKETAQSQVLIGMGLLAGSTVFLITLLWGTCVVVGKCDLGPNREAVDLTNTKGFSLTGTGITTDVQTSYAARIMGLSVIPFIIAQFPKMLKTHHGQRLAVLLALITSFLLVLSYCLYQVFQPWIQRRKLAYAKHKHVISGILRHAQMQALGRLLNDDGTPNEDVIRKLFRKIDIDDSGNLSHSELHALIVGINFEELDFDKMDAVDKVMNDFDTSRNDVLEEDEFVQGMKKWLNEAKRTVPASGAFSNKFINEFHERTRQEHAQLIDKSDEAVESVENPGWCIAKAVGFLLLGAAIAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILVVCVIMALFTSFRTTFPLWTCLVAYMLYPLSLVIVYILDYVFGWS

SEQ ID NO: 18070 - DNA, 624 bp, Panicum virgatum
  misc_feature: Ceres CLONE 1795672-R
  misc_feature: Encodes the peptide sequence at SEQ ID NO. 18071
acacgacggaccggtccttctgcgtggcggcggacgacgcggagcagaaggcggtgcaggcggccatggactgggcgtgcgggcccgggcgcgccgactgcacggcgatccagcccgggcaggggtgctacctgcccaacgacgtgcgcagccacgcgtcgtacgccttcgacgcctactaccagtcgcagggccgcgccgccgggtcctgctacttccagggcgccggcatggtcaccaccacggatcccagtcatgacaactgcttattccctggaagtaagcagctgggtaaccacaccaaatctgccagcgcaagcaacactacaacgccgacaagtgacgccgagggatctgcaatatggaggctaagaacaggaagggagaaagggttctcgctcttccttcggctgctgctgagcatcacggtggttatcgtgacagattcaaacttttggacatgacaagagagtgctagttgtaacaaaaccagaaattttgggagggggtaaattagaggaggggggattgggttgtgcttagcgattctttattgttaggagtaagcatcaataaattaatctcttttttttcttcagctaatgaaatgtgtctatgatctgc

SEQ ID NO: 18071 - protein, 153 aa, Panicum virgatum
  misc_feature: Ceres CLONE 1795672-R
  misc_feature (5)..(90): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50790
  misc_feature: Useful for making plants with altered carbohydrate content
  misc_feature: Functional homolog of the protein sequence given in SEQ ID NO 50791
  misc_feature: Useful for making plants with altered cell wall content and/or composition
  misc_feature: Functional homolog of the protein sequence given in SEQ ID NO 50792
  misc_feature: Useful for making plants with modulated drought sensitivity
  misc_feature: Useful for making plants with modulated water use efficiency
TTDRSFCVAADDAEQKAVQAAMDWACGPGRADCTAIQPGQGCYLPNDVRSHASYAFDAYYQSQGRAAGSCYFQGAGMVTTTDPSHDNCLFPGSKQLGNHTKSASASNTTTPTSDAEGSAIWRLRTGREKGFSLFLRLLLSITVVIVTDSNFWT

SEQ ID NO: 18072 - DNA, 597 bp, Panicum virgatum
  misc_feature: Ceres CLONE 1795672
acgggcatcaatggcgacagctgcctcgccagaccctcccctgctcgccttcgtgccgctcctgctactcctaatcctcgcggccttctcaccggccaccgacaaaacagcgcgctcctccaaccccaaggcgccgttcccggccgtcactcctctgcacctgcaggctctacaggcagcagagggcgcgccccagctcgtcagctgccaagcacgtcgccgccgatggcaccagcaccagagacggcacggcggcgaagccgttcacggcgcactacttcccgcaggagctggaccacttcaccttcacgcccaacgcgtccatgctcatctaccaaaagtacctcgtcaacgacaccttctggcggagggcccggcggcggtgaaggcgccggacgtgcgctacttccgtacaccgcaaaacatgaccacatcgagtgtctaccaaccaaacctgcgtttgtggtcgacatctggcccaagcggcggcgcctcctctcctgcatctaccatacgatcaactgctagtccaagcctccccgcaaccaatcgtagcagtctgcgtagaccctcgagtgcttgacttcgacgcaggca

SEQ ID NO: 18073 - DNA, 2537 bp, Panicum virgatum
  misc_feature: Ceres CLONE 1795673
  misc_feature: Encodes the peptide sequence at SEQ ID NO. 18074
agacgcttcgctcccattccgatcctcccacccgatctccccgctgccgcgcgtccatcggggtgggaggaggaggaggggccacgatggagtcggcggcggccgtgccgtgcgcggcgtgcggggacgacgcgtgcgcggcgtgccgcgcgtgcagctacgcgctctgcagggcctgcctcgacgaggacgccgccgaggcacgcgccacgtgcgcgcgctgcggcggggagtacgccgccgctaccgacccagcgcatggcagcgcgggcgctgaagcggaaggggtggaggaccaccacgccggcggcggcctgcgtgagagggtcaccatgggcagccacctcaatgatcgccaggatgaagtaagccatggcaggaccatgagcagcttgtcgggaattggtagtgaactgaatgatgaatctggaaaacccatctggaagaacagggtggagagttggaaggagaaaaagaatgagaaaaaagcctcagccaaaaaggctgcagcaaaagcccaggcaccacctgtggaagaacagatcatggatgaaaaggatttgacagatgcgtatgagccactctcccggatcatccctatatcaaagaacaagctcacaccttacagagcggtcatcattatgcgtttgatagttcttgggctcttctttcactaccgtatcaccaatcctgtttacagtgcctttggtctctggatgacatcagtcatatgtgagatctggtttggtttctcctggatcttggatcaattccccaagtggtgccctatcaatcgagagacttatgttgataggctgattgcaagatacggagatggtgacgattctggattggcacctgtggatttctttgtcagtacagtggatccattgaaagagcctccactgatcactgcaaacaccgtgttgtctattcttgctgtggactatcctgttgagaagatctcatgctatgtatccgatgatggttctgctatgctcacatttgaatcacttgctgagactgctgaatttgctagaaaatgggttccattttgcaagaagtatgccattgagccacgagctcctgagttctatttctcgcagaagattgactacttgaaggacaagatacacccatcttttgtcaaggagcgtagggctatgaagagagactatgaagaatacaaggtgaggataaacgctttggtcgccaaggctcagaagacacctgaggaaggctggatcatgcaagatggtacaccatggcctgggaataatcctcgtgaccaccctggcatgatccaggttttccttggtgagactggtgcccgggactttgatggaaatgaacttcctcgtttagtgtatgtttcaagagaaaaaagaccaggctaccaacaccacaagaaggctggggccatgaatgctctggttcgagtgtctgctgtcctgacaaatgctccttacattcttaatcttgattgtgatcactatgttaacaacagcaaagccgtccgtgaagcaatgtgcttcatgatggaccctactgttggcagagatgtctgctatgtacaattcccacagaggttcgatggcattgatcgcagtgatcgatacgccaataggaatgttgtgttctttgacgttaacatgaaaggacttgatggcattcaaggccccgtttatgtgggaactggttgttgtttctttaggcaagcactgtatggttatggacctccatctctgcctgccctcccaaaatcttcgatttgttcgtggtgttgctgttgctgtcccaagaagaaggttgaaagaagtgagagagaaatcaacagggactctcggcgagaagaccttgagtctgctattttcaatcttcgggaaattgacaactacgatgagtatgagagatccatgcttatctctcagaagagttttgagaagacttttggcctgtcctcagtattcattgaatcaactcttatggagaatgggggcgtccctgaatctgcaaacccatctactctaattaaagaagccattcatgtcattagctgtggatatgaagagaaaactgaatggggaaaagagattggctggatctacggttcagttacagaggatattctgactgggttcaggatgcactgccgtggctggagatccatctactgcatgccggtgagacctgcattcaagggatcagcccctatcaatctttccgatcgtctgcaccaggttctccggtgggctcttggttctgttgagatcttcctgagtcggcactgcccgctgtggtacggttacggtggtggccgtctgaaatggctccagaggctatcctacatcaacaccatcgtctacccgttcacttctcttcctcttattgcctactgttgcctgcctgccatttgcctgctcaccggaaagttcatcattccaacgctgtccaacgccgcgacaatatggtttcttggcctcttcatgtccatcatcttgacgagcgtgttggagctgcggtggagtggcatcggc

SEQ ID NO: 18074 - protein, 816 aa, Panicum virgatum
  misc_feature: Ceres CLONE 1795673
  misc_feature (165)..(816): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 2 in US patent 7049481
  misc_feature: Functional homolog of the protein sequence given in SEQ ID NO 50793
  misc_feature: Useful for making plants with modulated biomass
  misc_feature: Functional homolog of the protein sequence given in SEQ ID NO 50794
  misc_feature: Useful for making plants with altered cell wall content and/or composition
  misc_feature: The sequence is a functional homolog of SEQ ID NO 26 in US patent 7312377
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
MESAAAVPCAACGDDACAACRACSYALCRACLDEDAAEARATCARCGGEYAAATDPAHGSAGAEAEGVEDHHAGGGLRERVTMGSHLNDRQDEVSHGRTMSSLSGIGSELNDESGKPIWKNRVESWKEKKNEKKASAKKAAAKAQAPPVEEQIMDEKDLTDAYEPLSRIIPISKNKLTPYRAVIIMRLIVLGLFFHYRITNPVYSAFGLWMTSVICEIWFGFSWILDQFPKWCPINRETYVDRLIARYGDGDDSGLAPVDFFVSTVDPLKEPPLITANTVLSILAVDYPVEKISCYVSDDGSAMLTFESLAETAEFARKWVPFCKKYAIEPRAPEFYFSQKIDYLKDKIHPSFVKERRAMKRDYEEYKVRINALVAKAQKTPEEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGIQGPVYVGTGCCFFRQALYGYGPPSLPALPKSSICSWCCCCCPKKKVERSEREINRDSRREDLESAIFNLREIDNYDEYERSMLISQKSFEKTFGLSSVFIESTLMENGGVPESANPSTLIKEAIHVISCGYEEKTEWGKEIGWIYGSVTEDILTGFRMHCRGWRSIYCMPVRPAFKGSAPINLSDRLHQVLRWALGSVEIFLSRHCPLWYGYGGGRLKWLQRLSYINTIVYPFTSLPLIAYCCLPAICLLTGKFIIPTLSNAATIWFLGLFMSIILTSVLELRWSGI

SEQ ID NO: 18075 - DNA, 581 bp, Panicum virgatum
  misc_feature: Ceres CLONE 1795673-R
  misc_feature: Encodes the peptide sequence at SEQ ID NO. 18076
tcggacgcgctcaacagcggctacgagtcgtggggcccgctcttcggcaaggtgttcttcgccatgtgggtgatcatgcacctgtacccgttcctcaagggtctcatgggccgccagaaccgcacgcccaccatcgtcgtgctctggtccgtcctgctcgcctccgtcttctccctcctctgggtcaagatcgaccccttcgtcggaggcaccgagcctgtcaacggcaccaactgcaacacagtcatctgctgaggcaccgccggtcagccggtggtgtgccgcggacgatgtcttttgtctttctggtgttgcagatgtggttgcctgaagcagggcggttggtttcctccctcggtcgcctctgccccaggatctgaaagaggtgttgtagattaagtactatttggcacccaattgttcattgatgctgtatgtgttatgagaagttttggagttataaaatgttaaactcgcctgaattgtgagaaggcactgttgaagtgtgtgtaaaaatcataaatagggacgcacgaaaaaggagccaatatactttcataccgaaagggaagatcatttac

SEQ ID NO: 18076 - protein, 84 aa, Panicum virgatum
  misc_feature: Ceres CLONE 1795673-R
  misc_feature: SWISSPROT Homolog: EC 2.4.1.12 Cellulose synthase (UDP-forming)
  misc_feature: Functional homolog of the protein sequence given in SEQ ID NO 50793
  misc_feature: Useful for making plants with modulated biomass
  misc_feature: Functional homolog of the protein sequence given in SEQ ID NO 50794
  misc_feature: Useful for making plants with altered cell wall content and/or composition
  misc_feature: The sequence is a functional homolog of SEQ ID NO 2 in US patent 7049481
  misc_feature: The sequence is a functional homolog of SEQ ID NO 26 in US patent 7312377
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: Functional homolog of the protein sequence given in SEQ ID NO 50125
  misc_feature: Useful for making plants with modulated plant growth and development
SDALNSGYESWGPLFGKVFFAMWVIMHLYPFLKGLMGRQNRTPTIVVLWSVLLASVFSLLWVKIDPFVGGTEPVNGTNCNTVIC

SEQ ID NO: 18077 - DNA, 1612 bp, Panicum virgatum
  misc_feature: Ceres CLONE 1795682
  misc_feature: Encodes the peptide sequence at SEQ ID NO. 18078
tctctccctctaactttgttatgctcatcatgtgagaaagagagaagcagcagcagcagcagctcgagcattcagtgtgtgcgtgtgtgtgactgtaagtccattgactggcgacactggcctgctatctatagctccagctgctgctgccggagttagctggtagtggaaagtacaaagagtgagcgcgccactatggacatggcggccgccgtcgccggcgctgctgctcaaggcgacctcgccgacgtcgtggctcgtgcgggtgcaatggccgccgcaccgccttcaacgactccctcttttgctgccgcagcagatcacatgccgtcgtctgctgcaatggcggcccgacagatcatggtcgtcccttgcgaggcggcggagccacggcctgtgatgaggagcatcgctgcttgcagcgacacttcgatgctcgaggcgccgtccatggtcgatccatacctgtcggcgtctgcgacgccgcgcggtgcgtactggctgccgccgccgccgcagcttgcggtccagatctcccagcacgcctgctatggccgcgacgtggcgatggctggtgctgccaacgatgtcgacggcgaagaggccatgaggatctcatctccagctgctcatcaaatcatgaagagaaagaatgaagtgaagaaggtggtgtgtattccggccctgcctccgacgagcagccggccaggaggaggagaggtgattccgtctgatctttgggcgtggaggaaatacggccagaaacccatcaagggctcgccttacccaagaggttactacaggtgcagcagctccaagggatgtatggcgaggaagcaagtagagcgcagccgcagtgacccaaacatgctagtgatcacctacacggcagagcacaaccacccttggccaatgcaacgcaatgtactcgctggatactcccgccctcatactactaacacgtcgtcgtcgtcgtcgtcgtccagcagctgcaagaagaaaaacagctgcagggttgatccgacgacttcatcatcatcgacatcgtcaaagaacgccgccgctaactattactccgacgagcataacgcggctgccgccggtggcaacctcgagtgccagcagacgacgatgacagacatgatggaagaaggtaatgcagcagcagcagcagcagggtcgcatcatgttgcctactacaccatcgccggcgctcttgatgaggaggagggtgttgcgatgcatcatcagccaatccaaactgcggcagatgaggtttttgttgagctagaagagttggagcctagcagcagcagtaatcctgccgtgaatgcaaacatctactgctcttctagtaggggggtaagtagttatgatcagtggcacaagttctgacggatggatcgatcaagcacacaggcccaatgcaagcttggtataaggaacgaattggctacaacatatagtatatatgtttgatgaaaattaaataggttattacacaagctaagtatgcgcatggtttacttaatttattcttttgtgcttactttaattattcaaagctaagatatatatttacaaactaaaattataagataaatatgtgttc

SEQ ID NO: 18078 - protein, 399 aa, Panicum virgatum
  misc_feature: Ceres CLONE 1795682
  misc_feature (178)..(238): Pfam Name: WRKY Pfam Description: WRKY DNA -binding domain
  misc_feature: Functional homolog of the protein sequence given in SEQ ID NO 50795
  misc_feature: Useful for making plants with modulated biomass
MDMAAAVAGAAAQGDLADVVARAGAMAAAPPSTTPSFAAAADHMPSSAAMAARQIMVVPCEAAEPRPVMRSIAACSDTSMLEAPSMVDPYLSASATPRGAYWLPPPPQLAVQISQHACYGRDVAMAGAANDVDGEEAMRISSPAAHQIMKRKNEVKKVVCIPALPPTSSRPGGGEVIPSDLWAWRKYGQKPIKGSPYPRGYYRCSSSKGCMARKQVERSRSDPNMLVITYTAEHNHPWPMQRNVLAGYSRPHTTNTSSSSSSSSSCKKKNSCRVDPTTSSSSTSSKNAAANYYSDEHNAAAAGGNLECQQTTMTDMMEEGNAAAAAAGSHHVAYYTIAGALDEEEGVAMHHQPIQTAADEVFVELEELEPSSSSNPAVNANIYCSSSRGVSSYDQWHKF

SEQ ID NO: 18079 - DNA, 1771 bp, Panicum virgatum
  misc_feature: Ceres CLONE 1795683
  misc_feature: Encodes the peptide sequence at SEQ ID NO. 18080
ataagaggtcggcatggcacacacacaaaatcgccttgcagcacgcacgagaaaggcaaaggtagccgatggaaatgcaactctcccaagcttcatggcctctcctcctcgtcctgctcctccccctcgtctgcttgctatacctgcgccacgatcacaacaggaagcagcaacctcgcgcatcagacggcgacctcaaggcctacccaatcgtcggcaggtttcctcacctggccaagaacggccaccgccttatcgaatggtccgtcgaggttgcgaagcggagcccgacgcagaccacggccttcaaagcccccggcctgcccggcgtcgtcatcaccgccaacccggacaacattgagcacatagccaagacgagcttcgccaactaccccaagggtgacttcctgtcgtcgaagctcgaggacttcctcggccacggcatcttcaactcggacggcgagcagtggctgtggcagcgcaaggccgccagcatggagttcagcaagcgctcgctgaggaagttcatcgtccacaccgtccagtcagaggtcgtcgggcgcctcctgccgctgctcgagcaggctgagcgccatgggcgcactctggacatgcagcacatcttcgagtgcttcaccttcgacaacatctgcaacgtggccttcggcgaggacccggggtgcctcgccaaggagggcgcggcgacgcccgaggccgcggagttcgtgcgcgccttcgactacgtgcagagcgccatcgtgggccggttcaggccgccggcaatctttctgtggcgtctccagagggcgctcaacatggagcccgagaagcagatccgtgaggcgctcggtgtcatccacggctacgccgacaggatcgtccggaggtgccgggagaaatgggcggccgccgccgggtcggagagcgggggcgacttcctggcgcacatcgtcgccgctcgcggcgacctcagcgacgagagcctccgggacgtcgtcaccaacctcctcctcgccgggcgcgacacgacgtcagctgcgctgacatggttcttctggctggtctccggccggcctgacgtcgagagcaagatcgtggacgagatccgtagagtccgcggatcaaggtcgtcaagccatggcggcggcacgggcgagacaacgacaacgaccttcaccttcgacgagctccgggagatgcactacatccaggctgccatcaccgagtcgatgcgcctgtacccgccggtgcccgtcggcttgcactactgcaaccaggacgacgtcctgccggacggcacgttcgtcgggaaagggtgggcggtgcaacactccgtgtacgcgatgtcacggctggagggcctgtggggcaaggactgcgaggagttcaggccggagcggtggctccgagaggacggcacgttccagccagagagcccgttcaggttccccgtgttccacgcgaggccaaggatgtgcctcggcaaggagctggcctacatccagatgaagttcatcgtctcctgcgcctttgagaggttcagcttcccgtaccaaggcggcgacgagcacccggagctggagttaatgttcatgctaaggatgaaaggcggactgccgatgcaagtgaccaagcagaggccggtgccagaggcagaggcagaggcagatctagcgtagatattaactgttgtaccaataataatcctgggctactttattagccattccatatctattatcacgtatattaatttgcagaggccggttcg

SEQ ID NO: 18080 - protein, 536 aa, Panicum virgatum
  misc_feature: Ceres CLONE 1795683
  misc_feature (41)..(520): Pfam Name: p450 Pfam Description: Cytochrome P450
  misc_feature: SWISSPROT Homolog: EC 1.14.14.1 Unspecific monooxygenase
MEMQLSQASWPLLLVLLLPLVCLLYLRHDHNRKQQPRASDGDLKAYPIVGRFPHLAKNGHRLIEWSVEVAKRSPTQTTAFKAPGLPGVVITANPDNIEHIAKTSFANYPKGDFLSSKLEDFLGHGIFNSDGEQWLWQRKAASMEFSKRSLRKFIVHTVQSEVVGRLLPLLEQAERHGRTLDMQHIFECFTFDNICNVAFGEDPGCLAKEGAATPEAAEFVRAFDYVQSAIVGRFRPPAIFLWRLQRALNMEPEKQIREALGVIHGYADRIVRRCREKWAAAAGSESGGDFLAHIVAARGDLSDESLRDVVTNLLLAGRDTTSAALTWFFWLVSGRPDVESKIVDEIRRVRGSRSSSHGGGTGETTTTTFTFDELREMHYIQAAITESMRLYPPVPVGLHYCNQDDVLPDGTFVGKGWAVQHSVYAMSRLEGLWGKDCEEFRPERWLREDGTFQPESPFRFPVFHARPRMCLGKELAYIQMKFIVSCAFERFSFPYQGGDEHPELELMFMLRMKGGLPMQVTKQRPVPEAEAEADLA

SEQ ID NO: 18081 - DNA, 1602 bp, Panicum virgatum
  misc_feature: Ceres CLONE 1795685
  misc_feature: Encodes the peptide sequence at SEQ ID NO. 18082
aatgctccaccaaacgctcctcccttcctcctttcccccctccggctccgcctcctcctcctcgcctttcctccacgcctccgacgccgccacagcgccaccggttggttcctccccctcccgcagcgccttcccgcgaggctccgccatgccttccctcgcgcaccgccatagccccgtggatgatgggaggatggacgcgctgaagagtcataatagcttcccgccggaggagacggcggaggacgccgcggcggcggccgccggtgcgcttgcggagaaagacgggttctcggtcgaggacctgctggaccttgaggagttcggcgagcctgacaaggacggtcccgacaacgaagaggcgccgccgccgccggccgccgccgcggccgaggtgaagtcgaacgaggactcgcagccgttgtcggtcgtgacttacgacctcccgccgccgccaccggagatggttgaccttccggcgcatgacgtcgaggagttggagtgggtctcccgcatcatggacgactcgctctccgagctgccgccgcagccgcagccttccgccgcgctggtggcgtccatggcggcgcggcccccgctgacgcagcagcggcgggcgccgcaggcgcacgacggcgcgtaccgtgcgctgccggcggcgcacggcccgctgcggaccccgaccatctgcgcgctgtccacggaggctctggtgccggtcaaggcgaagcgcagcaagcgtacgcggggcccggggtggtcgctctcgggcgcctcgttcttgtccgactcggcctcgtcctcgtcgaccaccaccacgtcctcctgctcctcgtcaggttcgttctcgtcgttcctcctggactcgcccccgttcggcgggctggagctgggcgagggctacttcaaccacttcctgccggcgccgccgtccaagaagtccaagcacggcggcggcaagggcagcaagcacaagcccaagaagcgcgggcgcaggccgaagcaccttcccccgaacccctccgccgccgcccagcagccggcgccgggcgaccgccgctgcagccactgcggcgtgcagaagaccccgcagtggcgcgcggggcccgagggcgccaagacgctgtgcaatgcgtgcggcgtccgctacaagtccgggcggctgctcccggagtaccgtcctgcttgcagccccacgttcgtgagcagcatccactccaactcccaccgcaaggtgctcgagatgcgccgcaagaaagagggcggcatggtcgccaccgctgcgccggccgtcgcgtcgttctagctgcccctccccggcagcaacaaggaggcttggccaccgagccgcagcggtggctgtacattttttccggccggaatagcctttgtaccgtacctggatttccctcccttttcctcttgctagtatcgtcgtcgtagtcccttgggttaattagagtttaggagctttcgattaggtctggttaggtttagctttggttacggttagggttctactgcgacagcagcagcaggcgcagcactagcgcagaacttaaatttctagcatttctaaaaaggcaagcttttatttcttcc

SEQ ID NO: 18082 - protein, 385 aa, Panicum virgatum
  misc_feature: Ceres CLONE 1795685
  misc_feature (305)..(340): Pfam Name: GATA Pfam Description: GATA zinc finger
  misc_feature: The sequence is a functional homolog of SEQ ID NO 608 in the 10/374,780 US patent application
MPSLAHRHSPVDDGRMDALKSHNSFPPEETAEDAAAAAAGALAEKDGFSVEDLLDLEEFGEPDKDGPDNEEAPPPPAAAAAEVKSNEDSQPLSVVTYDLPPPPPEMVDLPAHDVEELEWVSRIMDDSLSELPPQPQPSAALVASMAARPPLTQQRRAPQAHDGAYRALPAAHGPLRTPTICALSTEALVPVKAKRSKRTRGPGWSLSGASFLSDSASSSSTTTTSSCSSSGSFSSFLLDSPPFGGLELGEGYFNHFLPAPPSKKSKHGGGKGSKHKPKKRGRRPKHLPPNPSAAAQQPAPGDRRCSHCGVQKTPQWRAGPEGAKTLCNACGVRYKSGRLLPEYRPACSPTFVSSIHSNSHRKVLEMRRKKEGGMVATAAPAVASF

SEQ ID NO: 18083 - DNA, 721 bp, Panicum virgatum
  misc_feature: Ceres CLONE 1795691
  misc_feature: Encodes the peptide sequence at SEQ ID NO. 18084
caatggaaagacaaagacaagttctattaagtttcacacccttgagcctcaatggaatgaaatttttgaatttgatgccatggaagatcctccatcagtgatggaaatagacgtgtatgatttcgatggacccttcgatgaagttgcctcccttggtcatgctgaagtgaatttcttgaaatataatatatccgagcttgctgacatttggattcctcttaagggaaagctggctcaagcatgtcagtcgaaattgcatttgagaatattcttgaacaatacaaggggtaatcaaattgtaaaggattacctggacaaaatggagaaagaagttggcaaaaagattgctgtgaggtctcctcacgcaaatttagcattccagaaaatcttttctttgccaccagaagaatttcttatcaatgattttacttgtcacttaaagagaaaaatgctgacacagggtcgcctttttctgtctccaagaatatttgggttttacacaaacctttttggtaacaaaacaaaattcttctttctttgggaagatattgaacaaatcctagtggtccctgcaaccctggcttcaatgggaagtccgtctctggtgattattcttcgcaagggcagaggaattgatgcaaagcatggagcaaagcaactggacagtgaaggaagactcaagtttcatttccagtcttttgtctcattcagtgtcgcacat

SEQ ID NO: 18084 - protein, 239 aa, Panicum virgatum
  misc_feature: Ceres CLONE 1795691
  misc_feature (124)..(190): Pfam Name: GRAM Pfam Description: GRAM domain
NGKTKTSSIKFHTLEPQWNEIFEFDAMEDPPSVMEIDVYDFDGPFDEVASLGHAEVNFLKYNISELADIWIPLKGKLAQACQSKLHLRIFLNNTRGNQIVKDYLDKMEKEVGKKIAVRSPHANLAFQKIFSLPPEEFLINDFTCHLKRKMLTQGRLFLSPRIFGFYTNLFGNKTKFFFLWEDIEQILVVPATLASMGSPSLVIILRKGRGIDAKHGAKQLDSEGRLKFHFQSFVSFSVA

SEQ ID NO: 18085 - DNA, 1424 bp, Panicum virgatum
  misc_feature: Ceres CLONE 1795702
  misc_feature: Encodes the peptide sequence at SEQ ID NO. 18086
atttcccttcgcttggaagcaaacgaacgaggcgtgagataaagaggggctccggtatccaggccttggccgcatcgacactctccccaccaccaccaccgccaccgccgctgcggctcacggctacgcagcccgctctctcccctccttccggccgtcccctccccccccccccctctctccggttgcttcgacggttcgccccgaatcgatcgcccgactgaccccgctagggttcggcccgatcgcccgccgcttcgtcctccccgcgggggtttccccgacgcgatgtccgaccggagctcgccggccgcgccgacgttcttccccttcggcccgcaggccgaggcgtgggacgtcacgttcaaggtcaaatatggggacacacttaagaggttttatggttgtgtcaatggagctcattttgacatgaatttatctgctctacgggcaaagatagccactgcctttaagtttggtcctgatgccaacttcattctgacttacattgatgaggatggtgatgctgtaatgctagacgatgatgatgacctgcgcgatgcagctctgcgtcagaaattaaaccctctgaggattactgttcaactaaagaaaagtcaaccaactgaacaaaaggagaaaaattctacacctgtgaagcccactcctcaggatccactgtcccagattatgtcagctattgaaggtttgaagcctgctcaggaagaaaacctggcacatataaaatcagctattggtgaagctttcaagtctatcccagagccaattcctgatgcccttgcaaaactctctcatgaagtacttgatgcggcaccaccaccattagctgagctgatgaaaccttttgtgcaaatgatggcaccaagcaatagtggcaatggatcatctgatgcacatgctgatgggtcatccagctcttctagtggtgtgactgaggcacaggctcctgccaacaaagatgaacccaaagctaaggcgtgtttaggtcttaggagcgtgttagaggaagctcctgctcctgctgctcatagtgctggggcttctctaggtcaacaaccatctatgtacccatctgttgaggagttgctgttccccagcaattcagttgacatatctgtttgcaaagggaagattgatgctcaaagtacgggcaaatctgttatgtcctctgctacacaggctgcccctcatgctgttcccattcatgctccacctccaccgcctccttgtgtttctgaatggttccgttcacgaagaagccaaccactccagtggcaatctgaagataatgcaaaagtcactaatgattccaaatgacgcatcccaatgtataaagtaccctatgcatcacctgcagcagtgcctcccccaggctatggaccttctccacattttccttatcc

SEQ ID NO: 18086 - protein, 349 aa, Panicum virgatum
  misc_feature: Ceres CLONE 1795702
  misc_feature (23)..(108): Pfam Name: PB1 Pfam Description: PB1 domain
MSDRSSPAAPTFFPFGPQAEAWDVTFKVKYGDTLKRFYGCVNGAHFDMNLSALRAKIATAFKFGPDANFILTYIDEDGDAVMLDDDDDLRDAALRQKLNPLRITVQLKKSQPTEQKEKNSTPVKPTPQDPLSQIMSAIEGLKPAQEENLAHIKSAIGEAFKSIPEPIPDALAKLSHEVLDAAPPPLAELMKPFVQMMAPSNSGNGSSDAHADGSSSSSSGVTEAQAPANKDEPKAKACLGLRSVLEEAPAPAAHSAGASLGQQPSMYPSVEELLFPSNSVDISVCKGKIDAQSTGKSVMSSATQAAPHAVPIHAPPPPPPCVSEWFRSRRSQPLQWQSEDNAKVTNDSK

SEQ ID NO: 18087 - DNA, 667 bp, Panicum virgatum
  misc_feature: Ceres CLONE 1795702-R
  misc_feature: Encodes the peptide sequence at SEQ ID NO. 18088
cacctgcatctgcatctgtatctgtccctgcttctatgcctgtgcctccacctgttagtactgctgcagcacctgagccttttgacacagatgatcataatgaagagaagctattgagggagctggaggaaatgggctttaggcagattgatctgaacaaggaaatccttaggcagaacaattacaacctggagcagtccgttgatgatctgtgtggtgtcaacgaatgggatccactccttgcagagctagaggagatgggctttgatgataccgagatgaacaaggagctgcttgcgaagaatgggggaagcatcaagcgagctgtgatggacctcatcgccagggagaagaaggacaagtgaagatcgtgtgcctgtgcacatagttatctatgatctacgtgtaaataatgaggctgctgtaccactccggtgcagcactatcacgtctcagagcttgcttaccttagaactgttgattttatgcgacttctttatattggtcgtgcgtcgtgtagtgtctggtggtgtcgatgacttgccctaagcgcctcaggaaagcagttaccctgccaggtgaattgcttgtaaggattggctgtgatgccttctaagtatctgttaccgagacatgcaaacttataatatgatgcctatgtggatgt

SEQ ID NO: 18088 - protein, 120 aa, Panicum virgatum
  misc_feature: Ceres CLONE 1795702-R
  misc_feature (33)..(70): Pfam Name: UBA Pfam Description: UBA/TS-N domain
  misc_feature (75)..(112): Pfam Name: UBA Pfam Description: UBA/TS-N domain
PASASVSVPASMPVPPPVSTAAAPEPFDTDDHNEEKLLRELEEMGFRQIDLNKEILRQNNYNLEQSVDDLCGVNEWDPLLAELEEMGFDDTEMNKELLAKNGGSIKRAVMDLIAREKKDK

SEQ ID NO: 18089 - DNA, 644 bp, Panicum virgatum
  misc_feature: Ceres CLONE 1795730-R
  misc_feature: Encodes the peptide sequence at SEQ ID NO. 18090
ccaccacaagaaggacgaagaggagcagcccgccggcgggtactcggaggtggtggccgccggcgagagcgagtacgagaggtacaagaaggaggagaaggagcacaagcacaagcagcacctcggcgaggccggcgccgtcgccgccggcgccttcgcgctctacgagaagcacgaggcgaagaaggacccggagcacgcgcaccggcacaagatcacggaggagatcgccgccacggcggccgtcggcgccggcggctacgccttccacgagcaccacgagaagaagaaggaccacaaggacgccgaggagaccagcggcgagaagaagcaccaccacctcttcggctgacccgccggcgagcgagctccggcccggccgccgcgcacccgcctgcttgctccaataattgtggccatgatttcgcaataagtcccttccggacccttagcttgcttgcttgtgtgagactgagaggtggggcccgcgcgtcgaggtgtgttccggcctgtacgtgcttgatttttctttgcgtccgtaattgcgttgaataaccgggagcgatgcacgtgtggctcccagtctgtctgtctgtggttgagtgtctgtatcctgatgatcaactcgtggaagtttttacacc

SEQ ID NO: 18090 - protein, 116 aa, Panicum virgatum
  misc_feature: Ceres CLONE 1795730-R
  misc_feature (26)..(105): Pfam Name: ABA_WDS Pfam Description: ABA/WDS induced protein
HHKKDEEEQPAGGYSEVVAAGESEYERYKKEEKEHKHKQHLGEAGAVAAGAFALYEKHEAKKDPEHAHRHKITEEIAATAAVGAGGYAFHEHHEKKKDHKDAEETSGEKKHHHLFG

SEQ ID NO: 18091 - DNA, 374 bp, Panicum virgatum
  misc_feature: Ceres CLONE 1795730
aaatcccgggccaggtccaacccggccttttcgtcggggccagcccgccgagcgccagggaccgcacgcgaggggacctatccgaaggctgccccccaggtacgccgcgcctcgccccgcgccctgcttgcttgcctccactgcgggattaacacaactccaaccaaaaaccctaacgctgaaagcgccagctcatggccaaccagatcctccgcacgttcgctcccctcgactagaactacggggtctacttcgaatgcatcgccgagatggacaatgtcatgccgacgcaaactaccgcctcgaggtcgctcgagacggccagcttattcctcatctccaaccttgacaacagcgtgaacgtcgaggatatc

SEQ ID NO: 18092 - DNA, 1535 bp, Panicum virgatum
  misc_feature: Ceres CLONE 1795737
  misc_feature: Encodes the peptide sequence at SEQ ID NO. 18093
actttcctccacccctctcgagagtcgagactcgccgagctcgagactctgcgtgctaatggcggcggcggcggcggcggcggcggacctcacggggaccaagcgggtcatggcctacgcgctatgcaagcacctcaacgtagatcccagcactgtatcaagtattgaagagagtgatattgcaagcctgttttcacatattgtgaaatcatctcaggatgaggtgatgaagtgggtaaaattttccagtgattttgctgggagcgatggaaaacagcaagcgttgcttgataatctgaatcaggatttgtcccaaaaatctgtagtgcttggtgatggtcttaaaccatcagttgctgatattgtggtgtttgctactgttcaagctttcgtaactcgtgtcagcgacagcgagttacagaaatttcctcatgtattgcggtggatggactacattcagaacattgttgattttggtacaactacacaaaagataaatgtggccaaatctgtctttgctccaccttctcatctgaagaaagctgataaaggagacactgaatcaagttcaaagaaagccatttccggacagaagattgctgacaaatcaaatggaagtgctgactccaagaagaaacctgcaggggagactaaggctcctgaaaaggaaactactgctgcgaaagacaataaaacctctggtgagaagaagaaagataattctgcaggaaaaacagcggagaaaacttcagagaaagctccggagaaaactgcagacaaggattctgagtgcaatatcagtatcctgaatatacaggttggccttatccgtaaaacatggaagcatccatctgctgacagtcttttggttgaggagatagatttgggagatggtaatgtgcgtcaagttgttagtggtcttgcaaagtactgcagcccggatgatcttactaatcggcatgttgtcttgatcacgaatgtgaagcctgggaagctgagggatgtcatgtctgctggattggtcttgtgcgcttcaactgaagatcatacggctgtcgagcctttgattcctccagaaggagccaagattggagaacgcatttcctttgctgggttcgatgggaagcctgaagatgttctaaatccaaagaaaaagcagctggacaagattaccccgcatcttcgtaccgacgaaaatggaattgcaacattcaaagggataccctttactacatcagctggtccatgcaggtcttcgattcgcaacgggaatgttaagtgaggagctcattaggcatgcagcatgctgattccagacattgatgtggtagaacacatgcaaggtggctgtaccattttgacttgcatcttgtttttgcccatacaaaatgtgccaaatttcatctgaatcaattttctaatctctctaccagtgactgagcacagagtttttcaattttttgtgtatacaatcaaatatccttgagttgccacaggcttggtcctgtgttggcctagagatgggatagtttatc

SEQ ID NO: 18093 - protein, 407 aa, Panicum virgatum
  misc_feature: Ceres CLONE 1795737
  misc_feature (252)..(347): Pfam Name: tRNA_bind Pfam Description: Putative tRNA binding domain
  misc_feature: SWISSPROT Homolog: EC 6.1.1.1
MAAAAAAAADLTGTKRVMAYALCKHLNVDPSTVSSIEESDIASLFSHIVKSSQDEVMKWVKFSSDFAGSDGKQQALLDNLNQDLSQKSVVLGDGLKPSVADIVVFATVQAFVTRVSDSELQKFPHVLRWMDYIQNIVDFGTTTQKINVAKSVFAPPSHLKKADKGDTESSSKKAISGQKIADKSNGSADSKKKPAGETKAPEKETTAAKDNKTSGEKKKDNSAGKTAEKTSEKAPEKTADKDSECNISILNIQVGLIRKTWKHPSADSLLVEEIDLGDGNVRQVVSGLAKYCSPDDLTNRHVVLITNVKPGKLRDVMSAGLVLCASTEDHTAVEPLIPPEGAKIGERISFAGFDGKPEDVLNPKKKQLDKITPHLRTDENGIATFKGIPFTTSAGPCRSSIRNGNVK

SEQ ID NO: 18094 - DNA, 2122 bp, Panicum virgatum
  misc_feature: Ceres CLONE 1795747
  misc_feature: Encodes the peptide sequence at SEQ ID NO. 18095
actcatcagtgctcactctccagctctcatcaaacactgcaagcgagagctagctaccaaagacaaggacacaatgccacccttacccaagagacccgggcctctccttgtcctcctcgttgtcgcattcgcggccgccactgccgccgccgccgcctccgacgccgccggcgcgaccgttcccttctacccctccgcggaggccgccgcggccgcgcactgcgacggcacgctctaccctgacgtctgcctgtccacgctggccgacatcccggacctgcacaagaagcccctcccggacgtcatctgcgccgccgtgaaccgcaccgaggacgtcgtggcggccaccgcctccaactgctcctcctacctccgggagaggtccctgaccgcgcgcgaccacctcgccctcagcgactgcctggagctcctgtccaccagcatggacgagctccaggccacggtcgcggacctggagtcccccgccgccaccggcggcggtggctcggcgtcgtcgtcgtccgcggtgggcgccaggcgcgtgacgatggaccacgtgatgacggtgctctcggcggccatcacgaaccagtacacctgcctggacgggttcgcgtaccagaacggcgggcgcgtgcggcgctacatcgagccgacgctccaccacgtctcccgcatggtgagcaactcgctcgccatggcgaagaagctgcccggcgcgacgccgtcgccgccatcgccggcggcggcgcggcatccgttcatggggtacgggcagatggtgaaggggttcccgcggtgggtgcggcccggggaccggcggctgctgcaggcgccggcgtcgggcatcgcggcggacgcggtggtggcccaggacgggagcgggaactacacgacggtgtcggcggccgtggcggcggcgccgaccaactcgaagcggcggtacgtgatctacatcaaggccggggcgtacatggagaacgtggaggtcgggaagaagcacgtcaacctgatgttcgtcggcgacggcatcgggaagacggtcatcaaggccagccgcaacgtcgtcgacggctccaccaccttccgctccgccacagtcgctgttgtgggcaacaacttcctgggccgcgacctgacgatcgagaactcggctggcccgtccaagcaccaggcggtggcgctccgcgtgggcgccgacctctccgccttctaccgctgcagcttcgtggggtaccaggacaccctgtacgtgcactccctccgccagttcttccgcgactgcgacgtctacggcaccatcgacttcgtcttcggcaacgccgccgtcgtgctccagggctgcaacctctacgcccgccgcccgctgcccaaccagagcaacatcttcacggcgcagggccgcgaggaccccaaccagaacacgggcatctccgtccaccgctgcaaggtggcggccgccgccgacctcgccggccgggaggcctccacgcggacgtacctgggccggccctggaagcagtactcccgcacggtgttcatgcagtcggagctggactcgctcatcgacccggccgggtggctcgagtggagcggcgacttcgcgctcgacacgctctactacggcgagtacatgaacacgggcgccggcgccggcacgtccgggagggtcaagtggaaggggtaccgggtgatcaccagcgcggcggaggccagcgccttcaccgtcgggtcattcatcgacggcgacgtctggctcgccggcacgtccatccccttcaccaccggcttgtgagcgctggccggccggcgattattcatcatcattcatcagttgatcgatgcacgctgctgatgattcacatacagtgggctctggggaagatgtgtgtgtgtggcaaacaataaatgggtacggtggtggcgtgatttattgcggcattgagaggtacggtgtggaaaggcacccatagatgcatggttcggtcgcgtgttgcgttgttgctgccgtcgttgattctttctgtactagtgcatagcgcgagctatcgcgcgcggacctgtaaactttgcatcattccttgtaagacaatttgtatttaattttaaactattatatcag

SEQ ID NO: 18095 - protein, 573 aa, Panicum virgatum
  misc_feature: Ceres CLONE 1795747
  misc_feature (262)..(559): Pfam Name: Pectinesterase Pfam Description: Pectinesterase
  misc_feature (40)..(209): Pfam Name: PMEI Pfam Description: Plant invertase/pectin methylesterase inhibitor
  misc_feature: SWISSPROT Homolog: EC 3.1.1.11 Pectinesterase
  misc_feature: Functional homolog of the protein sequence given in SEQ ID NO 50796
  misc_feature: Useful for making plants with altered carbohydrate content
  misc_feature: Functional homolog of the protein sequence given in SEQ ID NO 50355
  misc_feature: Useful for making plants with modulated time to senescence
  misc_feature: Functional homolog of the protein sequence given in SEQ ID NO 50369
  misc_feature: Useful for making plants with altered cell wall content and/or composition
MPPLPKRPGPLLVLLVVAFAAATAAAAASDAAGATVPFYPSAEAAAAAHCDGTLYPDVCLSTLADIPDLHKKPLPDVICAAVNRTEDVVAATASNCSSYLRERSLTARDHLALSDCLELLSTSMDELQATVADLESPAATGGGGSASSSSAVGARRVTMDHVMTVLSAAITNQYTCLDGFAYQNGGRVRRYIEPTLHHVSRMVSNSLAMAKKLPGATPSPPSPAAARHPFMGYGQMVKGFPRWVRPGDRRLLQAPASGIAADAVVAQDGSGNYTTVSAAVAAAPTNSKRRYVIYIKAGAYMENVEVGKKHVNLMFVGDGIGKTVIKASRNVVDGSTTFRSATVAVVGNNFLGRDLTIENSAGPSKHQAVALRVGADLSAFYRCSFVGYQDTLYVHSLRQFFRDCDVYGTIDFVFGNAAVVLQGCNLYARRPLPNQSNIFTAQGREDPNQNTGISVHRCKVAAAADLAGREASTRTYLGRPWKQYSRTVFMQSELDSLIDPAGWLEWSGDFALDTLYYGEYMNTGAGAGTSGRVKWKGYRVITSAAEASAFTVGSFIDGDVWLAGTSIPFTTGL

SEQ ID NO: 18096 - DNA, 2253 bp, Panicum virgatum
  misc_feature: Ceres CLONE 1795761
  misc_feature: Encodes the peptide sequence at SEQ ID NO. 18097
aggctcgctcgagcccggttcattgacagccctcgctcaggggatcaggttcatctatctcctccctttgtttctttcttcccttctctcgggctctctctctctcctcccttgctcttccttccctccctggcggcggcgacggctgggcgagcggcggcgccaggtcttcgtccagccctttgccggcgacgagcatcctccagggggcaatatgaagtttgaggaagatggccatttgctatctcaggcaaaaagggatttgtcacgtgtggattatcaaacacagccttcggagtccaactatgttactgaccttagatcacatgcatattctgaggatcgtttgccgctgggaagagaatgtcagaggcagaagtcacaccttcctacttcaagctgttcttgggaaaactcttctgcattagaagcagcagcaccaccaccaagtagcccagatgcattagggcatgcattcgggaaaatgagaaccaaaaccaacaccctcagtgcaagaccacattatcgtgcttcatatcctgccactgctcttcacatgacaaagcatctaggagaagttgaactcgattatggtttagatcattctgatcgttgttgcagaagatcagaccgatttactgccttgtcaagccgcagtggtcaatctgtagaaaattgcagtgagctgggcgattatgccagtgccccccactatgtagatgggatcaatcctatttcacgtcaatggtgctttgatgatggaggcccttcggtaccaagagggctgcagtatggcgatgagatcccttctttgtctagtaagaagcataatgggctaccttcactctcaagccaatggcactacgatcttcaaaccccattgttctcaagaagacaggagtatggtgatgagatcccgtcactgtctccaaattggcgttaccgatataagattcctctgcactctggtcattggtgccatgatgctgaggcacctgcaccatcaaggtaccggcaaggtgcttctcattggaatggtcactcaagacaaaattttgccaggattaataccaatgagcaatccaaagttaccacaagcaaacatgcttttatgaaacataggatggtcaacagagttgtaaacagtagtatccaccacaggaccaatatgaaagataataggtgcagaaatcctgaggatataaaggaccaagttcgtgggccaagagcaagtaaattgaataatacttcagcttcatccagtgtgaaagatatctcaagtccatttgtctgtagggatcaaattaatagatccgacttttcagttcagtataaacaggccaagtttttcatgataaaatcatatagtgaagacgatattcataaaggtatcaaatacaacgtttgggcaagtacagcaaacgggaatgataaacttgatgctgcttaccatgaagctcaaattttaatgaaagagaatggggagaactgtcctgtgttcctattcttctcggttaacaccagcggacagtttgtagggttggctgaaatgttaggccctgttgatttcaagaaaaccatggatttctggaaaggagataaatggaatggctttttccctataatatggcatattataaaggacattccaaatcgtctgttcaaacatataattcttgaacacaatgattacagaccagttacttttagtagggacactcaggagattgggttggcacaaggtatgcaaatgttgaaaattttcaaggatcaccttcagggaacatcaattctggatgattttgatttttatgaagaaaaagataatgcatgccgtgcccaaaagggcgaaaacccagagtcaacacatcaagctagattttctgaagacttggagccgatgggaaatttggaggcacgcatggagagctggagtttgtacgagaattgggactagtgcacagatcactgtacaactgaaataaagagcattatttatgagtcagtaaagtagctgaaggcactgacgctcctttggagaacaattccaaccaaaaattgtctatacgtgtcatctgaaactgctttattgttatacagtgtttatgtagtagcataggtgtattggtaaacagagacgtgaagagattttagcaccggagatttcctgaaaccagggtacttcgatatttccagaattctggttacttgtcaaatgtgagttttgagccttgttgcttgttactacttttt

SEQ ID NO: 18097 - protein, 580 aa, Panicum virgatum
  misc_feature: Ceres CLONE 1795761
  misc_feature (430)..(520): Pfam Name: YTH Pfam Description: YT521-B-like family
MKFEEDGHLLSQAKRDLSRVDYQTQPSESNYVTDLRSHAYSEDRLPLGRECQRQKSHLPTSSCSWENSSALEAAAPPPSSPDALGHAFGKMRTKTNTLSARPHYRASYPATALHMTKHLGEVELDYGLDHSDRCCRRSDRFTALSSRSGQSVENCSELGDYASAPHYVDGINPISRQWCFDDGGPSVPRGLQYGDEIPSLSSKKHNGLPSLSSQWHYDLQTPLFSRRQEYGDEIPSLSPNWRYRYKIPLHSGHWCHDAEAPAPSRYRQGASHWNGHSRQNFARINTNEQSKVTTSKHAFMKHRMVNRVVNSSIHHRTNMKDNRCRNPEDIKDQVRGPRASKLNNTSASSSVKDISSPFVCRDQINRSDFSVQYKQAKFFMIKSYSEDDIHKGIKYNVWASTANGNDKLDAAYHEAQILMKENGENCPVFLFFSVNTSGQFVGLAEMLGPVDFKKTMDFWKGDKWNGFFPIIWHIIKDIPNRLFKHIILEHNDYRPVTFSRDTQEIGLAQGMQMLKIFKDHLQGTSILDDFDFYEEKDNACRAQKGENPESTHQARFSEDLEPMGNLEARMESWSLYENWD

SEQ ID NO: 18098 - DNA, 1993 bp, Panicum virgatum
  misc_feature: Ceres CLONE 1795767
  misc_feature: Encodes the peptide sequence at SEQ ID NO. 18099
tagttcctttgcaagtcgcaaagacgcaaacgcaagggaggatttcaaaaaccctacctccccaccctaccccaccaggccaccacccccacccccgatctcccaatcccacccagatcgccgagcagcggcggcgcagaatggaggtgccgccggagatgctcgacgccctcgcgggctggttcgcgcagtcgctctcccccgacgccgccgcgcgccgcgccgccgagcagagcatctcctccgccgccggctccccgggcttcgcgctcgcgctccttggcctctccgcctccccgcgacacgacctccaggcccgcctcgcggcctcggtccacttcaagaacctgctccgccgccggtggcccaaggccgacgaggaggccgacgacgccgccgaccgcctccccgcctccgactgcgccatcatcaaggcgaacctcctccagctcctcctcaccgccccgcccctcatccaggcgcagctctccgaggcccttgccgccgccgcggagtccgacttccccgccaggtgggagtcgctcctcccgtccatcgtatcctccctcggcatcgccgtcaacgcgggggacgtcgccgccaccaattccttgctcgccgctgcggcgtcgctcttctcccgattccgcacgccttcgacaacaatgccctccgcctcgacctcaagtactgcctcgaaatctttgccgccccactcctcgaggtcttcctcttcgcatcccgccgacttcaggccgcggccaccacggtcaatccgctcgagctccgccccgtgtttgagtgccttcgcctctgctgcgagatcttctactcgcttaactcagtcgacctgcctgagttcttcgaggacaacatgcgccagtggatgacagagttccgtgccttcctcaccacatcatacccaccgcctgttgaggcagacggtgccccagatgccctgcgtgctgctgtttgtgataacttgcagctctatatggagaagtacgaggaggagttcaggggatacttgaaggaatttgttgaggctgtgtgggggctcctcatggcacagactgcttcgccatcccgcgcgcgactcgctgtgactgcaataaggttcttgactacagttgctgagagtgtgcaccatgccttgttcgggagtcctgaggcaatgaagcagatatgtgatagtgttgtcgtgcctaacctgcgactgcgggatgaggatgaagagttgtttgagggcaactgggtggaatatgtcaggcgtgactctgaggggagcgatgcagatacgctaagacgggctgcgtgccggttgctgagaggccttgcagcgaactaccgggaccaggtcgctgcacttgtgtcagcacaggttcagcaaatgttggctgcatatgcagctgatcgggcaaacaactggaaggagaaggatgctgcaatataccttgttatcgctgttatccagaagcctggtgccactggtggtggcacacctgtggttgacatggagagcttctttacatctgtgattgtgcctgagctccaggcccctgattggcagtctgagccaatgttgaaggctactgtcctcaggttcttgaaggagttcaggtttcaaatcctcaaagcaactgcactggcattgttaccaagtgtggtgaggtttttgacacatgagtcaaatgttgttcattcatatgctgcgacctttatcgagaacctactgatcatcaaggatgcggtcccggtaccaggggtgagcacagtgaccaggtctccacgctatgttgctactgatatcaatccgtatgccccacagatcattcagaacctgtccacagcactaagtttccccgattcatatgaaaatccctatctgatgaagtgcctgatgcgggtgcttgggatcgctaatatagctggtcaaattattcacgagatcaccactcgtcttgtggatattctgatggaagtgggcaataac

SEQ ID NO: 18099 - protein, 372 aa, Panicum virgatum
  misc_feature: Ceres CLONE 1795767
  misc_feature (1)..(283): Pfam Name: Cse1 Pfam Description: Cse1
MRQWMTEFRAFLTTSYPPPVEADGAPDALRAAVCDNLQLYMEKYEEEFRGYLKEFVEAVWGLLMAQTASPSRARLAVTAIRFLTTVAESVHHALFGSPEAMKQICDSVVVPNLRLRDEDEELFEGNWVEYVRRDSEGSDADTLRRAACRLLRGLAANYRDQVAALVSAQVQQMLAAYAADRANNWKEKDAAIYLVIAVIQKPGATGGGTPVVDMESFFTSVIVPELQAPDWQSEPMLKATVLRFLKEFRFQILKATALALLPSVVRFLTHESNVVHSYAATFIENLLIIKDAVPVPGVSTVTRSPRYVATDINPYAPQIIQNLSTALSFPDSYENPYLMKCLMRVLGIANIAGQIIHEITTRLVDILMEVGN

SEQ ID NO: 18100 - DNA, 673 bp, Panicum virgatum
  misc_feature: Ceres CLONE 1795767-R
caagatggagcacaacaggagcaaaacgatggtgctgatgcagtggatattcagaagacatcaggttattccgtctcatttgtacggcttcaatatgctggaaagagtgaagatgaccttttgaaagaagtaaatgatccaaaacagtttcttgtcacatctttggctaccctttctgcacagtctcctgggaggtttggtcctgtcattgagcagcatgtggacccagctaacaaaagtgtgcttcttcaactttgtgcagcctacaatgccaacattgtctaggacccaattgtgagggaaggcctttgcttgtttccgatgggtattgttgaaagatgattctctgggagttgtttgtctgccaagcctttctggtgtcatccttgtttagtggcacagtgttggttatgtcatggaacgggcagatgccaaaacatgtgaaagaaaaaaaaacattagcattgtggaggatttgtcaattaggtttggccgaggattttctttttcaggcagaggttccttttttggggcaaagtgtattggtactggtcgaggtcgagatgtatctggcatcctggatccttgagactgttggaacatgctgcaatttttgaatgtgcctgccgtagcaccggaaacggtattctgcagatgcattggagtcttcctc

SEQ ID NO: 18101 - DNA, 1426 bp, Panicum virgatum
  misc_feature: Ceres CLONE 1795777
  misc_feature: Encodes the peptide sequence at SEQ ID NO. 18102
atccactccccaacccacccactccgacgccatgggctcctcctacgacccctccccgtcccccggcgccggcgccggcgccgacgacctcgccttctacctctccgacctcggccccgcctccccctccgcctacctcgacctcccgcccaccccgcagcacgagaaacctcagcagcagccgcagcagtacccccagcccaacggcggggccgcggcgtcgccggaggacatggtgctccccttcatctcccgcatgctcatggaggaggacatcgacgataagttcttctacgactaccccgaccacccggcgctgctccaggcgcagcagcccttcctcgacatcctctccgacgacgcctcctcctcgtccccgtccgccgcccgcagcggcgccacccacccctccacctcctcctccgacgcggcctccgatgccgccgcagccaacgtgcccctcacccccgccgccgtcgactcctacgccccgttcaacggcttcgacctcgaccccgccgccttcttcagcgccggggccaactccgacctcatgagctccgccttcctcaagggcatggaggaggccaacaagttcctccccagccaggacaagctcgtcatcgacctcgacccgcccgacgacgccaagaggttcgtcctcccggccgagaacaagctcgcggcatccgggttcaacggcgctgctcccgctgccgcggtggccgtgaaggtggaggaggcggtcgtggcggcgcctgatacggtgccgggcggcgtcggcggcgtcgggggccgcggacggaagaaccggttcgacggcgaggaggacgacctggagatggaccgccggagcagcaagcagagcgcgctgcagggggacgccgaccagggggacgtcttcgacaagtacatgatcacctcccacgagatgtgcgtcgagcagatggagaagctgcggatcgccatgcaggaggaggctgccaggaaggacgcgaccgcgggcggtgggaacggcaaggccaaggccaaaggaggagggcgccgcggcgggagggaggttgtggacctgcgcacgctgctcatccactgcgcacaggcagtcgccaccgacgaccgccgcagcgccaccgagctgctcaagcagatcaagcagcatgccagcccgcagggggacgccacgcagcgccttgcccactgctttgccgagggcctgcaggcgcggctcgccggcacgggtagcatggtgtatcagtcgctgatggccaagcgcacgtccgcggtcgacatactccaggcataccagctgtacatggctgccatctgcttcaagaaggtggtattcatcttctcaaaccagaccatctacaatgcatccctgggtaagaagaagatacatatcgtcgattatgggatacattatggc

SEQ ID NO: 18102 - protein, 464 aa, Panicum virgatum
  misc_feature: Ceres CLONE 1795777
  misc_feature (321)..(464): Pfam Name: GRAS Pfam Description: GRAS family transcription factor
MGSSYDPSPSPGAGAGADDLAFYLSDLGPASPSAYLDLPPTPQHEKPQQQPQQYPQPNGGAAASPEDMVLPFISRMLMEEDIDDKFFYDYPDHPALLQAQQPFLDILSDDASSSSPSAARSGATHPSTSSSDAASDAAAANVPLTPAAVDSYAPFNGFDLDPAAFFSAGANSDLMSSAFLKGMEEANKFLPSQDKLVIDLDPPDDAKRFVLPAENKLAASGFNGAAPAAAVAVKVEEAVVAAPDTVPGGVGGVGGRGRKNRFDGEEDDLEMDRRSSKQSALQGDADQGDVFDKYMITSHEMCVEQMEKLRIAMQEEAARKDATAGGGNGKAKAKGGGRRGGREVVDLRTLLIHCAQAVATDDRRSATELLKQIKQHASPQGDATQRLAHCFAEGLQARLAGTGSMVYQSLMAKRTSAVDILQAYQLYMAAICFKKVVFIFSNQTIYNASLGKKKIHIVDYGIHY

SEQ ID NO: 18103 - DNA, 534 bp, Panicum virgatum
  misc_feature: Ceres CLONE 1795777-R
gctgttttttcaatatgttgtctacaaatataggtttaggtgtgtcatctagatatatctagtgacagtgtgttctgtatggcccagtgaatggccatggttccgtgggttccttgactcgaggtatgcctaatcagaattcaacatggacctgttctttccatgggagattgttttgctgattcatgtgattcactgaggaacatggttaacagaagatgtgagggatcagaagcagaaggcatgcagaaatccatgctttgatgtaatgtgaaatagatgtttattatgcagtcgtgtttctgcttagtgctatttagtagaatttagacttaggtcctgctctggatcatgttggctgcagtatcacttgcgagttgtgatcaatccagtcagctgattaggttgtaatggcagtccggtgcttgctgcactagcattgtatgataaagcgctgaaactagatgttctgttcattggagctctttcctgatgggcatgtgctacatattcatacatgattcatcttcatcg

SEQ ID NO: 18104 - DNA, 1447 bp, Panicum virgatum
  misc_feature: Ceres CLONE 1795795
  misc_feature: Encodes the peptide sequence at SEQ ID NO. 18105
accgctcgagcagaagccatgggcgaggaggccaagaaggaggaggcggagaagcccaaggaggcggcggcgccggcggaggacaagcccaaggacgcgccgccggcggaggagaagcccaaggagggcggcggcgaggagaagaaggaggaggcgccgccgccgccgcccccgccgccggaggaggtcgagatgcgggtctacatgcactgcgaggggtgcgccaggaaggtcaagaagatcctcaggcgcttcgacggagtggaggacgtgattgctgactcaaaggcacacaaggtggtggtgaaggggaagaaggcagccgccgaccccatgaaagtggtggcgcgtgtccagaagaagaccggacgcaaggtggagcttctctcgccgatcccgcctccgccggaggagaagaaggaagaggagaagaaggaggagccggagccacccaagctggaggaaaaaaaggagccgcctgtgctcgccgttgtactgaaggtacatatgcactgcgaagcctgcgctgaggggctcaggaagaggatcctcaagatgaaaggggtgcaatctgcagagccagacctgaaggcatcggaggtgacagtgaagggtgtgttcgaggaggccaagctggccgagtacgtgtacaagcgcaccggtaagcatgctgccatcatcaagtctgagcctgtggctccgccggagagcgcagggggtgacagcaaggccaaggaggagaagaaggcacaaggtggcagcgaggagaagaaggacgacgacaaggaggagaagaaggacggcaaagaaggtggcggcgaggagaagaaggaggagaagaaggagaaggagggtggtgatgctgccgccggcgacgagaaggagaaggcggacaaggagaaggaggcagctgccattgctgcggccaacctgtacatgcactacccgcggttcgcattccccggcgggtactaccagccgccgccgccgctaccgccgcccgggtatgtttaccagccagcctacccgccagcagcctacccaccgccaccggtgtatgcgcagcaccaccaggcaatggctccgcagatcttcagtgatgagaacccgaatgcgtgctacatcatgtaaaaaggtagaaccgtggggtctagaggaaataaaagaaaataagaagcaggggatggaaagagagagctgcataatttggaggttgtctttgcaaaaaaaaacgccattgagcaaagcaaatggcaacttgaagaaaagtaccaggctttttgaggggttagatctccatttcttttcattttgtaattttaaccctttttcacctttctggtataaagtaagtctggtcagtttatggatgttatatctttatgtagaattttgccttgtactgcctcagcttcagacttctataaaaaaaactgtactatactat

SEQ ID NO: 18105 - protein, 370 aa, Panicum virgatum
  misc_feature: Ceres CLONE 1795795
  misc_feature (58)..(122): Pfam Name: HMA Pfam Description: Heavy-metal-associated domain
  misc_feature (158)..(220): Pfam Name: HMA Pfam Description: Heavy-metal-associated domain
MGEEAKKEEAEKPKEAAAPAEDKPKDAPPAEEKPKEGGGEEKKEEAPPPPPPPPEEVEMRVYMHCEGCARKVKKILRRFDGVEDVIADSKAHKVVVKGKKAAADPMKVVARVQKKTGRKVELLSPIPPPPEEKKEEEKKEEPEPPKLEEKKEPPVLAVVLKVHMHCEACAEGLRKRILKMKGVQSAEPDLKASEVTVKGVFEEAKLAEYVYKRTGKHAAIIKSEPVAPPESAGGDSKAKEEKKAQGGSEEKKDDDKEEKKDGKEGGGEEKKEEKKEKEGGDAAAGDEKEKADKEKEAAAIAAANLYMHYPRFAFPGGYYQPPPPLPPPGYVYQPAYPPAAYPPPPVYAQHHQAMAPQIFSDENPNACYIM

SEQ ID NO: 18106 - DNA, 1857 bp, Panicum virgatum
  misc_feature: Ceres CLONE 1795801
  misc_feature: Encodes the peptide sequence at SEQ ID NO. 18107
ataacaacaggtaaaatcgctggctcgtcggcggcgccgcggccagatccgcctccaaccaccgaaccgaagcgcgccgccgtcgacctcctcaccgtcggtgttgggctggcgtttgagtccggtggtcatctccatccgcacctggcgttggtttctttcgtagcggtggactcctttggccccatggtggatcgctcactaaatcatccatccgtgcctccgattcggtcggcgtccaacgcgaccagattgatgccagatgatggcactggatttaggatctgcaggctaggatttgaccatggccttccggattggatatatctatctacacttgggttatgaaatcacgttcctaaaacatctgtctttgatttgtttgcatctatggatggagctgattagacgaagttctagatcaagcacacgtcaaaagaaataagcatatctgtaatgtgacattctgccgttcagcatgccctaaagattttagttacagaacaggagagctagatataaaggcgtggcttcttctgtgttgaagacaatggcagagaaggcagggcctgccatccataggcaggctgtgatagtgactgttgcagtggaatctagggcgcgccatctacttggcctccagtaacatacttatcttcagcttggtgtaaaggcacgtcgttgcaatggattgtcatacacagtaaattatgctggcacgctgttctgttctccggtaagatcttgatatagagaagtttgctcttgttgtgttggttaaacttatggcaaggtggttgttaatgcaatccttagctgggaaaaaaaaaatccaccaccacccagccgaacaatctcagctcgccggacacgcagaattgattgaagatggccgcgtcggcgctgcaccagaccaccagcttcctcgggcaggccctggtctcccgccccgccggcggcgccgacgccggcgggcgcatcaccatgcgccgcaccgtgaagagcgcgccccagagcatctggtacggccccgaccgccccaagtacctcggcccgttctccgagcagacgccgtcgtacctgaccggcgagttccccggcgactacgggtgggacacggcggggctgtccgccgacccggagacgttcgcgcgcaaccgcgagctggaggtgatccactcgcggtgggcgatgctgggcgcgctggggtgcgtgttcccggagatcctggccaagaacggcgtcaagttcggcgaggccgtgtggttcaaggccggcgcgcagatcttctccgagggcgggctggactacctggggaacccgaacctggtgcacgcgcagagcatcctggccatctgggcgtgccaggtggtgctcatgggcttcgtcgagggctaccgcgtcggcggcgggccgctcggcgaggggctcgacaaggtgtaccccggcggcgccttcgacccgctgggcctcgccgacgacccggacaccgccgcggagctcaaggtcaaggagctcaagaacggccgcctcgccatgttctccatgttcggcttcttcgtgcaggccatcgtcaccggcaagggccccatcgagaacctcttcgaccacgtcgccgaccccgtcgccaacaacgcctgggcctacgccaccaacttcgtccccggcaaatgaatgctgctctgctctgcttgtccaagaatgcagtaggcgtgtagagtcgcacgcgccggcgtatgcttcgtaagctcgtcagattcagatcagatcagcagctacgtctgcctgcacgtgatgtaaacttgtaaactacgcacagagatgcatgtgtaggatcaattgtgtaccgtaccattc

SEQ ID NO: 18107 - protein, 261 aa, Panicum virgatum
  misc_feature: Ceres CLONE 1795801
  misc_feature (60)..(228): Pfam Name: Chloroa_b-bind Pfam Description: Chlorophyll A-B binding protein
MAASALHQTTSFLGQALVSRPAGGADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGK

SEQ ID NO: 18108 - DNA, 2897 bp, Panicum virgatum
  misc_feature: Ceres CLONE 1795814
  misc_feature: Encodes the peptide sequence at SEQ ID NO. 18109
aaaaaaaaaaaaatcagtcttccttctgctcccctctcctctccactcctcccccgacgggttgagctcgcggcgtgcagcgtgtccgcatcgccgccgcccatcctcgttccaagcgcctttatccgcagccgtcgtcgccggccctaatccctagagctgccgtgttccccttctcctctctctcgctcagcatcgtcttcaacctccagacgtcaagaacagagcaagcagagccgccatcgatccaaaaatccacgagctccaccccgtggttttaaaatccaccacacccagggtctctccacctccctagcccctccacggcccctcaaactcgagctccgaccgtcatctcgccgggaatcgcagatctcccagccgccagttccaactccgcccggactcgacctcaccgtggaacttcatcgtccggccaccgtttccaccacccaacggctcaaatcgactgggcttctgattggtcatactcatagcgatgatggtgcctgatcttagtttctcagcatcaatctctagtgtgaagctcccaaggtatggggcatcaaagaatgagaaattcttggttaagaggaccccaaaattccgggcaaagtatggtactaatggccaggcaacaaagatggtcccaacaactgagttgaggaggaccaatggtggtggccttgcaagatcagggacagtcaatggttctccaaatggcactgtcaacagctcaaccaaggcaccaattaatggttctgcaaaggccattgtcaatagctcaaccaaaactgttattaacggtacaccgaagatgactgtgaatggtacaagtttggtgaaaggcagcaagatgtcctctcttgttaagacagagaagcacacgagattcaacaatgacccctttcaagaggaactgaaggttttgccttctgatgagggattcagctgggcgaaagataattacaactctgcgcagaggagcatagatatatggtcttttgtgctttcttttcgagtccgtgtgctatttgacaatgcaaaatgggcttatcctggtagattctcagaagaaaagcagaaagttcgaagacagaaaactgcttcatggttaagagagcaagtattgcagcttggcccaacatttattaagcttggacagttatcatccacacgatctgatttattcccaagagaatttgtcgacgagcttgcaaaactgcaggatagagtacctgcattctctcctgacaaagcaaaagctttcatagagaaggaaatgggttgttccattgatattgtgtacaaagaatttgaagaacgtccaatagcggcagcaagtcttggtcaggtacatcgtgcagtgctccataatggtgaacgagttgcagtcaaagttcagcgaccggggctcaaaaaactttttgacattgacctaaggaacttaaagctagtagctgagtattttcaaagaagtgaaacatttggaggcccttcaagggactggattggtatttacaaggaatgttccaaaattttatacgaagaaatcaattacatcaacgaaggaaagaatgcggacaggtttcgacgggatttcagaaatgtaaagtgggttcgcgtgccacttataatgtgggactacacaactgaaaaggtgttaaccctggagtatgttcctggtatcaaaattaacaatttgggtgtgcttgatagccggggctatagtcgctcactgattgcatcacgtgcaatagaatcttatctaattcagatattgaagactggatttttccatgctgatcctcatcctggaaaccttgctgtagataaggatggttctttaatatattatgattttggaatgatgggtgaaataaaatcattcactcgagagagattgctctccctgttctattctgtgtatgagaaggacgcaaacaaggttatgaaagctctaattgacctgggagctctacagccaacaggagatctctcaccggttaggaggtccattcaatttttcttggacaatctgttgagccagacaccagatcagcaacagactctggctacaattggagaagacttatttgcgatagcacaggatcagcctttccggtttccatccacatttacatttgttataagggcattctctactcttgaagggattggatatacattagatccagatttttcctttgtcaaagttgcagctccatatgcacaggaactgttagacttgaaacagagacaacggggtgggcctgaattagtccaggagataagaaagcaagcaaatgatgctcgtgattctaccatatcaatgccctacagaatacagagaattgaagattttgtaggacaactcgagtcaggtgatctgaaactcagggtcagagtactggagtctgaacgagctgctcggaaagctactgtgcttcagatggccaccatgtatacagccttgggtggtactctcttgaatgttggggtcacattgaacagtcaagggaaccaaataattgcaaacggttctttcattggtgcaggcatatttttagcattgctgatcagatctatgcaaagagtgaagaagcttgacaaattcgagaccatgatatgatcatcttgcaagatgtgcaaccgcagaagttcctgtccctgaaaaggcatggcatgacaaactaaatagtatctttgtcgatttacatgggaaatgcgcgccccctcaggtcatagtatatacgaagtgcatataggaaatttacattctttctgggaaacaagtgagctttcacatgctcttataaatctgtacaaactgtatcattatttagccgccaaggctaatcacatcgaccagtcaataaagcaaggaattcaagacg

SEQ ID NO: 18109 - protein, 710 aa, Panicum virgatum
  misc_feature: Ceres CLONE 1795814
  misc_feature (260)..(380): Pfam Name: ABC1 Pfam Description: ABC1 family
  misc_feature: SWISSPROT Homolog: EC 6.3.2.2 Glutamate--cysteine ligase
MMVPDLSFSASISSVKLPRYGASKNEKFLVKRTPKFRAKYGTNGQATKMVPTTELRRTNGGGLARSGTVNGSPNGTVNSSTKAPINGSAKAIVNSSTKTVINGTPKMTVNGTSLVKGSKMSSLVKTEKHTRFNNDPFQEELKVLPSDEGFSWAKDNYNSAQRSIDIWSFVLSFRVRVLFDNAKWAYPGRFSEEKQKVRRQKTASWLREQVLQLGPTFIKLGQLSSTRSDLFPREFVDELAKLQDRVPAFSPDKAKAFIEKEMGCSIDIVYKEFEERPIAAASLGQVHRAVLHNGERVAVKVQRPGLKKLFDIDLRNLKLVAEYFQRSETFGGPSRDWIGIYKECSKILYEEINYINEGKNADRFRRDFRNVKWVRVPLIMWDYTTEKVLTLEYVPGIKINNLGVLDSRGYSRSLIASRAIESYLIQILKTGFFHADPHPGNLAVDKDGSLIYYDFGMMGEIKSFTRERLLSLFYSVYEKDANKVMKALIDLGALQPTGDLSPVRRSIQFFLDNLLSQTPDQQQTLATIGEDLFAIAQDQPFRFPSTFTFVIRAFSTLEGIGYTLDPDFSFVKVAAPYAQELLDLKQRQRGGPELVQEIRKQANDARDSTISMPYRIQRIEDFVGQLESGDLKLRVRVLESERAARKATVLQMATMYTALGGTLLNVGVTLNSQGNQIIANGSFIGAGIFLALLIRSMQRVKKLDKFETMI

SEQ ID NO: 18110 - DNA, 1964 bp, Panicum virgatum
  misc_feature: Ceres CLONE 1795817
  misc_feature: Encodes the peptide sequence at SEQ ID NO. 18111
aatcccatcccatcccatcccatcgaatcgacgagctagcaaggtaggagggaggtgattcgattgattgcctggcttccctcccctcaaatcgagatcgaaatccccatgctgatgttgctaggctaggagcctcgatgagattccccttcatcaatttcagttatctgcctgcttccccttcgtccgccggggtgcgcgcgacaagtgccccgtgcaggttcccttcacttcacacatccaaccaggtacagtacattcccttgcctgatttccagcctcagctccagatgtaagtatcatcaacgccaggctcctggattagagccagccaatgcacactcgtttagagtagaccacaccgcaccgccgccctcatcattttgtgatctgggttgggtactcagatattcataaggacatgtgttgttacacacacatcttcggagttgggaccgcacccttaccctccatttgtccactctctctacctgcagtcatcttatccatcctcttcctctccagctgttccgctgcctgatacgcattgccattgaccttatgatcggctacctattcccttcttcagttcttgacgagatacacctttcaagttttgaacaccgtgaaatgatcctctgatccgacatgggcctcaaggaacagcatccgcaacccaacaccactgatcaaactgatgccgtcaactcgcctactgctgatgaccaccacaatccggccatcccccgtgtatcaagctgcagcactgataaggattctggcctttcactttgccgggtctgtcattgcgtcgagactgatttcagaggcgagtctgccctaggtttcttgggcattgtgccgccttcgagagagccttccgccccaaggaccaacaatgatgctaccaagacttccaccagcaaggatgtcatcactgggctaaaggatggaaccaatgcccccaggtttgttgagtttataagccccgagggcgagatattcgtgtgcgctactgacgtcgaatcaggccccctgcatcaacaagatcatcttgtggatctaggctgttcctgcaagaatgagcttgcccttgcgcattatgcctgtgcattgaagtggttcatcagccatggatccactgtgtgtgagatatgtggaagtattgctgcaaatgtaaggcctgacgatttcaacaaggtccttgtgtccttgaaggattatgaagctctcagggaaaggacatctactggggaactctcatacttgcagcatgtggcaaacacaggtgttgacccagatgctgttgcggcaatacgaaggcagcggcttagcgagatatcatcttggttcaatcctcataactctcacatgactgtctctcaagggcacgttgatcagccgccacttagtccaagcaataattctgtaccggagcatagtattgtggcagcgagacgggtgcatacaagatggagtttggagagtactggagttcttgttgctattggcctagctgtgattgttcttgcatggttggttgctccacatgttggcaagaaggctgctgtaattggtcttcacatgcttcttggaggtttatgcgcgttgactctagtaatatccatgagatttgttttcccgagaatccagtatgggtctatgcaatattgggcaatcttgtttgtgtcctggttccttgtgtttggtgtttgggcctcacgaactcgcagcatacgctcctcatgagcatgtagaatagcaagagtcactgtggcagagccagattgagttcgccatgacagtgttaggtactgcactcctgtgtatattcaccatactatccatatcggttgcctttttagggagttgttatatttgagatgtatatgcttgacctaagaaaggatggaaaatcatgttatatttgagatgtatatgcttgacctctggatgttatagtt

SEQ ID NO: 18111 - protein, 366 aa, Panicum virgatum
  misc_feature: Ceres CLONE 1795817
  misc_feature: Functional homolog of the protein sequence given in SEQ ID NO 50797
  misc_feature: Useful for making plants with modulated nitrogen use efficiency
MGLKEQHPQPNTTDQTDAVNSPTADDHHNPAIPRVSSCSTDKDSGLSLCRVCHCVETDFRGESALGFLGIVPPSREPSAPRTNNDATKTSTSKDVITGLKDGTNAPRFVEFISPEGEIFVCATDVESGPLHQQDHLVDLGCSCKNELALAHYACALKWFISHGSTVCEICGSIAANVRPDDFNKVLVSLKDYEALRERTSTGELSYLQHVANTGVDPDAVAAIRRQRLSEISSWFNPHNSHMTVSQGHVDQPPLSPSNNSVPEHSIVAARRVHTRWSLESTGVLVAIGLAVIVLAWLVAPHVGKKAAVIGLHMLLGGLCALTLVISMRFVFPRIQYGSMQYWAILFVSWFLVFGVWASRTRSIRSS

SEQ ID NO: 18112 - DNA, 1331 bp, Panicum virgatum
  misc_feature: Ceres CLONE 1795818
  misc_feature: Encodes the peptide sequence at SEQ ID NO. 18113
gctaatcaccctcctcgagccggccaaatcgaatcgaatcgaatcgaatcgcagggcgagcgcgcacgcgcaccgatcgccggcgatggccagcctcaccctgccgccggcgccccccaacccgcgccaggacgccatcgacctccacaaggccttcaaaggttttggttgtgacagtacagctgtgataaacatacttactcatcgcgattcagtgcaacgtggatacattcaacaggaatacaaggctatgtatcatgaggaactctcccagcgtatttcatctgaactcagtggacaccacaagaaagctatgttgctgtggattcttgatcctgctggacgtgatgcaactgttttgagagaagctctaagtggtgacactatggatcttagagcagccactgagataatatgttccaggacaccatcgcagttgcaaataatgaaacaaacttatttggcaagattcggtacttatcttgagcatgacattggtcaccacacatctggagatcaccagaagattttacttgcctatgtgggaattccacgctatgaaggccctgaggttgatcctactatagtgacacatgatgcgaaggacttgtacaaagctggtgagaaaaggctgggtacggatgaaaagactttcatccgcattttcactgaacgcagttgggcacacatagcatctgtttcttctgcttaccatcatatgtatgaccggaaattagagaaggttatcaagagtgaaacatctggaaactttgcatttgcacttttaactatcctcagatgcgcagagaatccggcaaagtattttgctaaggtcttgcgaaatgccatgaaaggtctaggcaccgatgacaaaacccttataagggtcgtggtgacaaggacggagattgatatgctatatatcaaggcagagtacttcaagaagtataagaagccattagccgaagctatcaactctgaaacatctggaaactatcggacgttccttctctcacttgtcggtcacggccactagtaacaggctttgtttcgaccatgggacatgatattccatcgatccaccctaaatgcagcgacctacctggaaaacgtatgatgtcgccatttatctgttgtgacttgtgaacctgtctaactgcaacatatgagatcctagtatgcttgtgcaaaccattcgtgtatatatatatgcgtatctggggtttgtgttggagaattctggacggagcactagggctattgctggttgcagtgggcttgtcgtgtgtctccataacaccaataatatgatgtcatgttcgtgtgtgctc

SEQ ID NO: 18113 - protein, 316 aa, Panicum virgatum
  misc_feature: Ceres CLONE 1795818
  misc_feature (246)..(311): Pfam Name: Annexin Pfam Description: Annexin
  misc_feature (170)..(236): Pfam Name: Annexin Pfam Description: Annexin
  misc_feature (15)..(80): Pfam Name: Annexin Pfam Description: Annexin
  misc_feature (87)..(152): Pfam Name: Annexin Pfam Description: Annexin
MASLTLPPAPPNPRQDAIDLHKAFKGFGCDSTAVINILTHRDSVQRGYIQQEYKAMYHEELSQRISSELSGHHKKAMLLWILDPAGRDATVLREALSGDTMDLRAATEIICSRTPSQLQIMKQTYLARFGTYLEHDIGHHTSGDHQKILLAYVGIPRYEGPEVDPTIVTHDAKDLYKAGEKRLGTDEKTFIRIFTERSWAHIASVSSAYHHMYDRKLEKVIKSETSGNFAFALLTILRCAENPAKYFAKVLRNAMKGLGTDDKTLIRVVVTRTEIDMLYIKAEYFKKYKKPLAEAINSETSGNYRTFLLSLVGHGH

SEQ ID NO: 18114 - DNA, 1939 bp, Panicum virgatum
  misc_feature: Ceres CLONE 1795846
  misc_feature: Encodes the peptide sequence at SEQ ID NO. 18115
aaaaaccccaaactgtacccgccatcctcctaaaaccctagcgcattcgtcccccaagcacgacagccatggcaaccaccgccgccgccgccgccgccgccgccgccaccccgctcgacgaagccaaggccaggaacgttctccgccaggttgagttctatttcagcgacagcaacctcccccgcgacgggttcctgcggaggaccgtcgaggaaagcgaggatggcttggtgagcttggctctcatatgctccttctcgcggatgaggtcgcacctagggctcgaaggggaggtgaagccggatactgtgccagaggagacggtgctcgcggttgcagaagtgctgcgccgttcctcctccctccgtatctctgaggacgggaagaaagttggtagagctaaggagttgctggagccagatgaggttatagagcaagtggactctaggacaattgctgcatcacctcttccttacaatgtaaaactggaagatgttgaatcgttttttgctcagtgtggcaaggtaaatagtgtgaggctacctcgacatgtttctgacaaaagacacttctgtggaactgctttagttgaattttctgaagaagatgaagccaaaggtgtttatgagaaaacacttgtttttgcaggggcagatctggaaataagaccaaagaaagaattcgatgctgaaagagaggtgaagaaagaagcatatgaaaaggcacaagctaataagaatagtggtgaaggttatccaaaaggtttgattctggccttcaagctgaagaaaattccagctaatggtggtgcagaacaaaatggtggggacaaagtagatgacgctgaaggtgctgagaaggatggatctgccaatactgcagagaaatcaagtatagggcatgaagacaaggctcctgaggataaaggcgttgcgagtaaagaacagtcagatggtgttgaggagacggaaggggtagcggctggggaaactgcacaatctgttgacaaggatgataaaaacccttcaaacaatgatgaagacaaaatctcaagggaggatataaaagaagaattcacaaaatttggcacagtgcggtatgtggacttcagtaaaggggatgattctggatttattcggtttgaagatcccacagcagctgaaaaggcacgtgcatttgcagccattgcagatgaaggtggtttgattatgaagggccacattgttagtctggagcctgtttctggtcaagctgagaaggattactggagtgcaattcgaggcggtcaagataaatataaagacagccggggcaacagaggacgggactggaagaataacagaggcggaaggcactttggtggtgggaagagggggcgctttgactcccgtgatagggcatcaaataaagctcagaaagtttagctttaggtcctataacgaggaaaacatatatgctgatgccgcgctgctccagtctgcacctttgaaagtggcatttggtgttttgcgccttttggttcttatgaatgttgggctgtgcattttaaagcgcagattatgaatgaaaccatgttgacaatgagaaatgaagtgtatgcggctaatgctcgatactgaagtctgaactctggtattgacaattggttccatctcggtaggacgacagtaactctggcactagttccatttccaaagttccctttgatggtgtattccggtgtgtggtttgacggctgttttggtaggaaaccaattaaggccatttctgatctgacgtgtgtttgtgcatgcgttgcgaagcatttctcaagtaatcctattcaagtacccccgattgtaacttgcggtcctatctcttgagtatgtgtcaacccaacacgtaagcaaatcttgacacaatctaatatacaacctctgcagttggttgttttgtgagt

SEQ ID NO: 18115 - protein, 451 aa, Panicum virgatum
  misc_feature: Ceres CLONE 1795846
  misc_feature (323)..(419): Pfam Name: RRM_3 Pfam Description: RNA binding motif
  misc_feature (24)..(96): Pfam Name: La Pfam Description: La domain
MATTAAAAAAAAATPLDEAKARNVLRQVEFYFSDSNLPRDGFLRRTVEESEDGLVSLALICSFSRMRSHLGLEGEVKPDTVPEETVLAVAEVLRRSSSLRISEDGKKVGRAKELLEPDEVIEQVDSRTIAASPLPYNVKLEDVESFFAQCGKVNSVRLPRHVSDKRHFCGTALVEFSEEDEAKGVYEKTLVFAGADLEIRPKKEFDAEREVKKEAYEKAQANKNSGEGYPKGLILAFKLKKIPANGGAEQNGGDKVDDAEGAEKDGSANTAEKSSIGHEDKAPEDKGVASKEQSDGVEETEGVAAGETAQSVDKDDKNPSNNDEDKISREDIKEEFTKFGTVRYVDFSKGDDSGFIRFEDPTAAEKARAFAAIADEGGLIMKGHIVSLEPVSGQAEKDYWSAIRGGQDKYKDSRGNRGRDWKNNRGGRHFGGGKRGRFDSRDRASNKAQKV

SEQ ID NO: 18116 - DNA, 550 bp, Panicum virgatum
  misc_feature: Ceres CLONE 1795858
  misc_feature: Encodes the peptide sequence at SEQ ID NO. 18117
ctttcttcctcctctccaccccctccccttcccccctcgggccaacgcgaggcgaaaaccaatacatctccgccctcgctcgccgaggaagctcgccaagaactgcatctacagcgggggagaggttgagagagaggcgataaaagtttctcctcgcctctctctctctctgtatctccttcccgtcttcctatctgtctgcgattctcgtcgcattggtttggtttccttgcaaaagggggcagctttttctgtcttcccttgatccagatgatggcgagcacgacgtcagcgaccgccgccgcggcggcattcgggggcccaactttttttttgacgcgggggtcgtcgtcggccatctgcccgagggtgtccaccggcggcaggaggcgctccggggtggtgcggtgcgacgccggcgtggagaccctggtgcaggtggtggccaaggcggccagcatcgccgcgctcgagcagttcaagatctccgccgaccggtacatgaaggaaaggagaagcctagctgtgattggcctcagtgtgcacacag

SEQ ID NO: 18117 - protein, 92 aa, Panicum virgatum
  misc_feature: Ceres CLONE 1795858
  misc_feature: SWISSPROT Homolog: EC 1.2.1.70 Glutamyl-tRNA reductase
MASTTSATAAAAAFGGPTFFLTRGSSSAICPRVSTGGRRRSGVVRCDAGVETLVQVVAKAASIAALEQFKISADRYMKERRSLAVIGLSVHT

SEQ ID NO: 18118 - DNA, 1738 bp, Panicum virgatum
  misc_feature: Ceres CLONE 1795875
  misc_feature: Encodes the peptide sequence at SEQ ID NO. 18119
atggcgccgccgccgcaacatcctaagaatcggagccgcggtccagcggcgaccggagggaacgggcgccccccgcgccggatggcgagccgggacgcggcggagcgcgccgcgttcttcgctcggcgcgaggccgcggcggtgctccggcgcgtgctccgcggggacgccaccaggcgcgccgcgggctccatcaagtccctcgtctactcccccaccgtccgcaacaagcgcgccaccttcgcgctcgtctgccagaccctcaagtatcttcctattcttaaggaggttttaggatcgagtggagtactaaacagcaaatggaagaaacaggaggaattagtcattgtgactgcctatgacatcctctttggtcagggaattgcagtttctggatcagctgagcagttaattctgacacacaaagacactcttagcagtgctcttgatagaatttgtgccaaaaagaaagtcagcagtgttgaagacttgctaggcaataaaacaccagtcaaaccaaagcccaggtttcttcgtgtcaacacactcaagaccactaccgagtctgtggtagaagaattgagcaaaatacacaaggttgctaaagatgatatggttccaaatatgttgcttctcccgcctggaactgatttgcacagccatccattggtcacaaatggaaaagtgtttttacagggcaaagctagttgtatggtagcggtcgcactgtgccctaagccaggttggaaggttattgatgcgtgcgcggctccagggaacaaaacagtccaccttgctgccctcatgaatggacaggggggcattatagcttgtgaacttaacaaagagagggccaagacattgcaaaatactatcagaagatctggagcaaataatattcaaacagtgaatggtgattttctggatatagatagcaacgatccatcatatgccgaggtccgtgctattctgttggacccctcttgctctggttctggaatatcaacagagagactagactacttgcttccttcacattctagagatgatcaggatgatgcgagtacaagctcaagggtcctaaagctctctgctttccagaagaaagctctctcacatgctctatcatttccctcagtggagagggtggtctacagcacctgctcgatccaccaggcagagaacgaggatgtcgtgaatgccgtcctacccttagccacatcacttggtttcgagcttgctactccatttccccaatggcaccgtcgtggccttcccgtctttgaaggatctgaacatttgcttcgaacggaccctgaggatggcctggaaggcttcttcatttcattgtttgtcagaaaagcagctggtggtgatgcagaagaacctaatgaagatgttaccgtggaagcacggaggaaagaacccaatgaagacgttgccgtggtagcgcgaagaaaacaaacgcgtagaaggcgaagcggggccaggtcgttcagttccttgaggctgtccaggatgatcctctgctccaacggggatttctggtaaagagaaggtgtttcctgatcttgcttgtttggtagtccatttggaagcagtagttagtttcgaactttttttggacaattggattcattttttgatatggcaaagaaaaaccaatgatccaggccatgttcatgttgcatggtcgtgccatatcatgcatgtatcaagcaaagcatccatcccattc

SEQ ID NO: 18119 - protein, 489 aa, Panicum virgatum
  misc_feature: Ceres CLONE 1795875
  misc_feature (138)..(425): Pfam Name: Nol1_Nop2_Fmu Pfam Description: NOL1/NOP2/sun family
  misc_feature: SWISSPROT Homolog: EC 2.1.1.29 tRNA (cytosine-5-)-methyltransferase
MASRDAAERAAFFARREAAAVLRRVLRGDATRRAAGSIKSLVYSPTVRNKRATFALVCQTLKYLPILKEVLGSSGVLNSKWKKQEELVIVTAYDILFGQGIAVSGSAEQLILTHKDTLSSALDRICAKKKVSSVEDLLGNKTPVKPKPRFLRVNTLKTTTESVVEELSKIHKVAKDDMVPNMLLLPPGTDLHSHPLVTNGKVFLQGKASCMVAVALCPKPGWKVIDACAAPGNKTVHLAALMNGQGGIIACELNKERAKTLQNTIRRSGANNIQTVNGDFLDIDSNDPSYAEVRAILLDPSCSGSGISTERLDYLLPSHSRDDQDDASTSSRVLKLSAFQKKALSHALSFPSVERVVYSTCSIHQAENEDVVNAVLPLATSLGFELATPFPQWHRRGLPVFEGSEHLLRTDPEDGLEGFFISLFVRKAAGGDAEEPNEDVTVEARRKEPNEDVAVVARRKQTRRRRSGARSFSSLRLSRMILCSNGDFW

SEQ ID NO: 18120 - DNA, 698 bp, Panicum virgatum
  misc_feature: Ceres CLONE 1795884
  misc_feature: Encodes the peptide sequence at SEQ ID NO. 18121
  misc_feature (627)..(627): n is a, c, t, g, unknown, or other
acgatacagagaggcaggaggaggaccctcaagcctctccccccctctgctgccatctcctctcctctgctctgtgtgtgcaagaaaccccaaaggaggagagaggtgaaagcaagaggctaggcttccttgacggagatgggggtgcagaggtacaggttcttcttctgcgggtgcggcgccaatgcggcggccggcgaccgtgagggcgacgacgacggggatttcagcgtgttcggcgagaaggctgagaagggggctgaagccggcccgcgggggctgtcgtgggcgcaggtggaggcgatgacgggcgggttcacctcggccgtggtcggcgagggcgggttcagcaccgtgtacctcgcgcgcctctccggcgcgctcgccgccgtcaaggtccaacgcagcagcgagcgcctccaccgcgtgttccgccaggagctcgacgcgctccagcgcgtccggcacccgcacatcgtccgcctcctcgccttctgcgaacagcaagaggaaggcgtgctggtgcttgaattcgcggcgaacgggaacctgcacgagcggctccacggcgggggcaaggccgcgggggcgatgccgtgggcgcggcgggtgtcggtggcgctgcangtggcgcgggcgctcgagtacctgcacgatcagtgcgagccgcaggtcgtgcacggggacgtgaaaggctc

SEQ ID NO: 18121 - protein, 186 aa, Panicum virgatum
  misc_feature: Ceres CLONE 1795884
  misc_feature (61)..(184): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature (163)..(163): Xaa is any aa, unknown, or other
MGVQRYRFFFCGCGANAAAGDREGDDDGDFSVFGEKAEKGAEAGPRGLSWAQVEAMTGGFTSAVVGEGGFSTVYLARLSGALAAVKVQRSSERLHRVFRQELDALQRVRHPHIVRLLAFCEQQEEGVLVLEFAANGNLHERLHGGGKAAGAMPWARRVSVALXVARALEYLHDQCEPQVVHGDVKG

SEQ ID NO: 18122 - DNA, 1810 bp, Panicum virgatum
  misc_feature: Ceres CLONE 1795889
  misc_feature: Encodes the peptide sequence at SEQ ID NO. 18123
aaaccgcgcggctgggcaccaagctaagccacgcccacgcgctggccggcggccggccggccatccatggcgcgcgcgcacccgctcaacgtcctggcgacgctcgaccgcgccaggacgcagcggtaccacctcgccgccgccgcgatcgcgggcacgggcttcctcgccggggcttacaacctgttcgctatcatcttcgccggcaggctgatcggccgcgtctactacgctgatgaaaccgccacccccggccagctgccccccgacgccgcggccgcgctcaacggtgccgcgttctgcgggacgtttctcgggcagctcgcgttcggctggctcggcgacaggatcggtcgccgacgcgcctacggatgggcactggcgctcatggccgtgttctccgcggcgtccggactctccttcggccgcgagccgaaggccgtcctggcgacactgtgcctcttccgcttctggctcggtgtcggcgtcggcggcagctaccccctgagcgcggccgtcatcgctgagtacgccaacaagcgcacccgcggcgcgttcgtcgccggagcccacgccatgcaaggtgtcggcatcctcctcgggtgcgctgtcgcgctcggcgtgtgctccgtcgtgccggaggccgaccacgtgtggcgcgcaatcctcgtggccggcgcagcgccggccgctctcggcttctacctgcgcacgaagctgccggagaccgctcggtacacggcgctggtcgcccgcaacccgaagcgtgcggcggacgacatgtcgctggtgctccgcaccagaatccaagagcaggaggtggacgtgtccgttggccgcgtcgacgacgagtggggcctcttctcggtgcagtttctgaagaggcatggcctccacctgctggccacctcaagcgcgtgcttcctcctcagcgtgacctactacagtcagaacatcctccagaaggatctcctcggcaagcatgggtgggtctccccttccccggcggcgagcatgggcgccgtccaggaagtcgcccgcctcgcccgcgcgcaggcgctcatcgcgctctgcggcgccaccccggggtacatcctgtcggtcgtcctcatcgacgtcctcgggcgccgccgcctccagctcgccggcttcgtggtgatgacggtctcactgcttgccctcgccatttcctacgaccactggacgtcgcaccctgccggcttcttcgcgctctacaacgtgaccttcttcttcgccaacgccgggcccaacgccaccacgtttgtcgcgcccgcggagctcttcccggcgcggctccggtgcacgtgccacggcgtcgccatggccgcagagaaggctggcgcggttctcgggacgttcgggtttttatccaagggcgccgacagcaagtacgtgtcgggcattggtgcccggaacgagctgttcgtgctggccggcaccaatttcctgggcatgctgatgtctctgttcgtcccggagacgaggggcgcgtcactggaggtactgtccaaggaggtcgtctacgaatcaattgacatgtttatggatagcaatggggaataattaccttttttttgcgcatggtgatgtttcccatcctcatctctgtccgctgtcctcacgaatggagagtattttcataaattgtcaggctgtcttcgcggaaatgtagaaaaattaaaaatgaattggaaaaaggtggaaagacattgcagcggggtgaacttgtttcataatggcaaaagcgcgaacccaattgcgggatggcaaattagtgaaaccaatttcg

SEQ ID NO: 18123 - protein, 505 aa, Panicum virgatum
  misc_feature: Ceres CLONE 1795889
  misc_feature (28)..(437): Pfam Name: MFS_1 Pfam Description: Major Facilitator Superfamily
  misc_feature: Functional homolog of the protein sequence given in SEQ ID NO 50798
  misc_feature: Useful for making plants with modulated phosphate use efficiency
  misc_feature: Functional homolog of the protein sequence given in SEQ ID NO 50799
  misc_feature: Useful for making plants with modulated carbohydrate content
MARAHPLNVLATLDRARTQRYHLAAAAIAGTGFLAGAYNLFAIIFAGRLIGRVYYADETATPGQLPPDAAAALNGAAFCGTFLGQLAFGWLGDRIGRRRAYGWALALMAVFSAASGLSFGREPKAVLATLCLFRFWLGVGVGGSYPLSAAVIAEYANKRTRGAFVAGAHAMQGVGILLGCAVALGVCSVVPEADHVWRAILVAGAAPAALGFYLRTKLPETARYTALVARNPKRAADDMSLVLRTRIQEQEVDVSVGRVDDEWGLFSVQFLKRHGLHLLATSSACFLLSVTYYSQNILQKDLLGKHGWVSPSPAASMGAVQEVARLARAQALIALCGATPGYILSVVLIDVLGRRRLQLAGFVVMTVSLLALAISYDHWTSHPAGFFALYNVTFFFANAGPNATTFVAPAELFPARLRCTCHGVAMAAEKAGAVLGTFGFLSKGADSKYVSGIGARNELFVLAGTNFLGMLMSLFVPETRGASLEVLSKEVVYESIDMFMDSNGE

SEQ ID NO: 18124 - DNA, 1362 bp, Panicum virgatum
  misc_feature: Ceres CLONE 1795905
  misc_feature: Encodes the peptide sequence at SEQ ID NO. 18125
gtcccccgtgacagcgaagcagaggctcatcaccctacccaagtacccatcctccgccgccgccatggcagcagcccccaccggcggccccgccatcaccatgtcctcctcctccttcctctctccgtcgccgttctatgtcaaggcgtcgaggaccagccaccgccgacccgccgggagaatgcctgtcaccgtccgctgcgtcagtagcccgccggccgccgatacaggtacgaccaagccctgatatacttcatcgctaatggtttcccatttgcatcctgctcactgaattctcttctagtctatgttaggtttcgtttcaggcgttcaatcgaatgctgcaggtgctagttcgactagggtattattctagttttctgttcgccgtggtagctccttgtttggctggtgttgcgttcatgtaaagagttgcctggagatgttgtaggaacagaaatacggatgttgtttcctgatattttcttcctcctgtcctgaagcttacaagactagtgtcccgcgcaatgcaaacatgaccaagctccaagcaggatatctgtttcctgagatagccaggagaagagcagctcatttgctgaagtaccctgatgctgagattataagccttgggataggtgacactaccgagcccattcctgacgtcataacaaatgccatggcagaggtgccttctcgttgtgaaaaataacaatctaatggtgttttcaattttatatattcagttcacctattttttttcaaaaaaatcaccaaaaaataccagttttcactggtgcattcacctttatgttttatttatttattttggctctcgtcgtttggttcttcttgtacatatttgtaggagcaaactaagaaaattcctctacatattttttttttgctctatacctcttttgcaattgcatttttttattgattactctatttgtaaagacagagagcacatgccttatcaacaattgatggctacagtggttatggagctgagcaaggtgaaaagaaactaagggcagcaattgctgcaacctactatgcggacattggtattgaagattcagacatatttgtctctgatggtgccaaatgtgacatttctcgcctccaggtcctttttggatctaatgtgacaattgcagtccaagacccatcataccctgcatatgttgattcaagtgttatcatgggccaaaccgacttatatcagcaagatgttcagaagtatggcaacattgagtacatgaaatgcaatcccgaaaatggatttttccctgatctgtcaactgtcccacgaacaaatataattttcttttgttcacccaacaaccctactggtgc

SEQ ID NO: 18125 - protein, 58 aa, Panicum virgatum
  misc_feature: Ceres CLONE 1795905
  misc_feature: SWISSPROT Homolog: EC 2.6.1.83 LL-diaminopimelate aminotransferase
  misc_feature: Functional homolog of the protein sequence given in SEQ ID NO 50595
  misc_feature: Useful for making plants with modulated nitrogen use efficiency
MTKLQAGYLFPEIARRRAAHLLKYPDAEIISLGIGDTTEPIPDVITNAMAEVPSRCEK

SEQ ID NO: 18126 - DNA, 631 bp, Panicum virgatum
  misc_feature: Ceres CLONE 1795905-R
  misc_feature: Encodes the peptide sequence at SEQ ID NO. 18127
gttgaaatcttcagatgacccttagtttttgcttatgcctgtttgtttcccatgcaggctatgcgtgacgtcgttggcttctacaaggagaacactgaaataattgttgacacatttacatcgcttgggttcaacgtgtatggtgccaagaacgctccttatgtgtgggtgcacttccctgatcgcaattcgtgggatgtgttcgctgagatcctcgagaaggcaaacgttgtcactactcctggcagtggatttggaccaggcggcgaaggctttgtgagggtcagtgcattcggccacagagagaacatcattgaagccgctaggagattaaagcaactgtacaaatgagcaccgacgcaacttctgtatcgcacttgaaggactgtaccaataagatcacagctggatttggaatgccaaatcctctctttggagctaccaggagatattagaagtgatacttgataatttcgtaggcttttttttaatggtgttactccattcaaaccatttccattttgaaataatgctttgtatacctgaggcgtttaaatcaccaatggttatatatggcctaggttattttccttacagttcttgctgttactgttcatttgcagttgctgtt

SEQ ID NO: 18127 - protein, 99 aa, Panicum virgatum
  misc_feature: Ceres CLONE 1795905-R
  misc_feature: SWISSPROT Homolog: EC 2.6.1.83 LL-diaminopimelate aminotransferase
  misc_feature: Functional homolog of the protein sequence given in SEQ ID NO 50595
  misc_feature: Useful for making plants with modulated nitrogen use efficiency
MQAMRDVVGFYKENTEIIVDTFTSLGFNVYGAKNAPYVWVHFPDRNSWDVFAEILEKANVVTTPGSGFGPGGEGFVRVSAFGHRENIIEAARRLKQLYK

SEQ ID NO: 18128 - DNA, 1691 bp, Panicum virgatum
  misc_feature: Ceres CLONE 1795911
  misc_feature: Encodes the peptide sequence at SEQ ID NO. 18129
ggtgccttctccccccaacttttccttcccttcccttcgccgcacgacgactgacgacgaccaccccccaaccccacgccgggaagccgcaccaaatctcatcccctctcctctagggcggctgtaaaaatctggtggtggtggaatttcgtgcctcggcgtggcccccgtgctccgattcctgatcacctgcgcgcaccctatgagcgcggggcgcgcggattggggctccggctgctcgggcgcgcgcgcggggtgtccgtgttaatgcctcggctgtcctgcaagttcgcagaccccgacagcgtcgtttcctcctccgcggctgctgctgctgcggcgcggcgcgtgcgtccagacacgatgagctgcggcagcgacgtgtgccgggacggcagcagcagtggcagcgacgacttcaggcggccgcggcccagcaaggtcgcggctgatgattcggtggcgccggcacggtgctcggatgcggcggcgccggctcggagctcggatgccacggcgccggcgtcctggatcgacaggaagctgcttgttgatcccaagatgctgttcgttggggacaagattggggagggagctcatgggaaggtctacaagggaaagtatggtgaacaaattgtagcaataaaggttcttacccgaggcagcactcctgaagagaaagcaacacttgaagcccgtttcattcgagaagtaaatatgatgtgcaaagtgaaacatgagaatcttgtcaagttcattggcgcgtgcaaggaaccattgatggtgattgttagcgagctactgcctgggatgtcactgaaaaattacctgaacagcattcggcctagccaactagatacacatactgcaatcagctatgccctagacatagctcatgcaatggactgtttacatgccaatggcataatacacagagacctgaaacctgataatttattgcttacagcaaatcgtaagaagctgaaacttactgattttggacttgcacgtgaagaaactgtgactgaaatgatgacggctgaaactgggacttaccgatggatggccccagagttatacagcacagtcacacttcgacgtggtgagaaaaagcattacacaaataaagtggatgtgtacagctttggcattgttttgtgggaattgctgaccaatagaatgccattcgaaggcatgtcaaatctacaagctgcatatgctgctgcttttcagcaaaagcgcccaccacttcccgaggagacaccccaggagcttatgttcatagtgcagtcatgctgggttgaggatcctagcatgcgacccagtttcagccagatcatccggatgcttgaaactttcctcatgacaatacctcctccaccatctttggaaccaaatgaagatgaggaatcagaagaaacaaggtcgtcactgagcagtaggagctcctctggctcctcgcttgtttcgcgtgcgacaagcaagctcttggtcgtccgccatctcttcgcctcaaagaaggcaggcaatgggaaggcgtgatgtgtcttaggtgccctgagatgttttcctttggtgctgtaaagatgctagcctaggtcatgggtaatacaagagggatcttgttcggtgtagagtagctgttgtattgatgatagaaaggaaagttgaaagcgcaacttttgcaagcc

SEQ ID NO: 18129 - protein, 392 aa, Panicum virgatum
  misc_feature: Ceres CLONE 1795911
  misc_feature (68)..(329): Pfam Name: Pkinase_Tyr Pfam Description: Protein tyrosine kinase
  misc_feature: SWISSPROT Homolog: EC 2.7.11.1 Non-specific serine/threonine protein kinase
MSCGSDVCRDGSSSGSDDFRRPRPSKVAADDSVAPARCSDAAAPARSSDATAPASWIDRKLLVDPKMLFVGDKIGEGAHGKVYKGKYGEQIVAIKVLTRGSTPEEKATLEARFIREVNMMCKVKHENLVKFIGACKEPLMVIVSELLPGMSLKNYLNSIRPSQLDTHTAISYALDIAHAMDCLHANGIIHRDLKPDNLLLTANRKKLKLTDFGLAREETVTEMMTAETGTYRWMAPELYSTVTLRRGEKKHYTNKVDVYSFGIVLWELLTNRMPFEGMSNLQAAYAAAFQQKRPPLPEETPQELMFIVQSCWVEDPSMRPSFSQIIRMLETFLMTIPPPPSLEPNEDEESEETRSSLSSRSSSGSSLVSRATSKLLVVRHLFASKKAGNGKA

SEQ ID NO: 18130 - DNA, 1706 bp, Panicum virgatum
  misc_feature: Ceres CLONE 1795915
  misc_feature: Encodes the peptide sequence at SEQ ID NO. 18131
aacaccccacctgcatcctgtatctacccccgcgacctcgtcggcgacgccacgatgccggaggacatcgagatgaacgactcccaggccccgcccgccgccgcccccgccgttagcgacgccccggcgcccgcgcagtccactctccaccatctgaaggagatcgcgtcggtgattgaggccgggtcgctgagcaaggaggtccgccggatctcacgcgccgtccgcctgaccatcgccctacgccgccgcctcgccgcccacgacgttgctgccttcctggccttcgcgctgcctccttcctcggaggccttcacccgcctctccgccctcgtgcccaaggaagatgggagtgaaatggatgttgatatggcagctccagcagctcaagtttcaatcaagcatggtcttcctgagattgaaatttattgttacttgcttgtgcttattttcctttttgataataagaaatatgacgaggctaaaacatgtgccgccgcaagcattgctcgtctgaagagtcttaacaggagaacagttgatgttttagcttctaggctgtactcctattactcatatgtccatgagcttaccaacacccttgctgagattcgtgggactctcctggcattgcacagaatggcaactttacaccatgatgagcttggtcaggaaactcttctcaatctgcttcttcgcaattacctgcactacaacttgtatgaccaggcagaaaagctaaggtcaaaggcgcctcgttttgaagcacattccaatcaacagttctgccggtatctcttttacttgggcaaaataaggacaattcagttggagtacactgatgctaaggaaagcctcttgcaagctgctagaaaggcacccactacagctcgaggatttcggatccagtgcaacaaatggggcattattgtaaggctgctcttaggagagattccagagagaactgttttcatgcagaaaggaatgaaagctgctttgacaccctattttgagcttacaaatgctgtccgagttggtgatctagagctattcagatctgtggcagataaattttcaagcactttcagtgcagataggacccggaatttgatagtgaggctgcgccacaatgttatccggactggattgcgtaacatcagcatctcatactcaaggatttcccttgctgatattgccaagaagctgaggttgaactctgagaaccctgtcgctgatgctgaaagcattgtagccaaggccatcagggatggggcaattgatgccaccattgatcatgccaacagctgtatggtgtcgaaggagactggtgatgtctactcaactaatgagccacagatagctttcaactcaaggatcgctttttgcctgaacatgcataacgaggcagtcaaggcgctaagattccctccgaactcacacaaggaaaaggagagtgctgagaagaggcgtgagaggctccagcaggaggaagaactggcaaaacatatggccgaggaagatgatgatgatttctagactggtgcaaatcgtttcagttgccgcttcttggtttcattttaagagcaaacgactaatttagttgattaaagctgcacacgaactcttgtcaaatttagagttctttattgtaacattttatataattacatatgacttcgaaaaaacaacatttattttttatcccg

SEQ ID NO: 18131 - protein, 493 aa, Panicum virgatum
  misc_feature: Ceres CLONE 1795915
  misc_feature (426)..(492): Pfam Name: Rpn3_C Pfam Description: Proteasome regulatory subunit C-terminal
  misc_feature (316)..(423): Pfam Name: PCI Pfam Description: PCI domain
MPEDIEMNDSQAPPAAAPAVSDAPAPAQSTLHHLKEIASVIEAGSLSKEVRRISRAVRLTIALRRRLAAHDVAAFLAFALPPSSEAFTRLSALVPKEDGSEMDVDMAAPAAQVSIKHGLPEIEIYCYLLVLIFLFDNKKYDEAKTCAAASIARLKSLNRRTVDVLASRLYSYYSYVHELTNTLAEIRGTLLALHRMATLHHDELGQETLLNLLLRNYLHYNLYDQAEKLRSKAPRFEAHSNQQFCRYLFYLGKIRTIQLEYTDAKESLLQAARKAPTTARGFRIQCNKWGIIVRLLLGEIPERTVFMQKGMKAALTPYFELTNAVRVGDLELFRSVADKFSSTFSADRTRNLIVRLRHNVIRTGLRNISISYSRISLADIAKKLRLNSENPVADAESIVAKAIRDGAIDATIDHANSCMVSKETGDVYSTNEPQIAFNSRIAFCLNMHNEAVKALRFPPNSHKEKESAEKRRERLQQEEELAKHMAEEDDDDF

SEQ ID NO: 18132 - DNA, 1545 bp, Panicum virgatum
  misc_feature: Ceres CLONE 1795921
  misc_feature: Encodes the peptide sequence at SEQ ID NO. 18133
acacacaaaccaaaaagtatctcccgcgcacgcgcgcgctcccgtcttatcccttctccgtctcgccgtgtcgacgcgcccgcctagagcggtagagctcatcccgctcccgcccgcccgcccgccagcccgccgcgcgcgccatggcctccgacgcgcggctctccctgccgtgccgcctccccgcgtgcctgccgcccccgccggcgctccgccgctttccgccccgcgccgccgcggcggtggcggcggcgtccacctccccgaggtgccgcgtcttgacaacggcggtgccggcgcgcccccgcgggcggtggcgggctcgcgccgccgggggcgaggcgcagggccaggtgcagcagcagcagcagcagcagcaggacgaggaggtggtggacagcaacgtgctcccctactgcagcatcgaccgcaagcagaagaagaccatcggggagatggagcaggagttcctgcaggcgctgcaggcgttctacttcgacaagaaggccatcttgtccaacgaggagttcgataacctcaaggaggagctcatgtgggaaggcagcagcgttgtcatgctaagcccggatgaacaaaggcttctggaagcctccatggcatatgtggctggcaaccccatcatgacggatgctgaattcgatgacctcaagttgagattaaagaaagaaggaagcgacattgtacaggaaggtccaaggtgcagcctacggagtcgaaaggtctacagtgacttgactgttgactacttcaagatgttcctgctaaatgttccagcggctgttgtagctctaacactattcttcttcttggatgatttgacgggatttgagatcacatatcttcttgagttgccagagcctttcagtttcatcttcacatggttcgctgcactgcctttaatattttggatagcacaggctatcactaatgttattgtgaaagacttcctgattttgaagggcccatgcccaaattgtggaaatgagaacctttccttcttcgggactatattgtcagtgcctagtggtggtgtaaaaaacactgtgaaatgcgcaaattgtggcactgagttggtgtacgactcggcatcccggttgattacactcccagaactggcagaggcataagtaaaggtggtttaggtttcactaggaggagagatggccgagcaaatcctgtgatccacagcacaaagcaaggcctgacctagagtgggtgacaatcgtgcagtgatgtttgtttgtcatgctggtcgatgtatatcttaaacaagtgtagatatttgtactatacagtgttgatgaaatggagatatgtgcatagtgtacaaagaaaaactggccatatatgttcgtactatcttagcatatcataccctgtctgaagaacttgatactggatgtgaagttcactaggaaagaccaccatcgtaaaaacataactcaacctgaaaaaatgccatgcagtgtgagtttgtagtcgagttaattgtgaggagaaaagactaaggtctctcttgacttc

SEQ ID NO: 18133 - protein, 334 aa, Panicum virgatum
  misc_feature: Ceres CLONE 1795921
  misc_feature: Functional homolog of the protein sequence given in SEQ ID NO 50723
  misc_feature: Useful for making plants with modulated nitrogen use efficiency
MASDARLSLPCRLPACLPPPPALRRFPPRAAAAVAAASTSPRCRVLTTAVPARPRGRWRARAAGGEAQGQVQQQQQQQQDEEVVDSNVLPYCSIDRKQKKTIGEMEQEFLQALQAFYFDKKAILSNEEFDNLKEELMWEGSSVVMLSPDEQRLLEASMAYVAGNPIMTDAEFDDLKLRLKKEGSDIVQEGPRCSLRSRKVYSDLTVDYFKMFLLNVPAAVVALTLFFFLDDLTGFEITYLLELPEPFSFIFTWFAALPLIFWIAQAITNVIVKDFLILKGPCPNCGNENLSFFGTILSVPSGGVKNTVKCANCGTELVYDSASRLITLPELAEA

SEQ ID NO: 18134 - DNA, 1775 bp, Panicum virgatum
  misc_feature: Ceres CLONE 1795933
  misc_feature: Encodes the peptide sequence at SEQ ID NO. 18135
atacttatattttaataagaaattaagaactaagaccccaggcaacgcccggaggccctgctgctcccagctcaggtgcggaaatgcagtccggcgagctcctgcccggacccgggccgtccctcggctccaaacccgccgacggccgcggcggctggcgcgccgcgcgcttcttcctcgcgatcggcttcctggagcgactcgggttctacggcgtgcagagcaacctgatcatgtacctgaccggcccgcttggcatgtccacggcgtccgcggccgcaggcgtgaacgcgtgggccggggccgtcctggtgctgccgctcgccggcgcgctcgccgcggactcgcggctcgggcgctaccgcgcggtcctcgtcgccggcgggctttatctactgagcttgggcagtctgacgatctcatccatgctgcaagcgccgcaacctcacgcagcggggggctccccatcttctaccatgctcgccttcttctacgtcgcgctgtacctgctggctctggcgcaagccttccacaggccgtgcgtggaggccctcggcgcggaccagttcgctccgggcgacggcagtgacccgggcgcgcccgcgtcacgaagctcctacttcaattggttccatttctcccaatcgtggggctacgccatcgcgacggcggggctgagctacgtcgaggacaacgtcggctggaccgccgggttcggcgcctgctgggccacaatggcgctgtatctcgcagtcttcttgcttggcacgcgggcgtatcgtgccgaaaaacccatcggcgtcagatcgttcactgaatccgtgcggttgtggagagccagggtcttccgtcgcagtgacgccaaaactgatgccgaacggcttcttctggctcaagaacatgagggaggcaaagaactcattgcgaagctgctcccgatttggctgacgagcttaatcatagccgtcatcttctcgcaactctacacattgttcaccaagcagggcagcacgctggacaggcgcctcggcggcgcgacctcgggcctcgtcgtgccgcccgcggcgctgcagtgcctcatgagcgccaccttggtcaccacgctcccggtgtacgaccgcgtgctggtgcccctcgccaggcgcgtcacggggcaccacgcgggcgtcacgatgctccagcgcattggcgcgggcatggccgtgtccggcgtcgccatggccgtcgcggcgctggtggaaggcaggcggctccgcgtggccagggacgcgggcctggtggaccggccagatgtggcgttgccgatgagcctgtggtgggtggcgccgcagtacgtgctgctcggagtcgcggccgtgctggcccagatcgggctcgaggagttcttctacgaccaggtgcccgacacgctccgcagcgtcgggctcgccatgtgcctgagcatattcggcgtggggagctacgctagcagcatgctcgtgtccgcggtcgattgggcgacgaggagcaagggcgagagctggttctccgataacctgaaccgggcgcacctcgactacttctactggctcctggcggggctcgccgccgtcgaggtggctgcgttcttgcactttgcgagcagatatgtctacagaaacgaagttcagcgatgatacttgaaacttcgaaagtcgcagtgatttgctcgcggcaaaactgtatacgaagtgctaagagaaggaaggtgaacaaagttatgatttcttcatgcaacaaggtctgcaagttaagat

SEQ ID NO: 18135 - protein, 523 aa, Panicum virgatum
  misc_feature: Ceres CLONE 1795933
  misc_feature (93)..(455): Pfam Name: PTR2 Pfam Description: POT family
MQSGELLPGPGPSLGSKPADGRGGWRAARFFLAIGFLERLGFYGVQSNLIMYLTGPLGMSTASAAAGVNAWAGAVLVLPLAGALAADSRLGRYRAVLVAGGLYLLSLGSLTISSMLQAPQPHAAGGSPSSTMLAFFYVALYLLALAQAFHRPCVEALGADQFAPGDGSDPGAPASRSSYFNWFHFSQSWGYAIATAGLSYVEDNVGWTAGFGACWATMALYLAVFLLGTRAYRAEKPIGVRSFTESVRLWRARVFRRSDAKTDAERLLLAQEHEGGKELIAKLLPIWLTSLIIAVIFSQLYTLFTKQGSTLDRRLGGATSGLVVPPAALQCLMSATLVTTLPVYDRVLVPLARRVTGHHAGVTMLQRIGAGMAVSGVAMAVAALVEGRRLRVARDAGLVDRPDVALPMSLWWVAPQYVLLGVAAVLAQIGLEEFFYDQVPDTLRSVGLAMCLSIFGVGSYASSMLVSAVDWATRSKGESWFSDNLNRAHLDYFYWLLAGLAAVEVAAFLHFASRYVYRNEVQR

SEQ ID NO: 18136 - DNA, 1832 bp, Panicum virgatum
  misc_feature: Ceres CLONE 1795940
  misc_feature: Encodes the peptide sequence at SEQ ID NO. 18137
atgcatatccattagcaattattaattgctccgccccggacgccaactccatcgcctctcctcccctccaccacctaaaaacccaaaaacaattccagcaaccgcagcgacgagcggcgggcgacgacaaagtctccggcggaaaccctagcaggcccggcgcgcaatggcggaggacggcgagaaggccgcgccgcccgccgcggcgtcagcggcggcggccgcggacgtaggagaagcagcagggaagggaggcggcggcgaggaggggagcgtgaagctcttcgtggggcaggtgcccaagcacatgacggaggccgagctgctcgccttgttccgggaggtggccgccgtcgacgaggtcaccgtcatcaaggacaaggtcaccaaggtctcccgaggttgctgcttcctcatatgccccacaagggaagaagctgacaaggcagtgaatgcctaccacaacaagcgcacgctccctggggcatcaagtcctttgcaagtaaaatatgctgatggagagttgaagaggctggaacataagcttttcattggaatgcttccgaaaaatgttacggatactgagttgactgatctgttttccaaacatggaaatatcaaggatttataaattttgagaggttcacaacaaacaagcaaagctggctgcgccttcattaaatatgagacaaaagaacaagcattggcagccattgaggctctaaatgggaagcacaaaatagagggttctagtgtgccattggttgtcaaatgggctgatacagaaaaggaaagacaggctagaaaagcacaaaaagctcaactacagttatctaatatgcccaatgcaagtcctatgcagcaatcttcactatttggagctttacagatgggatatatgcctcaatataacggatttagttatcagccaccagggacctatggacttatgcagtaccctctgtcacctatgcaaaatcaaggtcccttccaaaacatggttcaacctgttaatcaagggaactcaataagaggagtcaaccctgaactgtcccccagttctgttcaaaggtcatttaatgcaatgcagttaggcagcccttatcctcctatccctggtatgcagtatcctggatcatatcctggtggtctcatgaacaatcgtccttttggaaattctcacaattcgattaaagttccaaattcaaatgccacttctgccatatctactagtcccagaagcaatactggtgggcagatcgaaggtcctcctggagccaatctatttatttatcatatcccacaagactatggtgaccaagaactttccagtgcgtttcagagttttggtagagtactaagtgctaaggtgtttgtagacaaagcaacgggtgtcagcaaatgctttggttttgtgagctacgattctccagcttctgcacagacagccatcagtatgatgaacgggtttcaattaggcggtaagaaactcaaagtacaactcaagagagaaaacaacaagcatagtaaaccctattgacaaaagcagcagttgttgtgaccatacgacacgatcaggttcccggtacatatttgtcagataattgatcgtttaccacattgtttccttcatctgctccctcccaaccagccagtcagcccttcagactcggggagcccccattgtatcgttctttgttcagttcacattcttgaaagatcgtcacgttgtgtaatgtaattcattgcagcatagtccgtagcatttgtaccgtcagatcacttgtacacaagactgccaattcattcaattgttaccttttccaactgac

SEQ ID NO: 18137 - protein, 154 aa, Panicum virgatum
  misc_feature: Ceres CLONE 1795940
  misc_feature (39)..(111): Pfam Name: RRM_1 Pfam Description: RNA recognition motif. (a.k.a. RRM, RBD, or RNP domain)
MAEDGEKAAPPAAASAAAAADVGEAAGKGGGGEEGSVKLFVGQVPKHMTEAELLALFREVAAVDEVTVIKDKVTKVSRGCCFLICPTREEADKAVNAYHNKRTLPGASSPLQVKYADGELKRLEHKLFIGMLPKNVTDTELTDLFSKHGNIKDL

SEQ ID NO: 18138 - DNA, 1655 bp, Panicum virgatum
  misc_feature: Ceres CLONE 1795943
  misc_feature: Encodes the peptide sequence at SEQ ID NO. 18139
actcctataaagcggccataaaccccaccgccgagccaaggaacgccgcccccgcccccgctccacccatccatcagctaggttgcatagcagctaggtcgggcgggcgggcatgcatgcacctccccccgctctactcccggtagaacagcgagcttggtgggcgcgcgtcacaaggcagccgaggtaaaagacagcaaccaaccgccgccgctgcgctggctctaacaaaccaccacagaacaagatcggccgcgaggccgccgagctgctgctgagctcacgcctcacgcggtgaggttggagtgaaggaagggagaggagagagatctggctgctgctgagtcccgagacctcacagtcgcggcccgccaccatgtacgccgacgccgggttcggcttcgccgccgcctactccccggccgccctcgcgtcctcgcagcaccagccggcctacgacctcgccttctcctccgcggccgcgcaccccgtcgtctccatggacgccgtggcctccctgccggagatgcccgccgcccacctggggaacatggtacagtcatccctggtgtcagaatatgaccttggaggagaaggggacctgttcaaagctccagaagtcatcatcgaagaaccgttgctcagcattgatcctgttgcagctgccatctcaatgatgtctggcagtgaaagcgcaatggatcaaactattaaggatgcaggcatcagcaccattcaaaatgaccctctcctaagtgaagtgttatacgagtgcgagaaggaactcatggagaagtctgcaatcgaagagacaatctctgaacttctggatgttaagattcccatgctgcaagttgaagaattcccaaggcaagctgaacaagttcttatacaggccgaactcccaaccatggagaatgagaagccagccattcccgaatgctcactccagaaaagtgttagttctggatgtctcaactcagcagattggatgaatggagctgtcaggccgaactttctagacttccaaggactggactttgaggcagcatttgggttgaggagagcttacagtgaaggagacattcagaaccttggagccaacacgcctcgaccagcagcgaacgcagcaaaccttcagacaccttgtgagaggcttgtaaccatcagtgacctgaagaccgaggaaaggaagcagaagctttccaggtatagaaagaagaagatcaagcgaaactttggcaggaagatcaagtatgcttgcaggaaggctctggcagacagccagccaagggtgcgagggaggtttgccaagatcgaagaatgcgacctgctgaagccgagcatgtaggcgatggcaaaagcttccatgaaatctagtcgagagcgagcttgatggagctttggcttctagaaacttctaggtctgccaccttctgcgccagaggtggagaggcaccgtgttgcccatcggaattcgtttagctgttcaattgatatcctctctctctctctcgggccgcattctattctatttcccctgtgtaataatatccgatcctttggtgcaagggaatgaagagctgaaaatggtagtctaggccctgtacaaaggcttgaagatggtaataaaactcagctcccctcttgctcgg

SEQ ID NO: 18139 - protein, 324 aa, Panicum virgatum
  misc_feature: Ceres CLONE 1795943
  misc_feature (272)..(316): Pfam Name: CCT Pfam Description: CCT motif
MYADAGFGFAAAYSPAALASSQHQPAYDLAFSSAAAHPVVSMDAVASLPEMPAAHLGNMVQSSLVSEYDLGGEGDLFKAPEVIIEEPLLSIDPVAAAISMMSGSESAMDQTIKDAGISTIQNDPLLSEVLYECEKELMEKSAIEETISELLDVKIPMLQVEEFPRQAEQVLIQAELPTMENEKPAIPECSLQKSVSSGCLNSADWMNGAVRPNFLDFQGLDFEAAFGLRRAYSEGDIQNLGANTPRPAANAANLQTPCERLVTISDLKTEERKQKLSRYRKKKIKRNFGRKIKYACRKALADSQPRVRGRFAKIEECDLLKPSM

SEQ ID NO: 18140 - DNA, 1911 bp, Panicum virgatum
  misc_feature: Ceres CLONE 1795956
  misc_feature: Encodes the peptide sequence at SEQ ID NO. 18141
gcccgtcacagtcgcattgctcgcaccgcatcgcttcgcttcgagttcgggtatcttcgcctcgcgtgcgctgagcatagtagcgggtctctccacttcgggttcgctcgctcggcccggtcgcttcgagaaggaaaagaaaaaaaaaaaagataagcaagcagcacggagacgactcgactcgagcggcgaggaggcggaaataaaaaagaggataaggcgaggcgcggccgggcggcctccgcgcgctcccagatccgtccttctcccgcgcagatccagctcgccggcgcgccctcgagcggacgtcgtaccctcgcgccggatcccggcatcggggttcctgcttcttcagatccagcgttaccagatctgtgtcccgctggcgcctgggcacatgacaccgacggtcctaatggagtttgggcagcagaggcccataaaacgggcctacgaggaaatgaccttccggggcggggcgccagctgcgcctcgggggtatgcagagacagttgcggagtcggaatgtgtagctggcagccctgttcgtgttgattccgaggactcttcagcgccgaagcgcaagtgcatcagcctgaacagcgatggctttgacgtgaagcgggagatctttgtgccgtccaagatgtcatcatctgagcggcggtatcttcggaagagattccgggcggagcttgattctgtgcgagatctcctcaagaagccagagtttgcagcccctgttcctgtgagtcgggcacctgcgttgtcatcctcagcagcccctcgaaccaagaaggtgcaccgtgggagcaatgttgcccgcggcgcaaagggacggttcttgcctactaaaccccggcctgaaccttctgcagagttatctgaagctgcagtgtttaagcagtgtgaagctattttgaagaagctcatgactcagaaatatagtcatatattcaatgttccagttgatgttgtgaagctgcaaattcctgattattttgacatcatcaagaccccaatggatcttggtactgtccagaagaagcttgaatctggctcatacacaagtccatcagattttgctgctgatgttaggctgacttttaacaatgcgatgacttacaatcctcgtggccatgctgtacatgacatggccatccagctgaacaagatgtttgagaataggtggaggccaattgagaagaagttggcttctatgtccgctgagaaacatgttgaggttgacagggctgactcgaagaggaggaagacccctcctgtggaccgcagtgatgtgtcagtggagggtgtacgtcaaacagagcctgtaaaacctaagatgacagctgctgagaaagaagcctttgggaactgcttggcttctatagctgatgacttaccttctcacatccttgaactgctgcaacagtgcatagacagtaatgccgatatggctggtgatggagagatagagattgatattcaagcagtcagtgatgacctgctattcaagcttaagaaacaagttgacaagtatttgcaggagcgagagcagagtcagcaggtggcgaaatctgagccttccgagaatgaaactgtgaatgtgtctggccttagccactcatctacaaatccttgcaaaggtagtgagcctatcgaggaggatgtggatatttgtggcaatgcctcccctatcatgttagacaaacatgcacaaatcaggagtagcaagtgcggtagtccaagtagttccagcagcgactctggatcatcttctagcggtctgtgtctcacggtgtttatttgcatttgtttttattattatagacatttctgtgtaaagaaaatgctgcttttgttcccaactctatgttgtaaattctttgaaaacattgttattatctctcc

SEQ ID NO: 18141 - protein, 504 aa, Panicum virgatum
  misc_feature: Ceres CLONE 1795956
  misc_feature (167)..(256): Pfam Name: Bromodomain Pfam Description: Bromodomain
  misc_feature: SWISSPROT Homolog: EC 2.3.1.48 Histone acetyltransferase
MTPTVLMEFGQQRPIKRAYEEMTFRGGAPAAPRGYAETVAESECVAGSPVRVDSEDSSAPKRKCISLNSDGFDVKREIFVPSKMSSSERRYLRKRFRAELDSVRDLLKKPEFAAPVPVSRAPALSSSAAPRTKKVHRGSNVARGAKGRFLPTKPRPEPSAELSEAAVFKQCEAILKKLMTQKYSHIFNVPVDVVKLQIPDYFDIIKTPMDLGTVQKKLESGSYTSPSDFAADVRLTFNNAMTYNPRGHAVHDMAIQLNKMFENRWRPIEKKLASMSAEKHVEVDRADSKRRKTPPVDRSDVSVEGVRQTEPVKPKMTAAEKEAFGNCLASIADDLPSHILELLQQCIDSNADMAGDGEIEIDIQAVSDDLLFKLKKQVDKYLQEREQSQQVAKSEPSENETVNVSGLSHSSTNPCKGSEPIEEDVDICGNASPIMLDKHAQIRSSKCGSPSSSSSDSGSSSSGLCLTVFICICFYYYRHFCVKKMLLLFPTLCCKFFENIVIIS

SEQ ID NO: 18142 - DNA, 1512 bp, Panicum virgatum
  misc_feature: Ceres CLONE 1795969
  misc_feature: Encodes the peptide sequence at SEQ ID NO. 18143
actcgtcggtctctcccccgccgcgcgcgtgtgctgctcttcttgcgccgagcgctgcttgcttggcgccgcgccggttgtcgatgagcatggggcgcttcgccaactcgacggatccgaggtcggggctggaggtgctcagggactggaacggggtcgcacaggtcgtgctgcgctcgcccaagggagcctccgcgcgggtgagcctgcacggcggccaggtagtctcctggaggaacgaccgcggcgaggatctcctcttcaccagcagtaaggcaatcttcaagccgccaaatgcgatgcgaggtggaattcagatgtgtttcccacagtttgggtattctgggacattggaaagacatggatttgcaagaaacaggatatgggccctggatgatgagcatcaaccaataaatcataatgataacgttagcaaagtttctgttgaccttatactaaagccatctgaagatgacctcaagtgctggccacattgttttgaattccgtctgagggtctctctttcaaaagatggggacctgtcattagtctcacgcatcaggaatgtcaatggcaagccattcagtttctcatttgcttatcacacatatctttctgtttctgacatcagtgagatgaggatagaaggtctggagacccttgattatcttgacaatcttagccacaaagaacggtttacagaacaaggagacgccataacatttgagtcagaggtcgatcgagtctatgttagctccccaaatgtagtagcagttcttgaccatgagaagaaacactcatttgtgataagaaaggaaggacttcctgacgttgttgtatggaatccgtgggaaaagaaatcaaagactatggtggactttggtgatgaggagtacaagcagatgctttgtgttgatgcggccgcggtggagagagcaatcaccctgaaaccaggggaggagtggacagggaagctggagctttctgcagtttcatccaccaattgcagcgatcatcttgatcatcccgtcagcatctagcgtgtaatgtggaagttcacatttcttagtgctatatgtatttgcctcataagagaagtaagaacctcctttgtacatcagggataagtaggtgcatctatgatcagtcagctgctcaaattgattctagaatcgaacaattctattgtaacctggtctctggaatctcaataatgatagtagcgctttgcttcaggcaaaaaaaaaacgccactcctccctctcctctcgtctcggcctcgggatcagcgggatcggagcagcagcaatggcgatggcgtcgtcgagcgggctccggagctgcagcgccgtgggcgtgcccagcctgctggcgccgtcgtcccgctccggccggctgccgttctgcgccagcgccaccacctccggccgcgtcaccatgtccgccgagtggatgcccggccagccccgccccgcccacctcgacggctcctcccccggggacttcgggatc

SEQ ID NO: 18143 - protein, 318 aa, Panicum virgatum
  misc_feature: Ceres CLONE 1795969
  misc_feature (26)..(301): Pfam Name: Aldose_epim Pfam Description: Aldose 1-epimerase
MSMGRFANSTDPRSGLEVLRDWNGVAQVVLRSPKGASARVSLHGGQVVSWRNDRGEDLLFTSSKAIFKPPNAMRGGIQMCFPQFGYSGTLERHGFARNRIWALDDEHQPINHNDNVSKVSVDLILKPSEDDLKCWPHCFEFRLRVSLSKDGDLSLVSRIRNVNGKPFSFSFAYHTYLSVSDISEMRIEGLETLDYLDNLSHKERFTEQGDAITFESEVDRVYVSSPNVVAVLDHEKKHSFVIRKEGLPDVVVWNPWEKKSKTMVDFGDEEYKQMLCVDAAAVERAITLKPGEEWTGKLELSAVSSTNCSDHLDHPVSI

SEQ ID NO: 18144 - DNA, 671 bp, Panicum virgatum
  misc_feature: Ceres CLONE 1795969-R
  misc_feature: Encodes the peptide sequence at SEQ ID NO. 18145
tgggtgaaagcgcaggagtgggcggccgtgcccggcggccaggccacgtacctgggcaacccggtgccgtggggcacgctgcccaccatcctggtgatcgagttcgtggccatcgccttcgccgagcaccagcgcaccatggagaaggaccccgagaagaagaagtaccccggcggcgccttcgacccgctcggcttctccaaggaccccgtcaagttcgaggagtacaagctcaaggagatcaagaacggccggctggcgatgttggcgttcgtggggttctgcgtgcagcagtcggcgtacccgggcacggggccgctggagaacctggccacccacctcgccgacccgtggcacaacaacatcggcgacatcatcatccccagaacgatctacccttgagctcagctgagacgacggcggcgaagaacgaagatgaggcgaggcgaggcaacgggcagacgggctgcgctgggagagtgtactggatagatcgatggtgttttctgtgtgtggattactgggcactgcctgcgtgcgtgcagcaactgtacaacgaccgacggcggcgacgactttccggccggccgggaaccacttgtccttgtgtaatgtaaagcttgttgatgtagcggctactcgatcttgtgaatccaccctacttttcctcc

SEQ ID NO: 18145 - protein, 133 aa, Panicum virgatum
  misc_feature: Ceres CLONE 1795969-R
  misc_feature (6)..(99): Pfam Name: Chloroa_b-bind Pfam Description: Chlorophyll A-B binding protein
WVKAQEWAAVPGGQATYLGNPVPWGTLPTILVIEFVAIAFAEHQRTMEKDPEKKKYPGGAFDPLGFSKDPVKFEEYKLKEIKNGRLAMLAFVGFCVQQSAYPGTGPLENLATHLADPWHNNIGDIIIPRTIYP

SEQ ID NO: 18146 - DNA, 1498 bp, Panicum virgatum
  misc_feature: Ceres CLONE 1795974
  misc_feature: Encodes the peptide sequence at SEQ ID NO. 18147
atcattcatcagcgcaatcgatcgatcacacggctgcgaatcgcgagagcgcttggcgaatacaatggcaatgcacgggataaggaagaaggcctcgccgtcgccgtcgccgtcgccggcggcggcggtggtcatggccctggtcctgtcgtcggcggtggcggcggtctgcggccagccgcagccggcggggaagcagacggcggcgaacaacccgcggctgcagcgggcgtacgtggcgctgcaggcgctgaagcgcgccatcacggaggaccccaagaacctgacgcgcgggtggtgcggccccgacgtgtgcgcctacttcggcgtgttctgcgcgccggcgccggatgacccgcacgcgctcaccgtcgccgggctggacctgaaccacggcgacctcgcgggcacgttcccggaggagctgggcctgctgtcggacctcgcgctgctgcacctcaactccaaccgcttcgccggcgggctgcctgagtcgctgcccaagctgcacctcctccacgagctggacgtcagcaacaaccgcctctccggcgggttcccgcagcacatcctctgcctgcccaacgtcaagtacgtcgacctccggttcaacaacctgtgcgggcccgtgccgccggccatcttcgacaagccgctcgacgcgctcttcctcaacgacaaccacttcgacttcgagctgccggagaacctcggcaactcgccggcgtcggtcgtcgtgctcgccaacctgcgcctgcgcggctgcatcccgcagagcgtcggccgcatggccggcacgctcaacgagttcgtcatcctcaacgccggcctccgctcctgcatcccgcaggaggtcggctggctccgagagctcaccgtgctcgacctcagcttcaaccagctccagggcatgcttccggagtccatggccggcatgcacaagctcgagcagctcgacgtcgcgcacaacgagctctggggccacatcccggagggcatctgcgcgctgcccagcctccgcaacttcacctactcgtacaactacttctgcacggagccgcagcgctgcctcgacatccgccgcatcgacgaccgccagaactgcatcgccggccgccccgaccagcgccccggcgaccagtgcctcgccttcctccaccgcccgccgccacgctgcgacgagcacggctgcttcggcccgccgcactactaggcggccagctcctcgatcgcgcgcgccgggtgggagggagagggagagagacagccggcgccgcccggccgcgccgccgcggccgcgacttgtaaaatccgttgcttggtggtgggatttgagtggagggtaaaattggtaaacagaaacgaccgtatatattatacactgaaatttttcctattcttcttttctctttctttttcacaggagtggtattgcagtatatgttgggactgtagagagacatgatagtgcattgattattacagtgttaatttaatc

SEQ ID NO: 18147 - protein, 382 aa, Panicum virgatum
  misc_feature: Ceres CLONE 1795974
  misc_feature: SWISSPROT Homolog: EC 2.7.11.1 Non-specific serine/threonine protein kinase
MAMHGIRKKASPSPSPSPAAAVVMALVLSSAVAAVCGQPQPAGKQTAANNPRLQRAYVALQALKRAITEDPKNLTRGWCGPDVCAYFGVFCAPAPDDPHALTVAGLDLNHGDLAGTFPEELGLLSDLALLHLNSNRFAGGLPESLPKLHLLHELDVSNNRLSGGFPQHILCLPNVKYVDLRFNNLCGPVPPAIFDKPLDALFLNDNHFDFELPENLGNSPASVVVLANLRLRGCIPQSVGRMAGTLNEFVILNAGLRSCIPQEVGWLRELTVLDLSFNQLQGMLPESMAGMHKLEQLDVAHNELWGHIPEGICALPSLRNFTYSYNYFCTEPQRCLDIRRIDDRQNCIAGRPDQRPGDQCLAFLHRPPPRCDEHGCFGPPHY

SEQ ID NO: 18148 - DNA, 1942 bp, Panicum virgatum
  misc_feature: Ceres CLONE 1795977
  misc_feature: Encodes the peptide sequence at SEQ ID NO. 18149
acacacgcatccggctccgccgcccgctccctgctgctcacgccaaaggcgacgagccgacgacgtcgtgttccgtcccgcgccgcccgacacgcttcgagttccgatcggctaggtagccagctcgcgcggtcgatcgctttcggtcgccatggaggctgcgccggcggcggtcatggagcgggagcgcctcacggccgagatggccttccgcgaccccgacgggggcgaaccggcgcccagcatcgtcatcaagatccgccgccggctcccggacttcgcgcggaacatcaagctcaagtacgtcaagctcgggatccgccacggcggcagccccacgtcggtgctgccgatgctctgcgtgcccgcgctcgccgccgccgcctactccttcgtccgcctcgacgtcatctactactccattgacctgctcacctgcgtcgcctggctcggcaccgcggcgctgctcctcaccgtgtactacttcaagcggccccgcccggtgtacctcgtcgagttcgcgtgctacaagcccgaggaccagcacaagatctccaaggcgggattcctcgagatgaccgagagcaccggctgcttcaatgaggcggccctggactttcagaccaagatcaccaaccgctccgcgctcggcgacgagacgtacctgcccccgggcgtccaggcgcggccgcccaggctcaacatggcggaggcgcggatggaggccgaggccgtcatgttcgggtgcctggacgcgctgttcaagtccaccgggatcgacccgcgccgcgacgtgcgcatcctgatcgtcaactgcagcctcttcaacccgacgccgtcgctggcgtccatgatcatcaaccactacaagatgagagaggatgtcaagtcgttcaacctcggcggcatgggctgcagcgccggcctgatcgccatcgacctcgccaaggacatgctccaggcgaaccccaactcgtacgccgtcgtcctcagcaccgagaacatcaccctcaactggtacttcggcaacgaccgctcgatgctcctctccaactgcatcttccgcatgggcggcgcggcggcgctgctgtccaacaagcgcgcggacgccgggcgcgccaagtaccggctgctccacacggtgcgcacccacaagggcgccaccgacgagtgcttcaactgcgtgtaccagcgcgaggacgaggccggcaaggtcggcgtctccctggcgcgggagctcatggcggtggccggcgacgcgctcaagaccaacatcaccacgctggggcccctggtcctgcccctgtcggagcagctcaagttcctcaagtccctgatgatgcgccgcgtatttcgcgtcaagggcgtgcgcccctacatccccgacttccggcgcgcgttcgagcacttctgcgtgcacgccggcgggcgcgcggtgctggaggaggtgcagcgcagcctgagcctgcgggacacggacatggagcccagcaagtgcgcccttcaccggttcggcaacaccagcagcagctcgctgtggtacgagctggcgtacgcggaggccaagggccgggtgcgccgcggccaccgcgtgtggcagatcggcttcgggtccgggttcaagtgcaacagcgccgtgtggcgcgcgctccgcgacgtgccggcgctgccgtcccccgccgccgccgccgccgaggaccggaggaactgctgcaacccctgggcggaggacgtggacaagtaccctcccaaggcgtacgtctagctgatggcccacgtcacgtggcttcatcgcacaacaattgtatgattcgattcgattttaattttcctcacacactcacgacgacagaacgaagaagaagggcgcgcgggggaaaagaacacagcatatatgtttttctttctcaaaatttctgtattttttttcgttctttcttcc

SEQ ID NO: 18149 - protein, 537 aa, Panicum virgatum
  misc_feature: Ceres CLONE 1795977
  misc_feature (110)..(400): Pfam Name: FAE1_CUT1_RppA Pfam Description: FAE1/Type III polyketide synthase-like protein
  misc_feature (413)..(499): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
MEAAPAAVMERERLTAEMAFRDPDGGEPAPSIVIKIRRRLPDFARNIKLKYVKLGIRHGGSPTSVLPMLCVPALAAAAYSFVRLDVIYYSIDLLTCVAWLGTAALLLTVYYFKRPRPVYLVEFACYKPEDQHKISKAGFLEMTESTGCFNEAALDFQTKITNRSALGDETYLPPGVQARPPRLNMAEARMEAEAVMFGCLDALFKSTGIDPRRDVRILIVNCSLFNPTPSLASMIINHYKMREDVKSFNLGGMGCSAGLIAIDLAKDMLQANPNSYAVVLSTENITLNWYFGNDRSMLLSNCIFRMGGAAALLSNKRADAGRAKYRLLHTVRTHKGATDECFNCVYQREDEAGKVGVSLARELMAVAGDALKTNITTLGPLVLPLSEQLKFLKSLMMRRVFRVKGVRPYIPDFRRAFEHFCVHAGGRAVLEEVQRSLSLRDTDMEPSKCALHRFGNTSSSSLWYELAYAEAKGRVRRGHRVWQIGFGSGFKCNSAVWRALRDVPALPSPAAAAAEDRRNCCNPWAEDVDKYPPKAYV

SEQ ID NO: 18150 - DNA, 1656 bp, Panicum virgatum
  misc_feature: Ceres CLONE 1795980
  misc_feature: Encodes the peptide sequence at SEQ ID NO. 18151
aactcattgatcacaagcagacgctaccgccccacactttcgtcttctttcctcagctgctgctccagtgccccacccactcgcggtcaaaatggcccccgccggcgccggcgcagccgtcctgaggcgggcccacatcgccggcgtccactcgttgaccggccgccggcaggcgggggcggaccgcgtctcgatgctccctcctgcgatcccgccgctgccgccgctcgtctcatggcgacagggcgtagagcagggatctggagtggttgctaggaggcgcctctgggcgaatgcgagtggttccttcgagcagaataacacttgggaggaatcagtattgccttcacaggtattggaggagagtaaaaaagatttcctcaagatcctgaagagtgccaacaccgttattccccatgtagtgctagggagcacaattctggctctggtgtacccaccttcttttacatggttcacaaccaggtattatgcaccagctttgggattcttgatgtttgctgttggtgtgaactcaagcatcgaggattttatcgaagcaataaaaaggccagatgccattgctgtcggttatatcggacagttcatcatcaagcctttgcttggattccttttcggcactcttgcagttacagttcttaatcttccaactgctctaggtgctggtatcatgttagtttcatgtgtgagcggagcacagctttcaaactatgcaactttcctaacagatccacatatggctcctctcagcattgttatgacatcattgtcaacagctactgcagtttttgtcaccccaacattatcttactttcttattggccagaaattacctgtagatgtcaaagggatgatgtccagcattgttcaaattgttgttgctccaattgcagctggattgctactgaatagattccttccaaagctctgtgcagctattcagccatttctccctccgttgtcagtatttgtcactgctttgtgtgttggctcaccattggctataaatattagagctgttttgtctccatttggattatccatcgtgctgctcctttttgcgttccatacctcatcttttgtagctggttatcaccttgctggtacttggtttcacaagtcagccgatgtgaaggcagtacaaagaacaatatcttttgagacaggaatgcaaagtagccttcttgctcttgctttagcaaacaagtttttcccagatccactagtgggtgtgcctccagccatatcggttgtgctgatgtccttaatgggctttgctctcgtgatggtatggtccaagaaaacaaaaacgtagcaagccacgaactgaatcaactcagccttgtaatcagacatcgccatagcccttgtcaaaaaatttagccaggctaacttgagccaggaagacactttgggcccctgttcatcggaggtcaggatcgctgccaaatgatcatcatgggctcacggcacaggattcagttcacctttttttttcttctcttttccatattcacatctgatattggttctgtcgaaccaaagatttcaagtgtcccgaactcttctaggattgcaaaaaactcatgtgaaagattctctgtaactcattttgggataggaggggatgcctcttcg

SEQ ID NO: 18151 - protein, 413 aa, Panicum virgatum
  misc_feature: Ceres CLONE 1795980
  misc_feature (134)..(319): Pfam Name: SBF Pfam Description: Sodium Bile acid symporter family
MAPAGAGAAVLRRAHIAGVHSLTGRRQAGADRVSMLPPAIPPLPPLVSWRQGVEQGSGVVARRRLWANASGSFEQNNTWEESVLPSQVLEESKKDFLKILKSANTVIPHVVLGSTILALVYPPSFTWFTTRYYAPALGFLMFAVGVNSSIEDFIEAIKRPDAIAVGYIGQFIIKPLLGFLFGTLAVTVLNLPTALGAGIMLVSCVSGAQLSNYATFLTDPHMAPLSIVMTSLSTATAVFVTPTLSYFLIGQKLPVDVKGMMSSIVQIVVAPIAAGLLLNRFLPKLCAAIQPFLPPLSVFVTALCVGSPLAINIRAVLSPFGLSIVLLLFAFHTSSFVAGYHLAGTWFHKSADVKAVQRTISFETGMQSSLLALALANKFFPDPLVGVPPAISVVLMSLMGFALVMVWSKKTKT

SEQ ID NO: 18152 - DNA, 2120 bp, Panicum virgatum
  misc_feature: Ceres CLONE 1795981
  misc_feature: Encodes the peptide sequence at SEQ ID NO. 18153
gcaaaacccctcccaagtaaatcccccgtctccatgctccgccgcatcgcggccctccggccgccgccaccgccgcgcgcggccgcttctgccggggcgggggcggccacctattcctccaagtccacctccatccctcagaagcagcagcgcgtccgcgaccacgccttcgacggcatcatggaggtccagaaacgcgtccgccgcttccacgcactccactccctcctcctctacgccgccgccccgaccgcggcctcccgcggcggcggaggcggcgccgtgtccgtccccttcacccgccttggcgccctcgcgcgccgccagctccgcctcgcgcccctcgacgccggccgcttcctcctgcgccacgcacacgccttccacctcttcctccaccccgtccaccgcatgctccacgcccgcctcaccccgcgcgccgccgcggcgctccgcgccgaggccgaagccgtcgccgccgccctcccttccgcctccgtcatccgcctccgcaagctcctcctcctcgcgcccccgcgccgccgcctccgcctcgagcacatccacctcctccgccgcgacctcggcctccccgatgatttcgccgaatccgttatccagtctaacccctccctcttccgcctcacccccgacggcttcgtcgagttcctgccctcccccacggacccgccggatctcaccgtcgccgcggtcgagcgcgcccgggagcgccactaccgcgagcaccgcgcacccggctcaggcgaggaggatgcgcgttttgcgttccccatccgcttcccgccagggttcaagatcggcaagtacttccggattgctgtctggaaatggcagcgcctcccctacgcgtcaccctacgcggacgtctcgggacatgacctgcgctcacttgaggctcaacgccgcatggagaagcgagcggtcgctgccgtccatgagctgctctcgctcactgtcgagaagcgcactacactggagcgccttgctttgttccgggaggcactcggtgtgcccaagaagatcaaggagttcttgctcaagtatcagggcatattttacatatccaccaggggaaatcaggggaagctgcatacagtgttcctcagggaggcgtattacaagggggagcttgttgagccaaatgagatacacgaggcaagaaggaagttggaggaactgctcatgatcagcccacagaaggcgaatttggaccggatgttcaccagcatgggtcgtggatgggatgagcttggtggtggtcgccgtggtggagctgaattgagggacgagtttcttgggaatggaggtggccagaaaaagcatgctgatactgatggtgctgatagtggggaggactcgagtgttgaatcactctacattgattgaggaatagaaacatatggtggcattgggcatcaacttggaagggaacagtcactgctcccatttggggaaaggttaacttcatgtattggtaacatcactcaacatctgattggaaatctccaaaaggagcagagtctacggtgaaaactgatggcaccttcaactggggggaagtgaaaactctatgtgctataatggttggatggctcctccccttgcactccgtgtgaagcatgtgaagacagatttcaagggcaggagaacacctttcagaactcagagcttatgcttctaagcttaattggttaagtgcttgtttatcatcaccattcagtcgatttgtgtgttcaaagcccattggaatagctgtttactgagcaagtctaacctgattgtgaggttcactagaagaaaggcccagctcttggctgctaatagttcatcagctacataatgtcttgggcaaatagcaataataatcttggtatggtttgtcagaatatgggtctcatttgatggaacttggttctgcttgtttgctctcaagctatgcccccctgaaaacctgtctgcctgctactacatttagatgcttgcggataatggtcaatttcccgtttgatttatttttgggagcagtagggttattgtcttgttcatctatcaggctcaaacttcgttttaataagcgaaactgcagaagattgaaatgc

SEQ ID NO: 18153 - protein, 457 aa, Panicum virgatum
  misc_feature: Ceres CLONE 1795981
  misc_feature (93)..(389): Pfam Name: Peptidase_C12 Pfam Description: Ubiquitin carboxyl-terminal hydrolase, family 1
MLRRIAALRPPPPPRAAASAGAGAATYSSKSTSIPQKQQRVRDHAFDGIMEVQKRVRRFHALHSLLLYAAAPTAASRGGGGGAVSVPFTRLGALARRQLRLAPLDAGRFLLRHAHAFHLFLHPVHRMLHARLTPRAAAALRAEAEAVAAALPSASVIRLRKLLLLAPPRRRLRLEHIHLLRRDLGLPDDFAESVIQSNPSLFRLTPDGFVEFLPSPTDPPDLTVAAVERARERHYREHRAPGSGEEDARFAFPIRFPPGFKIGKYFRIAVWKWQRLPYASPYADVSGHDLRSLEAQRRMEKRAVAAVHELLSLTVEKRTTLERLALFREALGVPKKIKEFLLKYQGIFYISTRGNQGKLHTVFLREAYYKGELVEPNEIHEARRKLEELLMISPQKANLDRMFTSMGRGWDELGGGRRGGAELRDEFLGNGGGQKKHADTDGADSGEDSSVESLYID

SEQ ID NO: 18154 - DNA, 1550 bp, Panicum virgatum
  misc_feature: Ceres CLONE 1795990
  misc_feature: Encodes the peptide sequence at SEQ ID NO. 18155
acttctcccacaagctctgcgagcttggtgctatcctggaactgcgtgccaaagctccggcaccaatcttggattctgcttcaaggacggtgcttcttgtagcaagaagcccaaacatttgatccaggcagctgctcggatccttgcgagaaccaggcggccggccatggtgtcccgctcctacaccaacctcctcgacctggccaccggcgcggcggaccaggcgccggcggcggccgcgctgggcgcgctccggcggcggctcccgcgcgtggtcaccaactcggggctcatcgacgacaccccggcgtcgccgtccgtcccgccgcggccgcgcaccatcgtggtggccaaccagctccccatccggtcccaccgcccggggtcgccggaggagccctggaccttcgactgggacgaggacgccctcctccgccacctccaccacacgtcgcccccctcgatggagttcatctacatcggctgcctccgcgacgacatcccgcaggccgaccaggacgccgtggcgcaggcgctcctcgacacccacaactgcgtgccggccttcctgccgcccgacatcgccgagcgctactaccacggcttctgcaagcagcacctgtggccgctcttccactacatgctgccgctgtcccccgacctcggcggccgcttcgaccgcacgctgtggcaggcctacgtctccgccaacaagatcttcgcggacaaggtgctggaggtgatcaacccggacgacgacttcgtgtgggtgcacgactaccacctcatggtgctccccaccttcctccgcaagcgcttcaaccgcatcaagctcggcttcttcctgcactcgccgttcccctcgtcggagatctacaagacgctgcccgtgcgcgaggagctgctgcgcgccctgctcaactccgacctcatcggcttccacaccttcgactacgcgcgccacttcctctcctgctgcagccgcatgctcggcctctcgtacgagtccaagagggggcacatctgcctcgagtactacggccggacggtgagcatcaagatcctgccggtgggggtgcacatggagctgatggagatgtacatggggaagggcagggtggtcatgctgggcgtcgacgacatggacatcttcaaggggatcagcctcaagctgctcgccatggaggagctgctgcggcagcaccccgagtggcgggggaagctggtgctggtgcaggtcgccaacccggcgcgagggcggggcaaggacgtcgccgaggtgcaggccgagacgtacgccatggtgcggcgcatcaacgagctgtatggcgagcccgggtacgagcccgtggttctgatcgatgagccactgcagttctacgagcgcgtcgcgtactacgtcatcgccgaggtgtgcctggtgaccgcggtccgggacggcatgaacttgatcttctatgagtacatcgtctcccggcaaggcaacgagacgctggacaggatgcagctgcggcaggggaaagcagaggggaagaagagtatgctggtgg

SEQ ID NO: 18155 - protein, 461 aa, Panicum virgatum
  misc_feature: Ceres CLONE 1795990
  misc_feature (56)..(459): Pfam Name: Glyco_transf_20 Pfam Description: Glycosyltransferase family 20
  misc_feature: SWISSPROT Homolog: EC 2.4.1.15 Alpha,alpha-trehalose-phosphate synthase (UDP-forming)
  misc_feature: Functional homolog of the protein sequence given in SEQ ID NO 50800
  misc_feature: Useful for making plants with altered carbohydrate content
MVSRSYTNLLDLATGAADQAPAAAALGALRRRLPRVVTNSGLIDDTPASPSVPPRPRTIVVANQLPIRSHRPGSPEEPWTFDWDEDALLRHLHHTSPPSMEFIYIGCLRDDIPQADQDAVAQALLDTHNCVPAFLPPDIAERYYHGFCKQHLWPLFHYMLPLSPDLGGRFDRTLWQAYVSANKIFADKVLEVINPDDDFVWVHDYHLMVLPTFLRKRFNRIKLGFFLHSPFPSSEIYKTLPVREELLRALLNSDLIGFHTFDYARHFLSCCSRMLGLSYESKRGHICLEYYGRTVSIKILPVGVHMELMEMYMGKGRVVMLGVDDMDIFKGISLKLLAMEELLRQHPEWRGKLVLVQVANPARGRGKDVAEVQAETYAMVRRINELYGEPGYEPVVLIDEPLQFYERVAYYVIAEVCLVTAVRDGMNLIFYEYIVSRQGNETLDRMQLRQGKAEGKKSMLV

SEQ ID NO: 18156 - DNA, 517 bp, Panicum virgatum
  misc_feature: Ceres CLONE 1795990-R
  misc_feature: Encodes the peptide sequence at SEQ ID NO. 18157
aaccccgtgtccgtgaagaccacccctcactctgtcgaagtgaaaccgcaggacgtgagcaagggcctggtagcgcggcgcatgctggcgtcgatgcaggagcgcggccagtgcccggacttcgtgctgtgcatcggcgacgacaaatccgatgaggacatgttccagctgctcgccacggccccctgcggggcgtcgctggcgtccaaggcggaggtgttcgcgtgcaccgtcggccgcaagcccagcaaggccaagtactacctggacgacgcggcggaggtggtgaggctgatgctggggctctcctacgtctccgaggagctggccctggccaaccaccgggatgaagacgacgactcttctctggacgtgtgggagtagcagactagttgtaacgatcaattgggattccttgcgttggcccacttggaggctggagctttcgccgagcagttagatgtgtaaatgaggtatggttttcagtataatgcactgtcagtgagtgagtctcacg

SEQ ID NO: 18157 - protein, 127 aa, Panicum virgatum
  misc_feature: Ceres CLONE 1795990-R
  misc_feature: SWISSPROT Homolog: EC 3.1.3.12 Trehalose-phosphatase
  misc_feature: Functional homolog of the protein sequence given in SEQ ID NO 50801
  misc_feature: Useful for making plants with altered carbohydrate content
NPVSVKTTPHSVEVKPQDVSKGLVARRMLASMQERGQCPDFVLCIGDDKSDEDMFQLLATAPCGASLASKAEVFACTVGRKPSKAKYYLDDAAEVVRLMLGLSYVSEELALANHRDEDDDSSLDVWE

SEQ ID NO: 18158 - DNA, 1169 bp, Panicum virgatum
  misc_feature: Ceres CLONE 1795998
  misc_feature: Encodes the peptide sequence at SEQ ID NO. 18159
gcagagcaccgccgccagccatcagccacaaactccgccgcgccacgggaaggacctgaagacttgcttgtccgtcaccaggccaggccatggcgctcgcgtccacctccgccgccgcccccgcggccgtgctcaagaccccgttcctcggggcccggcgcgcgctcgccaatgccgcctccgtcgccgccaggcccgcgccgcgccgcgcgctcgtcgtcgccgcggccgccgccaagaagtcgtggatccccgccttcaagagcgacgccgagttcatcaacccgccgtggctcgatggctcgctccccggcgacttcgggttcgacccgctgggcctgggcaaggacccggcgttcctcaagtggtaccgcgaggcggagctgatccacgggcggtgggcgatggccgccgtgctgggcatcttcgtcgggcaggcgtggagcggcatcccgtggttcgaggccggcgccgacccgggcgccatcgcgcccttctccttcggctcgctcctgggcacgcagctgctgctgatggggtgggtggagtcgaagcggtgggtggacttcttcaacccggactcgcaggccgtcgagtgggccaccccctggtcgcgcaccgccgagaacttcgccaacttcaccggcgagcagggctaccccggcggcaagttcttcgacccgctcagcctcgccggcaccatcaaggacggcgtctacatccccgacaccgacaagctcgagcggctcaagctcgccgagatcaagcacgcccgcctcgccatgctcgccatgctcatcttctacttcgaggccggccagggcaagacgccgctcggcgcgctcggcctataatctgccgccgacggtgccgcgtgtacttgtacgcatcgatagattcgaccacgattgcgcgcgtggtgactggtgagggacgttaaggctgcgcatcagatcggtcaggcgcaagcgtcaatggacattgcattggatcggttggattattggaggtgaaagaagagcgcgtagcagcaaatgtatctctgttcgtggcttcttttgggtggtgtgcgtcaatcgaatggggagtttttttttttcaatttcgtatgtaccatgtaatgtatagtctgcatcgatctctgtaataaggcaggataaagtgaggac

SEQ ID NO: 18159 - protein, 254 aa, Panicum virgatum
  misc_feature: Ceres CLONE 1795998
  misc_feature (64)..(243): Pfam Name: Chloroa_b-bind Pfam Description: Chlorophyll A-B binding protein
MALASTSAAAPAAVLKTPFLGARRALANAASVAARPAPRRALVVAAAAAKKSWIPAFKSDAEFINPPWLDGSLPGDFGFDPLGLGKDPAFLKWYREAELIHGRWAMAAVLGIFVGQAWSGIPWFEAGADPGAIAPFSFGSLLGTQLLLMGWVESKRWVDFFNPDSQAVEWATPWSRTAENFANFTGEQGYPGGKFFDPLSLAGTIKDGVYIPDTDKLERLKLAEIKHARLAMLAMLIFYFEAGQGKTPLGALGL

SEQ ID NO: 18160 - DNA, 3500 bp, Panicum virgatum
  misc_feature: Ceres CLONE 1796005
  misc_feature: Encodes the peptide sequence at SEQ ID NO. 18161
attcctgccttcccaccaaactcccccaacccaattccccagtctcccgctggattcgcccagttcgttaactctggagctcgattcgacaccgaagctgcggcctgggccgccaattttctcggtttggtgtcttgctgattcgcgtcagtattttttcactggaatatttcggtgattcgcgccgtatgagctcggattggcggtggtgtttctgattcttgcttgccggagctggaggcgcaagggtatgtgggtttctctggtgtggatccggggctgcgtgggcgtcacgttcgtcgatttccagagcgggagaggagccgactagatctctcggctcctgaggttgctgctctccttcaaagagtccgagcggctagctgcgatcggaggttcatctagggttttggcaggtgagaggacatggaggccgccaggctcggcgcgcagagcagccacttgtacggcagcaggccgggtgagcttgacctgaacaggcgtgagaacagggtgtttggctgggacctcaacgactggaactgggacagtgagcgctttgttgccatgtcggtgccaactgctgtggcgaatggctcaggtttgaacagctcgccatcatcgtcagaggaagccgaggcagaggtggctaggaatggtggccatagaggcgacgctgataagaggaaaagggtggtggtaattgatgacgatgatagggaggatcaggacatgattgtgaacggtggcgggtcgctcagcttgagaattgggggtagtgctgttggtgtcggagcgatggagagcagtgatctaaacgaggatgagagaaatggaaagaagatccgggtgcaaaggggcagctcaaatcggccggcatgccaggttcagggctgtggggctgatctgactgcagctaaagactaccaccgccggcacaaggtctgcgagatgcatgctaaggctagcaccgctgttgttggaaacaccgtccagaggttctgccagcaatgtagtagatttcaccttcttcaagaatttgatgaaggtaagcgaagttgccggcggcgtttagcaggccacaatagacggaggaggaaaacccgccctgatagcgcaattggtgggactgcttcaattgaagacaaagtcagcaattatctattgttaagtcttattgggatttgtgctaatctgaactctgatagtgttcagcattcaaacagccaggagctgctatctactcttttaaagaacctagggtctgttgccaaatcactggagccaaaagaactctgtaaactcctggaggcatatcaaagcctgcaaaatggatcaaatgctggaacctctggaacagctaatgctgcagaagaggctgcagggccatctaactctaagttgcctttcgcgaatggtagtcatcgtggacaagcatcatcatctgttgtgccagtacaatcgaaggctaccgtggtggtaactccagagcctgcatcatgcaagctcaaggattttgatctgaatgacacttgcaacgatatggaaggctttgaggatgggcaagaaggttcacctacacctgcttttaaggcagctgattctccgaattgtgcatcatggatgcagcaagattctactcaaagtccaccacaaactagtggcaattcagattcaacatcaacacaatcattgtcaagctcaaatggagatgctcagtgccggactgataagattgtcttcaagcttttcaacaaagttcccagtgatttacctccagttttgcggtcacagattcttggttggttgtcaagtagtcctaccgatatagagagctatattagacctggctgtataattctaacagtatatcttcggctagttgagtctgcatggagagagctttctgataatatgagcctgcacctggacaagcttttgaatagctccactgacgacttttgggcatccggcttggtgtttgtgatggttcgacgacagttagcttttatgcacaatggtcaaattttgttggacagaccactggcacccagttctcaccaatactgcaagattttacgtgtcagaccagttgctgcaccttattctgcaacaataaatttcagagtagaaggttttaacctactcagtacttcctcaagggtaatttgttcatacgaaggacattgtatattccaggaagacacagatactgtagtggatgatgctgaggacatcgaatgcctcagtttttgttgttccatccctggtacaaggggaagaggatttacagaggtcgaagatagtggatttagcaatggcttcttcccctttataattgctgagaaggatgtatgctctgaggtttctgagctggagagcatatttgagttctccagtaacgaacatgcagttgttgatgataatgccagggaccaagccttggagtttctaaatgagttgggttggcttcttcatagagcgaacagaatgtctagacaggatgaaacggatacacctctagcttcttttaacatgtggagattcaggaaacttggtatatttgccatggagcgggagtggtgtgctgtggtcgaaatgctgttagattccttatttattggccttgttgatgtgggatcccaatctccagaagagatggtgctttcagaaaatttgttgcacgctgctgtccgaaggaagtctgttaaaatggttaggtttctgctgagatacaaaccgaataaaaactccaagggaactgcacagacatacctattcagacctgatgctctgggcccgttaacaattaccccccttcatatagcagctgccactagtgatgctgaggatgtgttggatgcgctgacagatgatcctggactggttggaattagtgcgtggagtaatgcacgggatgaaacaggctttaccccagaagactatgctcggcagagaggcaatgatgcttacctgaatcttgtccacaagaagattgataagcatcttggcaaaggccatgttgtcctcggtgttccaagcagtatgtgctctgtgatacctgatggtgctaagcctggtgatgttagccttgagatctgcaggccaatgtctgcatcagtgccacgttgcctcctctgcacccaacaagcgcggcgggtgtatccaaattctggggcaaggaccttcctttaccggccagcaatgctgacggtgatgggagtggccgtggtttgtgtctgtgtgggcatacttcttcacacctttcccagggtttatgctgcgcccacattcagatgggagctgttggagcgtggaccgatgtaagaagttttaggatgaaataagcctagctgctgtttgtaagttgagagctttagtgtggtggctaagatcaaaggaacataactaccatgtgaagaagttcctttgtatgtatagcagtatcctgttgctgctgtaagcttacacatcgtcaatatcaactatatttacaacct

SEQ ID NO: 18161 - protein, 966 aa, Panicum virgatum
  misc_feature: Ceres CLONE 1796005
  misc_feature (151)..(229): Pfam Name: SBP Pfam Description: SBP domain
  misc_feature: Functional homolog of the protein sequence given in SEQ ID NO 50802
  misc_feature: Useful for making plants with altered lignin content
  misc_feature: The sequence is a functional homolog of SEQ ID NO 1120 in the 10/225,066 US patent application
  misc_feature: The sequence is a functional homolog of SEQ ID NO 1912 in the 10/412,699 US patent application
  misc_feature: The sequence is a functional homolog of SEQ ID NO 432 in the 10/374,780 US patent application
  misc_feature: The sequence is a functional homolog of SEQ ID NO 958 in the 10/412,699 US patent application
  misc_feature: Functional homolog of the protein sequence given in SEQ ID NO 50782
  misc_feature: Useful for making plants with altered terpenoid content
  misc_feature: Useful for making plants with modulated flowering time
MEAARLGAQSSHLYGSRPGELDLNRRENRVFGWDLNDWNWDSERFVAMSVPTAVANGSGLNSSPSSSEEAEAEVARNGGHRGDADKRKRVVVIDDDDREDQDMIVNGGGSLSLRIGGSAVGVGAMESSDLNEDERNGKKIRVQRGSSNRPACQVQGCGADLTAAKDYHRRHKVCEMHAKASTAVVGNTVQRFCQQCSRFHLLQEFDEGKRSCRRRLAGHNRRRRKTRPDSAIGGTASIEDKVSNYLLLSLIGICANLNSDSVQHSNSQELLSTLLKNLGSVAKSLEPKELCKLLEAYQSLQNGSNAGTSGTANAAEEAAGPSNSKLPFANGSHRGQASSSVVPVQSKATVVVTPEPASCKLKDFDLNDTCNDMEGFEDGQEGSPTPAFKAADSPNCASWMQQDSTQSPPQTSGNSDSTSTQSLSSSNGDAQCRTDKIVFKLFNKVPSDLPPVLRSQILGWLSSSPTDIESYIRPGCIILTVYLRLVESAWRELSDNMSLHLDKLLNSSTDDFWASGLVFVMVRRQLAFMHNGQILLDRPLAPSSHQYCKILRVRPVAAPYSATINFRVEGFNLLSTSSRVICSYEGHCIFQEDTDTVVDDAEDIECLSFCCSIPGTRGRGFTEVEDSGFSNGFFPFIIAEKDVCSEVSELESIFEFSSNEHAVVDDNARDQALEFLNELGWLLHRANRMSRQDETDTPLASFNMWRFRKLGIFAMEREWCAVVEMLLDSLFIGLVDVGSQSPEEMVLSENLLHAAVRRKSVKMVRFLLRYKPNKNSKGTAQTYLFRPDALGPLTITPLHIAAATSDAEDVLDALTDDPGLVGISAWSNARDETGFTPEDYARQRGNDAYLNLVHKKIDKHLGKGHVVLGVPSSMCSVIPDGAKPGDVSLEICRPMSASVPRCLLCTQQARRVYPNSGARTFLYRPAMLTVMGVAVVCVCVGILLHTFPRVYAAPTFRWELLERGPM

SEQ ID NO: 18162 - DNA, 2303 bp, Panicum virgatum
  misc_feature: Ceres CLONE 1796022
  misc_feature: Encodes the peptide sequence at SEQ ID NO. 18163
ctgcagccgcagctgctccccgcatggtgtgaattgtgatcagctcgcccccgtggggaaaaagaaaaagagagggaaggcgcgacgccgccaggtacccatgctcccgccgcgcgccgccgccgtgccggtggcgccgctgcttctgctgatcctggccctggcggccggcgcggcccgggccgccgacgacctggcctcggacgccgcggcgctgaaggccttcctggccccgttcgggtccgcgaccgtgacgtgggacgcgtcccggccggcctgctcctggacgggcgtcgtctgcacgggcggccgcgtcacggagatccacctgcccggggacgggctccggggcgcgctccccgtcggcgcgctcggcgggctcacgaagctcgccgtgctgtcgctgcggtacaacgcgctctccggcccgctgccgccggacatcgcctcctgcgtcgagctccgggtgatcaacctgcagtccaacctcctctccggcgagctcccggcggcggtgctggcgctcccggcgctcacgcagctcaacctcgccgggaaccgcttctcggggcggataccgccgagcattgccaagaacggccggctgcagctgctctacctcgacggtaaccgcctcaccggggagctgccggacgtcaacatgctgtcgctcaccgtgttaaacgtctccttcaacaacctcaccggcgaggtaccgaagagcctcagcggcatgccggcgacgtctttcctcggcatgccgttgtgcggcaagccccttccgccctgccgggcgccaagttcgtcggagccaccgtcgctgccccccgcgctcgcgcccgaagcaccggcctcttcagacagccgcggacggggtagacaccgcctcgccggcggcgccatcgctggcattgtgattggctgcgcgttcggcttcctgctcatcgccgccgctctcgtcctcgtgtgtggcgcgctgcggcgcgagccaagagcaacctaccgcagccacgacgccgttgcggcggagctggcgctgcacagtaaagaagcaatgagccccaacggctacaccccaccggtctccgacgcgcggccgccgccttcggtgccgcctgccgtgcccgccgcatcggtggggaagaagaagctttttttcttcgggaggatccctcgcccctacgacctcgaggacctgctgcgcgcgtctgccgaggttcttggcaagggtacatacggaaccacgtacaaggccgcgatcgagtccgggccggtcatggcggtcaagcgcctcaaggagacctcgctgccggagcgcgagttccgggacaaggtcgcggcgatcggcgggatcgaccatcccaacgtcgtgcccctgcaggcctactatttcagcaaggacgagaagctcatggtctacgagttcgtcgccatgggcagcctctcctcgatgcttcacgggaaccgtggctccggccggtcgccgctgaactgggagtcgaggaggcgcatcgcgctggcctcggcgcgcggcctcgagtacatccacgccacgggctccatggtcacgcacggcaacatcaggtcctccaacatcctcctcagccggtcggtggacgcgcgcgtggccgaccacggcatggcgcacctcgtcggccccgcgggcgcgccggcgacccgcgtcgcggggtaccgcgcgcccgaggtcgtggcggacccgcggcgggtgtcgcagaaggccgacgtgtacagcttcggcgtgctgctgctggagctgctgacggggaaggcgccgacgcacgccgtgctgcacgacgagggcgtggacctcccgcggtgggcgcgctccgtggtgaaggaggagtggacgtccgaggtgttcgacacggagctgctccggcacccgggcgccgaggaggagatggtggagatgctgcggctggccatggactgcaccgtgcccgccccggaccagcggccggcgatgcccgagatcgtggcgcgcatccaggagaccggcgccacggggtcggcgtcgacggcgcggtccggccggagcgcgtccatggacgaggccgacgaccggccgctgaggcccaccggatcgatccgccagagctgaggtccgtccatccggttactcgtgttcttttcaggctgcagcgtagcgatcatttggtaaactcatggaatgttctgaagggaaaaaaaaggagatctttttgttctgtcttcttgcgcttgtcgtagagcgttgcccgtgtgctgtttattctttgatgaagtttcatgaatctcttgat

SEQ ID NO: 18163 - protein, 673 aa, Panicum virgatum
  misc_feature: Ceres CLONE 1796022
  misc_feature (367)..(636): Pfam Name: Pkinase_Tyr Pfam Description: Protein tyrosine kinase
  misc_feature (32)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MLPPRAAAVPVAPLLLLILALAAGAARAADDLASDAAALKAFLAPFGSATVTWDASRPACSWTGVVCTGGRVTEIHLPGDGLRGALPVGALGGLTKLAVLSLRYNALSGPLPPDIASCVELRVINLQSNLLSGELPAAVLALPALTQLNLAGNRFSGRIPPSIAKNGRLQLLYLDGNRLTGELPDVNMLSLTVLNVSFNNLTGEVPKSLSGMPATSFLGMPLCGKPLPPCRAPSSSEPPSLPPALAPEAPASSDSRGRGRHRLAGGAIAGIVIGCAFGFLLIAAALVLVCGALRREPRATYRSHDAVAAELALHSKEAMSPNGYTPPVSDARPPPSVPPAVPAASVGKKKLFFFGRIPRPYDLEDLLRASAEVLGKGTYGTTYKAAIESGPVMAVKRLKETSLPEREFRDKVAAIGGIDHPNVVPLQAYYFSKDEKLMVYEFVAMGSLSSMLHGNRGSGRSPLNWESRRRIALASARGLEYIHATGSMVTHGNIRSSNILLSRSVDARVADHGMAHLVGPAGAPATRVAGYRAPEVVADPRRVSQKADVYSFGVLLLELLTGKAPTHAVLHDEGVDLPRWARSVVKEEWTSEVFDTELLRHPGAEEEMVEMLRLAMDCTVPAPDQRPAMPEIVARIQETGATGSASTARSGRSASMDEADDRPLRPTGSIRQS

SEQ ID NO: 18164 - DNA, 3222 bp, Panicum virgatum
  misc_feature: Ceres CLONE 1796030
  misc_feature: Encodes the peptide sequence at SEQ ID NO. 18165
aggatcccggtcacgcgcgcaggcaggcagcaagcgctgtgctctgctcgtaaaccagggaaacccgcgacccccgaccaatagcgagccgagatccagccgcagtgacgtagattcgattcgattaacccgagccggggcgcaaatccgatctcgccgcagcccatctcccacctttcctcgtcgcattcgtcgtccggatccccaattctccgatcccaggcgcgctccccaaggccaaggtcccctccctcgccaccccctccagatccgcgcgccgccaccgatccccggcggcgcggccgcggcgttcggcatggaggagacgccgccggggcagcggccgcagccgcagccggcgcacgcgtctcctcccttccccgcggcgcccttcaccccgccgccgcgcgtcttctcgctcgccctcgccgcgcggggcacccccagcccaggctccgggcctggccacgcgccggcgcacctcagcacgccccccggcccgcccgtcttctcctcgccgctgcgtcccgcggccgtgcccttccgcgccacgccggcctcgccacaccccgtgcccttcgccgccgcggggggcggctactcctcgtcctcctccgcctccgcctccctccccacctcgtcggcgccgcacttcctcaacggcgccgccacgccgcacggggacctcgcccccgcaccgtcgccgctccagggcgacggcctggacaacccctacgtccagttctccgcgaacaaggtgctgaagcagaagaagctgctcaatgcccctagcttggggttcggagctctggtttctccggggaaggaggtggcgcctgggccagaggttgtggagcgtgacccccggcgatgcttgaactgtggagcctatgtcaacttatactgtgatgtcttgatcgcctctgggcaatggcagtgcatcatttgcaagaagctcaacggcagtgaaggggagttcgttgtctccagcaagcaggacctgctccattggccggagctagcatcaacgactgtggattacgttcagatggggaacaggcggccaggctttgtccctgtgtctgactcaagggtgtccggccccatttttatcctcatagatgagtgcctcgacgaggcacacctgcagcatcttcagggctccttgcatgcttttgtggattcgctccttcctacagcaaagataggaataatcacctatggccgaaccgtctcggtgtatgatttctcggagggggcagcggtgtcagcggatgtcctacctggaaataagtcgcctacacatgagtctttgaaggggctaatctatgggacaggtgtttacctgtctcctatacatgcttcactgcctgttgcgcacacaatattctcatccctgagaccctatcaactgaatgtgccagaagtgtcaagggaccggtgccttggcgcagccgtagaggtctcccttggtattattcaaggtccatcagtggagttgtctcgtggaattatcaagagatccggaggcaactgcaggatcttggtgtgtgctggtggcccttgcacctttggaccaggatctgtgcctcattcagttaaacatccaaactatgcttacctggagaagacagctatgaagtcaatggagagtctggggcatgaagcacagagacacagtactgtcattgatatcttttgtgccggacagtgtcctgtaagagttcctgttctgcaaccattagcaaagtgttctggaggtgtgcttttacttcatgatgactttggagaggcctttggggtcaacttgcaaagggcatcaactagagcagctggttcccatggcttatttgagatcaggtgttcagataacatgcttgttacccaagttattggcccgggtgaagaggcgtctcctgattctcacgaaacattcaagcatgatagttcattttgtatccagattcatagtgttgaggagacacaaagtttttctgtgtctatggagacaaagggtgacatcaagagtgattttgttttctttcagtttgcagtccattattccaatatgtatcaagcagaaatcactcgggtgatcactatgaaactgcagactgttgatggtttgtctgtgtatctggcaagtgtacaggaggatgttgcgtcagttatcatcggtaaaagaactgttttgcgtgccagaactgcctctgatgctattgatatgaggctctcgattgatgaaagggtaaaggacatagctttcaaatttggtaatcaggccccaaaatcaaaactttatcgcttcccaaaagaactagcatcactcccagagtgcttatttcatctgaaaagggggccacttttaggtagcataatcggacatgaagatgaaagatccgtacttagaaatctattcttgaatgcttcatttgacctttcactccgtatgctggcacctcagtgcataatgcatcgtgaaggtggtacatttgaggagttgccagcatatgatcttgtcatgcaatctaatgctgcagtgatactggaccatggaaccgatattttcatttggttgggtgctcagctagcagcccaagaaggacaaagtgcagcagctttagctgcatgccgtacactggcagaagagctcagcgagcatcgctttccagctcccaggatactttcattcaaacaaggaagctcccaggctagatattttgtgtcacgcctgatcccagctcacaaggatcctacttatgagcaggagtcaaggtttccgcaactacggacacttacccctgaagaaagggctaggttaaagagcagctttatccacttcgacgaccatagtttctgtgagtggatgcgcagcctcaaattggtcccgccagagccaagctaacacaaatactggagcagtacacttggaaatggcttctgacagagttgcccaaacaacagctgagatctttgtgagctaaattgtggcgtagtgagacatgcctgagccgatcacatatttggtttggtgaagctccatttagggtgcggtggaaattgtatgattttgcctgattctttccccccctttttgaccctgacgtgttagcgtaagttcatatatggtcccttgtcatacaggctgagaaatttacacaatatgagcgtctcagatgttacatgtatacaaccttttgccggatggtgtcattattcttt

SEQ ID NO: 18165 - protein, 862 aa, Panicum virgatum
  misc_feature: Ceres CLONE 1796030
  misc_feature (613)..(713): Pfam Name: Sec23_helical Pfam Description: Sec23/Sec24 helical domain
  misc_feature (507)..(601): Pfam Name: Sec23_BS Pfam Description: Sec23/Sec24 beta-sandwich domain
  misc_feature (182)..(221): Pfam Name: zf-Sec23_Sec24 Pfam Description: Sec23/Sec24 zinc finger
  misc_feature (260)..(502): Pfam Name: Sec23_trunk Pfam Description: Sec23/Sec24 trunk domain
MEETPPGQRPQPQPAHASPPFPAAPFTPPPRVFSLALAARGTPSPGSGPGHAPAHLSTPPGPPVFSSPLRPAAVPFRATPASPHPVPFAAAGGGYSSSSSASASLPTSSAPHFLNGAATPHGDLAPAPSPLQGDGLDNPYVQFSANKVLKQKKLLNAPSLGFGALVSPGKEVAPGPEVVERDPRRCLNCGAYVNLYCDVLIASGQWQCIICKKLNGSEGEFVVSSKQDLLHWPELASTTVDYVQMGNRRPGFVPVSDSRVSGPIFILIDECLDEAHLQHLQGSLHAFVDSLLPTAKIGIITYGRTVSVYDFSEGAAVSADVLPGNKSPTHESLKGLIYGTGVYLSPIHASLPVAHTIFSSLRPYQLNVPEVSRDRCLGAAVEVSLGIIQGPSVELSRGIIKRSGGNCRILVCAGGPCTFGPGSVPHSVKHPNYAYLEKTAMKSMESLGHEAQRHSTVIDIFCAGQCPVRVPVLQPLAKCSGGVLLLHDDFGEAFGVNLQRASTRAAGSHGLFEIRCSDNMLVTQVIGPGEEASPDSHETFKHDSSFCIQIHSVEETQSFSVSMETKGDIKSDFVFFQFAVHYSNMYQAEITRVITMKLQTVDGLSVYLASVQEDVASVIIGKRTVLRARTASDAIDMRLSIDERVKDIAFKFGNQAPKSKLYRFPKELASLPECLFHLKRGPLLGSIIGHEDERSVLRNLFLNASFDLSLRMLAPQCIMHREGGTFEELPAYDLVMQSNAAVILDHGTDIFIWLGAQLAAQEGQSAAALAACRTLAEELSEHRFPAPRILSFKQGSSQARYFVSRLIPAHKDPTYEQESRFPQLRTLTPEERARLKSSFIHFDDHSFCEWMRSLKLVPPEPS

SEQ ID NO: 18166 - DNA, 1469 bp, Panicum virgatum
  misc_feature: Ceres CLONE 1796035
  misc_feature: Encodes the peptide sequence at SEQ ID NO. 18167
acaaacaatcgagagcgagcgcctcgccatcccgtgagctccttcttttaatttttcttcttcttcttcctcgagcagtcgccggaggtgctcagtgctctgcaatggctcgagtagttgggatcctgctcgccgttgttgtggctgcggcggcatccctgcttgcgccggtggcggccgaactgacgcgggtggagcacccgcccaagaccgaggggtcgctcaacatccttgccgtcggcgactgggggcggcgcgggcagtacaaccagaccctggttgccgagcaggtaacacacacacaaaaaaaactgttacgatcgatccattcactaatcagtaacagtataaaattggcacggtagtataataaccgacgttgatcaaggaacagaatgtcgaaattacatgtacagttcatttgggctctacaggcagtattttttaattagttgtactaaattgagtgctgggcaagcaaaaaaaacttagcgtgatgctgatgaggaatggctaacctggatagcacccttagcattcatgccatgacctattagaccggcctccttcatggccaagcagtggacctcatggccttaccgcacacctagtccatggagcagggaccagaaataggcaaatttatgatgaacactatttacattattttttcaacgacgctttaatttggaggttcgttactaccattcatagttgcacgagatgatcctctttgaatcaaaccatgtgaactcgtagaaaattatccggtaataatatatccacgggctttactttcggtcccggagatctccaaatatatccaaaaaattatccatgtgaactggtagagatcgagtacttgcagctatatgtggtacggtcatgtctctccgttcattagtagccgaaagtggaggcgtcagtcattatcacatcgttagctggcttgagtatgatggcactgttcttctgttggaacggttacaaatgagccaggccccaataattgtttcccagccaacaagtaatgttacaggacatatccatgtgttgaacacttgattgaatgatttagatgtgaaaagcatgcaaattcaagtgaatttgcttcacaaacatcaacttcaactaataataattaacgacggcagctgataatgcattcttgatttcaaagcgatctgctcctctgtgtgtgtacatgcatgtgcctgcagatgggagtggtgggggagaaactggacatcgacttcgtcatctccaccggcgacaacatctacgacgacggcatcgccaacaccagcgacccactcttcaaggagtgcttcaccaacatctacaccgcccagagcctccagaagccttggtacattgtccttggcaatcatgactacaccggcaacgcgctggcgcagcaggacccctgcatccgcgaagtggacagccggtacctcgccattgccagt

SEQ ID NO: 18167 - protein, 86 aa, Panicum virgatum
  misc_feature: Ceres CLONE 1796035
  misc_feature: SWISSPROT Homolog: EC 3.1.3.2 Acid phosphatase
MCLQMGVVGEKLDIDFVISTGDNIYDDGIANTSDPLFKECFTNIYTAQSLQKPWYIVLGNHDYTGNALAQQDPCIREVDSRYLAIA

SEQ ID NO: 18168 - DNA, 662 bp, Panicum virgatum
  misc_feature: Ceres CLONE 1796035-R
  misc_feature: Encodes the peptide sequence at SEQ ID NO. 18169
caggatctggacgacgcgctgacgcaatccgaggcgccctggaagatcgtcgtcggccaccaccccatcagcagcggctgcgagcatgggaacaccaccgagctccagcagctgctccggcccatcctcgaggcgcgtggtgctgacatgtacgtgaacggccatgaccactgcctgcagcacatcagcagcaggaacagccctgtgcaatttatgacgagcggcggtgggtccaaggcatgggcaggcaagttcaagaccacctcggacaagatcgagttcatctacgacgggcaggggttcatgtcgatgcagctgagcaagacggaggcgcacctcgtcttctacgacgtcgccggcaacgtcctgcacacctatgacagcagcaagaccgaagatgatgatgaacactagctggctagatcacctacaagctaggccgcagacagcactgtgattggtaaatcagatcaggctattgtttattaactgtttgtctggaaaaagttggtgtgtgtgtgtgtgttgttgttggtgtgtgtgtgtgttgttgttgttgtgtgtcgtctgtgacaatgtgaagatcgatgtgcgtggtgtgcagaagagagaatggtatcttctgtggaattaataacactactggaaaataggcttattgt

SEQ ID NO: 18169 - protein, 137 aa, Panicum virgatum
  misc_feature: Ceres CLONE 1796035-R
  misc_feature: SWISSPROT Homolog: EC 3.1.3.2 Acid phosphatase
QDLDDALTQSEAPWKIVVGHHPISSGCEHGNTTELQQLLRPILEARGADMYVNGHDHCLQHISSRNSPVQFMTSGGGSKAWAGKFKTTSDKIEFIYDGQGFMSMQLSKTEAHLVFYDVAGNVLHTYDSSKTEDDDEH

SEQ ID NO: 18170 - DNA, 2209 bp, Panicum virgatum
  misc_feature: Ceres CLONE 1796089
  misc_feature: Encodes the peptide sequence at SEQ ID NO. 18171
gaaaccgcatcgcatcgcggcgccggcgcctccgctccgcgcgccgcgctagggttttagggctcctccccattcgccccaaaagccagccgccccgccaggggttttagccgccttctccctccccctcccctatcccctctccctcgattcctcgccgccctcgtccacatcccctcgcccgccgccaccctgaaccctcccgcagcgacgccatgtgggccctccgccgcgccggcaaccccctcaggatccgtgcccaacaagttgtgagtgcccgtggttgcgctagtcttgwggttctgctaaatgcagatgcaaaggatgtagaggagcatcatgagggtaattgtcagaaagcttgctgccgtcgtaacccaaagttgccagccttcctgttgtcattttcttcaagccatttcactttgagtaggagtttctcctctcaggcaggtgcaaattctggcaacaaagatgatgctttggaggatgggttttctgatctggaggtcccaccagaagctgatacaaaggatgctgggttgacatctgaagatagttctgatgaggatgctactgatgaagttggcttgcctgatgtggatgctgatgcaaaatctgagaagaggggctccatcctccttaaagttttgattgaagctccgaggcatgaagtcactaaagcagttgaaaaatgggctaatgatggcaatacacttgatagggctgaactctatttcgttcttcttagccttcgaaagcggaggtggttcgacaaagccttgcggctcttggaatgggttgaacaatccaaactgttcgaatttggagagcgtgattacgcttcatgcgttgatttgatggctaaggtttatggtcttcacaaagcagaacaatatattgaaaaaattcctgcacctcataggggtgagatagtgtacagaacactattggccaattgtgttcatgaatcaaatgtcaacaaagcagagcaagtcttcaataagatgaaggatcttggattgccaattacagtattttctttcaaccagcttgtgctcctttacaaaagggttgacaagaagaagattgctgatgttctcgccatgatggagaaggagaatgtgaaaccatctctcttttcttacaagctccttatagacgccaagggatcggctagagatatagaaggtatggaaaaggttgttgaacaaatggaaacagaaggtattgagccagatcttatgtttcaagctacaattgcaaggcactacatttttgatggccagcgagagaaagcagaggcgcttttggagtcaatggaaggtgatgatatcaacacaaatcgtgctgcttgcaagattctgttacctttatatggttttcttggcaagaatcatgatgtggaaaggatttggaatgtctgcaaggataatcctaggctagaggagtgtctttctgctatagaggcctttggtaggcttggtaatgttgaaaaggcagagaaagtttttgaggatatgtttgtgagatggaaaacactctcttccaaatactacaatgctatgctaaggatgtatgccaatcagaatctccttgacaagggcaaggagttgttaaagcggatggatgagaacaatgttaaatttggaaacacaacattggattcgcttgtgaagctatatgtcgacgcaggagaagtggagaaagctgagtccctgttgcacaagttatctctgaagaataggatcaggcctcagtacaccacatacctgatgctgcttgatagttactcgaagaaaggagacatccacaactcagagagagtgttcaacaggctgcggcagattggctactctgggagggtcaagcagtaccagttgctgctccaggcatatctaaatgcaaaggccccagcttatgggttcagagagaggatgaaggctgacaacattttccccaacaatgttgtggcaactttgattactgctactgatccattcgccaagaagaaatccatatctgacttgctggattaagcttggggctagtgtgagatccatcatgtcgccatgcaatgcatgtgctgcttttggcattctgctaaagtatatggtgtgataataacgtcttagtcttgtaatgaactactagtgtttgtttgcattcggactcccatgatgctttactgaacttttgagtcatatag

SEQ ID NO: 18171 - protein, 607 aa, Panicum virgatum
  misc_feature: Ceres CLONE 1796089
  misc_feature (309)..(343): Pfam Name: PPR Pfam Description: PPR repeat
  misc_feature (240)..(274): Pfam Name: PPR Pfam Description: PPR repeat
  misc_feature: SWISSPROT Homolog: EC 1.2.1.70 Glutamyl-tRNA reductase
  misc_feature (28)..(28): Xaa is any aa, unknown, or other
MWALRRAGNPLRIRAQQVVSARGCASLXVLLNADAKDVEEHHEGNCQKACCRRNPKLPAFLLSFSSSHFTLSRSFSSQAGANSGNKDDALEDGFSDLEVPPEADTKDAGLTSEDSSDEDATDEVGLPDVDADAKSEKRGSILLKVLIEAPRHEVTKAVEKWANDGNTLDRAELYFVLLSLRKRRWFDKALRLLEWVEQSKLFEFGERDYASCVDLMAKVYGLHKAEQYIEKIPAPHRGEIVYRTLLANCVHESNVNKAEQVFNKMKDLGLPITVFSFNQLVLLYKRVDKKKIADVLAMMEKENVKPSLFSYKLLIDAKGSARDIEGMEKVVEQMETEGIEPDLMFQATIARHYIFDGQREKAEALLESMEGDDINTNRAACKILLPLYGFLGKNHDVERIWNVCKDNPRLEECLSAIEAFGRLGNVEKAEKVFEDMFVRWKTLSSKYYNAMLRMYANQNLLDKGKELLKRMDENNVKFGNTTLDSLVKLYVDAGEVEKAESLLHKLSLKNRIRPQYTTYLMLLDSYSKKGDIHNSERVFNRLRQIGYSGRVKQYQLLLQAYLNAKAPAYGFRERMKADNIFPNNVVATLITATDPFAKKKSISDLLD

SEQ ID NO: 18172 - DNA, 2215 bp, Panicum virgatum
  misc_feature: Ceres CLONE 1796092
  misc_feature: Encodes the peptide sequence at SEQ ID NO. 18173
gccggggttaaggctgaggaggcctaatcactctcgcttcggcttcggcttcggctctgcttcctctccgggcgggggaagggagggcccggaagggaggagaggcgacctgctccatcgatctcctcctcggtctactaagcggaatttcttatttttggtgagaatgaagcgcatgcacagaatgccaacgaggaagtcccactcatggtggtgggacagtcacattagccccaagaactccaaatggttagctgagaatttggaaggtaacaactctatttttattgaatcacagtatgtactgaagcactcatgttattggccaagcagagtagtctgcagtaacttgctcaatgttcatgtatcttgtatatcccgtaatacaattaaacataacacaattttcctgactttttttcttgaacaaacagagatggataagcaagttaaagagatgctgaagctcatagaggatgaaggtgattcttttgcaaagaaggctgagatgtattaccaaagacggcctttgcttgtaacccatgttgagaacttctatcgcatgtaccgtgcacttgctgagcgttatgacaacgtgactggggaattgcgcaagaatcttccatcatctctgcagtctcaaggctctggtatatctgaaactgattccgagacgcaatcaatttccccatctccagagcctaacatggaacagaagacaccaaaacagaagcgcaaagcaagagcagttggctttgatgtgttccttggttctggtggaagctcagacatttcgaagaagggtagtgaaggatcattgtcttcgtcttcttcaaattctgattcagaggttgatgaaggaagtgaagaaaatggcaatggaatttcttatataatgaatggacggattaatgagctagaagaggagcttcaggaagcaaggcaacaaattgaggcacttgaggaaaagaacatgaactgccaatgtgaaaaacttgaagagagtctcaaacaagttagcagtgaaaaggaagatttggtagctgcagttctggcaaacaagaacgagattgagggtctaaaaggaaacctagcaaaagttacaggagagaaattgcagctcgaggcccaggtaaaggagcttgaacaagcatctcagagcttagatgattcttctgcagagattatgaagttacaagaaataatcaaggatctgcaagcaagattgcaaaatgattcaaatgagaaaagtatacttgaggaacgtgctatggagtttgagcaagttcgtaagcagttagaggattcaaggactgaggtcagggagctacaggctacaatcaagaacctgaaagatgacttaggcaaaactctgcaagagaaagcactgcttcaggaccgtgtgaaggatctggaacaggcaagtagtgacttaaatgcctcggtggcttctcttgagggcaagttaaccgccgcacaggcgcagcttgaacaacttcgtgccgagaacgcagaagcttccttcaagagcgaggaacaaatatcagaactgaatgaaaccatcgctgatcttaagaagaagcttgagctgctgtcctcagagaaatctgcagttgacaataaggtgtccattctgctgattgatgtcaccactcgtgatgaaaagctgaaggagatggagatccacttgcatcagctgcacctggagcatgtcaagctgcttgaagaagcagatgtcgcacggaagactgtctcaggcctgcgtgcaagggtgtgcgagctcgaggaagaggttgagaagcagaaacttatgatatccgatagcgcagaagggaagcgggaggcgatcaggcagctgtgcttctcacttgatcactaccgccatgggtacgagcagctccggcagctccttcaaggccacaagaggcccatggtgatggcaacttgagtaagtagctcgtgggatccttcgttctggatgtccaaaattggtcccccggcggcttatcatgtaatttgagcgtctccttcccccgtccccccttttcctgtataatttgagtgaaacttatgctctgcagttactcgagcagttgagctactctctctctctctctctctctctctctctctctctctctccctctctctctctctctgtaatgtattgagttatggataatcatggtaacggtattcccttctctgttcgttc

SEQ ID NO: 18173 - protein, 593 aa, Panicum virgatum
  misc_feature: Ceres CLONE 1796092
  misc_feature (75)..(142): Pfam Name: KIP1 Pfam Description: KIP1-like protein
  misc_feature: SWISSPROT Homolog: EC 2.7.11.1 Non-specific serine/threonine protein kinase
MKRMHRMPTRKSHSWWWDSHISPKNSKWLAENLEGNNSIFIESQYVLKHSCYWPSRVVCSNLLNVHVSCISRNTIKHNTIFLTFFLEQTEMDKQVKEMLKLIEDEGDSFAKKAEMYYQRRPLLVTHVENFYRMYRALAERYDNVTGELRKNLPSSLQSQGSGISETDSETQSISPSPEPNMEQKTPKQKRKARAVGFDVFLGSGGSSDISKKGSEGSLSSSSSNSDSEVDEGSEENGNGISYIMNGRINELEEELQEARQQIEALEEKNMNCQCEKLEESLKQVSSEKEDLVAAVLANKNEIEGLKGNLAKVTGEKLQLEAQVKELEQASQSLDDSSAEIMKLQEIIKDLQARLQNDSNEKSILEERAMEFEQVRKQLEDSRTEVRELQATIKNLKDDLGKTLQEKALLQDRVKDLEQASSDLNASVASLEGKLTAAQAQLEQLRAENAEASFKSEEQISELNETIADLKKKLELLSSEKSAVDNKVSILLIDVTTRDEKLKEMEIHLHQLHLEHVKLLEEADVARKTVSGLRARVCELEEEVEKQKLMISDSAEGKREAIRQLCFSLDHYRHGYEQLRQLLQGHKRPMVMAT

SEQ ID NO: 18174 - DNA, 525 bp, Panicum virgatum
  misc_feature: Ceres CLONE 1796099
  misc_feature: Encodes the peptide sequence at SEQ ID NO. 18175
ctaacacctccattattctgttccctcaccaagtctacttccgggcgtctcccctccctctcgcccccagccacgcagccgacgccggccggagggggcgccatggccacttctgatctggggggcaaggccaaggaggccttcgaccaacaccacttccagctcccccctgagctatacacccatctcattcacgccgggcccgccgcctcagacctctactccgaccgcgcccaggcgcacatcaagctcaccaactactctgaggctgtggcagatgctaacaaaacaattgaacttgatcctacgatgcataaagcctactatcggaaaggtgctgcatgcatcaaacttgaacaataccaaactgcaaagactgctcttgaattgggttcgtcctatgcaaatggcgactcaaggcttactcgtctgttgaaggaatgtgaagagcgcattgctgatgatcctagccaggcaccagtaaagaatgctgaggcacctgccactgctactgttgaggacaaa

SEQ ID NO: 18175 - protein, 140 aa, Panicum virgatum
  misc_feature: Ceres CLONE 1796099
  misc_feature (37)..(70): Pfam Name: TPR_1 Pfam Description: Tetratricopeptide repeat
  misc_feature: SWISSPROT Homolog: EC 3.1.3.16 Phosphoprotein phosphatase
MATSDLGGKAKEAFDQHHFQLPPELYTHLIHAGPAASDLYSDRAQAHIKLTNYSEAVADANKTIELDPTMHKAYYRKGAACIKLEQYQTAKTALELGSSYANGDSRLTRLLKECEERIADDPSQAPVKNAEAPATATVED

SEQ ID NO: 18176 - DNA, 691 bp, Panicum virgatum
  misc_feature: Ceres CLONE 1796103
  misc_feature: Encodes the peptide sequence at SEQ ID NO. 18177
ttccgaggttttcgccgctcgcagcgcacccgcaccccccggagcggctcgccgtcggcgcggaggaggagagcggaggaggctacgcgatgacggaagagaatcaggctggaaagaaagaggaggaggaatttagcactggtcctctgtctgtcctaatgatgagtgttaagaacaacacccaggtgctcatcaactgccgcaacaacaagaagctgcttggtcgtgttcgtgcttttgatcgccactgtaacatggtgcttgagaacgtgcgggaaatgtggacagaggtacccaagactggcaagggcaagaagaaggctctgcctgtgaacaaggacaggttcatcagcaagatgttcctcaggggtgactcagtcatcatcgtgctgagaaacccgaagtgagcttgcagcaagcccccttgatgtggggtttgaggaagccatgtatctgttgaaggctgtagcttatctacttatgtatgtttttggagaattaactggtagtctggaaccgctgcgcatgagcacatgtttcatgagtttgttaacttggagtatgtacctgccaactgcagtattttgatcacggaatgcctcgcttgtctttctggttaaaaaaaacctttctctcttcccttccatctccccgctctcgtctctcctcatccacagaaacagaagcttag

SEQ ID NO: 18177 - protein, 105 aa, Panicum virgatum
  misc_feature: Ceres CLONE 1796103
  misc_feature (23)..(102): Pfam Name: LSM Pfam Description: LSM domain
MTEENQAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 18178 - DNA, 671 bp, Panicum virgatum
  misc_feature: Ceres CLONE 1796106
  misc_feature: Encodes the peptide sequence at SEQ ID NO. 18179
aattccatcagctcacaccagaccagaccaagcaagcacgagggagaaaacaaaatttcggtgctgagctgtgcctgtcctcggagccgtagccatggagcgagcaggggaggtgtcggccgccgccggcaacggcaacggcgccgtgcggaggtcgccgtcgacggcgccggcggcgcgggtgtcgatctgggagtcggtgcgcgcgtgcgggatatgggggaaggaggtggacaaggccgagctgcggaggcaggtcgtcatgccgctccacctccgccgcgcggtcgcggcggccgtcgcggccaaggacgaggccgccggcgtggcggcggcgtcggcggcgaaggagggggccggggatggggagaaggaggaggggccaacagtggcgcccgtggtcgtgttcgtcaactcgcggagcggcgggcgccacgggcccgagctcaaggtgcggctgcacgagctcatcaccgaggagcaggtcttcgatctttctgttgtgaagccttcagattttgttcactatggtttgagttgtttggagaggttagctgaccaaggtgataactgcgcgaaagctgctcgtgaaaaaataaggattgtggttgctggaggtgatggcacagttggttggatgcttggttgtctctcagatctttataagatga

SEQ ID NO: 18179 - protein, 192 aa, Panicum virgatum
  misc_feature: Ceres CLONE 1796106
  misc_feature: SWISSPROT Homolog: EC 2.7.1.107 Diacylglycerol kinase
MERAGEVSAAAGNGNGAVRRSPSTAPAARVSIWESVRACGIWGKEVDKAELRRQVVMPLHLRRAVAAAVAAKDEAAGVAAASAAKEGAGDGEKEEGPTVAPVVVFVNSRSGGRHGPELKVRLHELITEEQVFDLSVVKPSDFVHYGLSCLERLADQGDNCAKAAREKIRIVVAGGDGTVGWMLGCLSDLYKM

SEQ ID NO: 18180 - DNA, 601 bp, Panicum virgatum
  misc_feature: Ceres CLONE 1796106-R
aagaaggttggcatgcttcatttgtaatggctgagcttataaaagcaaagcacattgcccaggccgcagctatcaagttcgaaatgaggggtggccagtggaatcgagcatatgttcaaatggatggagagccatggaaacaaccactcattcaggaccagtcaaccattctggaaataaacaaagttccatatcattctcttatgatcaccggggagcaatgatatttcccatgtcaatcagggttgcattcttagatcgttagattgtgtacagttcaggagcagcgtgcactagattcttagaactgggtcgactgcagggaggatgcatgttcgttggcctttgtcatgccatggtcaagtcatggccagagcatgataaggcaccatgcattattgtattgtatcatatctgtaatctgttgttgtatccggatttcttttgaagagaaagaaacaagcttaatttaatttgtagtgttccgttgtgtgtcaatgcaaaagaataacctggtgaaaacaccatctcgactgtaaaactggacagtttgggatttgcactgtcctaagagcatatccattcgcaaacagcttatttc

SEQ ID NO: 18181 - DNA, 2482 bp, Panicum virgatum
  misc_feature: Ceres CLONE 1796107
  misc_feature: Encodes the peptide sequence at SEQ ID NO. 18182
atgcctgcctagcgtgttgtgtcattttatatatctgacctgtgtttgcaacgccttgcatcatcactggttaatggtttgacagcgtaaaggggtcgaatcatcacttgtcgtccatactaccggccctattcagcagccagggatggcagccggtacgacgtcaggagaagcaactatggaccgacgtctcctggctgcagccgcatctggagatgcggcatcaatgaagcaactggctcttgatccaggcgtgctgctgggaacaactccaccggggaacacctgcctccacgtctcctgcatcctggagcacgagaaattctgcaggagtatcctgacgctggaccagtctccagcactcgtctccgccgtcaacaaagatggcgagacgccgctcctcgccgccgtgacaaggggccatgtctctgtagcttctatattactcaggtattgccgtgatcagcagctgagccaagtaatcttgaaacaagacaagcgcggattcaacgtgctgcaccacgccatccgcagaggacacacgatgctggcgcttgagctgatagaagcagagccggccttgtcgaaagctgtcaacaaaaacgacgagtcgcccatgttcatcgcagcgatgagaaacatcacagatgtgtgtgaaaaattgttggagattccgtattcagctcattcgggaacctgtggcctcaatgctctccatgctgccgtcagaaatggcaatccagtgatagctaaaaggattatggaattacgcccttggctagtcagacaacaaaacgagaataagtctactccaatgcacctagctgtgagcaaaaaaaggattgacgtgctaaaagtattattggaacatgattcgtcattagggtacctaatctccccacctcttctttgtgtcgccgcaactgtgggtgctgttggtgttgctcgagagcttcttaaacattgtccagatgctccctactgcgatccaatgggcagcacatgccttcacttagcagtgttgtgtggacatatggagtatgtaaagtttatcctggggtcacagcaacttgggcaactcgttaacatgcaaaatagcagaggagaaactgctctgcatctcgcagccaaattcaagaaggtggagatgctttctgctttaaggcatcgccaagatatggacataacagtgcttaatagcgccggtaaatcggcaagctgggaattacttcatgccaccaaccccgcgaagcctttaatctcgatggcagacgatatatcttccccgccagaaccatcaggggctacccggtcaccaggaaaccctctgatggacctacgtctactaaaagcagcagcgtctggtcatgctgcagaaatgaagcacatggctgtgcatgtccctggcgtcctgcatgggacaaccccgcaagggaacacctgcctccacatcgcctccatccatgggcacgaggagttctgcaaggatgtcatgtcgctcagccagtctctgcctctcctggccgccaccaatgccgacggcgagacgccgctggtcgcagccgtagcaagcggccatacatctttggcttcatctattctcaggtgctgcattgctcagcagttgagcgacgcaatcctaatgcaagacaagaacggatgcaatgcgcagcggatagaggccgagccttcactgtcgcgtgctgtaaaccaatacggcgagtcgcccatgttcatcgcggtgatgagaaatcacgcggatgtcttcgagaaactgttggagatccctgattccgctcacgggggagcgtatggttacaatgttctgcatgctgctgtgagaagtggcaatacagccatcgcaaaaaggattatggagacacgtcccgggctggccagagaagaagacaagcataaggctactccaatgcacctggctgcgcactgggacaaggttgaggtcctgagagtgctgctcgaacatgactggtccttagggtacgcagtatcctctaagggatcccctgttcttatttctgcggcagcgtcacggggatatgttggtattgccaaagagcttcttaagcattgtccggatgctccctgtcgcgttgcaaacgacgagacgacatcgacatgtcttcagcaagctgtaatgcttggtcgtatggagcttctagaattcttccttgattcaaagtatactcggaaactagtcaacgtgcgagacgaaaatgaagagactcctttgcataacgcggtaagaaagtgcgatccaaagatagtccatgctttgctacgatgcccggacattgatgttacagtgcttaacaaagtgggtaacccagcatcctggttactaggtactaccgcccaccacgccaagacattaaactgggtacgtacgtatgtttgttgtccaaatgcctcagcccttgtatcaatgcagtgcaaagcaatataaataacaaccattttggtc

SEQ ID NO: 18182 - protein, 761 aa, Panicum virgatum
  misc_feature: Ceres CLONE 1796107
  misc_feature (272)..(307): Pfam Name: Ank Pfam Description: Ankyrin repeat
  misc_feature (340)..(681): SWISSPROT Homolog: EC 2.4.2.30 NAD(+) ADP-ribosyltransferase
  misc_feature (203)..(336): SWISSPROT Homolog: EC 2.1.1.43 Histone-lysine N-methyltransferase
MDRRLLAAAASGDAASMKQLALDPGVLLGTTPPGNTCLHVSCILEHEKFCRSILTLDQSPALVSAVNKDGETPLLAAVTRGHVSVASILLRYCRDQQLSQVILKQDKRGFNVLHHAIRRGHTMLALELIEAEPALSKAVNKNDESPMFIAAMRNITDVCEKLLEIPYSAHSGTCGLNALHAAVRNGNPVIAKRIMELRPWLVRQQNENKSTPMHLAVSKKRIDVLKVLLEHDSSLGYLISPPLLCVAATVGAVGVARELLKHCPDAPYCDPMGSTCLHLAVLCGHMEYVKFILGSQQLGQLVNMQNSRGETALHLAAKFKKVEMLSALRHRQDMDITVLNSAGKSASWELLHATNPAKPLISMADDISSPPEPSGATRSPGNPLMDLRLLKAAASGHAAEMKHMAVHVPGVLHGTTPQGNTCLHIASIHGHEEFCKDVMSLSQSLPLLAATNADGETPLVAAVASGHTSLASSILRCCIAQQLSDAILMQDKNGCNAQRIEAEPSLSRAVNQYGESPMFIAVMRNHADVFEKLLEIPDSAHGGAYGYNVLHAAVRSGNTAIAKRIMETRPGLAREEDKHKATPMHLAAHWDKVEVLRVLLEHDWSLGYAVSSKGSPVLISAAASRGYVGIAKELLKHCPDAPCRVANDETTSTCLQQAVMLGRMELLEFFLDSKYTRKLVNVRDENEETPLHNAVRKCDPKIVHALLRCPDIDVTVLNKVGNPASWLLGTTAHHAKTLNWVRTYVCCPNASALVSMQCKAI

SEQ ID NO: 18183 - DNA, 730 bp, Panicum virgatum
  misc_feature: Ceres CLONE 1796111
  misc_feature: Encodes the peptide sequence at SEQ ID NO. 18184
acgcaacgcaatcttgcaatccagcccccgaaagagacctaaaaaccgccaccaggctttcgatcgcgccgagggaggaggacgagcaatggcggccgaggagggagtcgtgatcgcgtgccacaccaaggaggagttcaagaaccagatgaccaaggccaaggatgccggcaagctggtgatcattgacttcactgcctcctggtgtggtccttgccgcatcatcgccccggtgtttgctgaattagccaagaagttcactgacgctttcttcctgaaggtcgatgttgacgagctgaaggaagtagcctcagagtacgagatccaggcgatgccgaccttcctcttcattaagaacggtgagaagatccacactgttgttggtgccaggaaggaggacctccagaccagcatcgagaagcacgcctccgccactgctgcttccgcctccgcctaaggccatagcgccaccagttatcaataagggccagcccacggcgtggtagcagtaggcgtcgtaattttcagtttggtttgggtgaattgtgagctatgttcaaatctggagtcctgatatgtttggttcctgtgctggacctgttatcgtcctgaaaaaaaaagatcagatcggcgaaagcccaaatcccaagcagaggagcgaaatctcgagcgctcgtgccggcgaagaccacgagaaggaggccgcggcacgagagctccccaggcatct

SEQ ID NO: 18184 - protein, 122 aa, Panicum virgatum
  misc_feature: Ceres CLONE 1796111
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAEEGVVIACHTKEEFKNQMTKAKDAGKLVIIDFTASWCGPCRIIAPVFAELAKKFTDAFFLKVDVDELKEVASEYEIQAMPTFLFIKNGEKIHTVVGARKEDLQTSIEKHASATAASASA

SEQ ID NO: 18185 - DNA, 665 bp, Panicum virgatum
  misc_feature: Ceres CLONE 1796111-R
  misc_feature: Encodes the peptide sequence at SEQ ID NO. 18186
ctgagctcgtcatgaagtccatcgtgcccgtggtcatggctggtgtgctcggtatctacggcctcattattgccgtcatcatcagtactgggatcaaccccaaggccaagccatactacctcttcgacggctatgcccacctgtcgtctggcctagcctgtggtcttgctgggcttgccgccggcatggccattggcattgtcggtgatgctggtgtgagggctaacgctcagcaacctaagctgttcgtgggcatgatcctcatcctcatttttgccgaagcactcgccctctatggtcttatcgtcggcatcatcctctcatcccgcgccggccagtcccgtgcagactaggcgcgttccagatgtcgataccatgcctggccctggccgggccctgttttatattcatgagacaagaagctggagctctttagagggttattttaattctgtctagttttcgctcttctgtttgggtctgagaaaaaaaacgtgtgcagccaagggaggacttccccttgtggtgccgatgccattctttctccagtatgtggtggtggtggtgggctgtggtcgatgctcattattctggactaattatgagttgattaacagggcacatcggtgaactgacgtggctaataaaaagattatgagcatatc

SEQ ID NO: 18186 - protein, 116 aa, Panicum virgatum
  misc_feature: Ceres CLONE 1796111-R
  misc_feature (44)..(109): Pfam Name: ATP-synt_C Pfam Description: ATP synthase subunit C
  misc_feature: SWISSPROT Homolog: EC 3.6.3.14 H(+)-transporting two-sector ATPase
ELVMKSIVPVVMAGVLGIYGLIIAVIISTGINPKAKPYYLFDGYAHLSSGLACGLAGLAAGMAIGIVGDAGVRANAQQPKLFVGMILILIFAEALALYGLIVGIILSSRAGQSRAD

SEQ ID NO: 18187 - DNA, 2380 bp, Panicum virgatum
  misc_feature: Ceres CLONE 1796121
  misc_feature: Encodes the peptide sequence at SEQ ID NO. 18188
atagtcaaaccttccttgttcatcttctcctcgtcctcctcggctcctcctcccctggtccattgaagagaggcatgcgcgcgagcggtggctgcgcgctccgccaccgtcgtccgtagcagccgcgaccgcgaggcgtttcctcgaagaagaggaggagcaggcgcgggacggccggccggcgggtatgatggaggtcggggaggaggcagtgcgggcgctgggcgcggggttcgacctcacgtccgacttccgcctgcgcttcgccaaggccagcgcgggtcggcgcctcgtggagctcggcggcgagacccgggacgtgccgctcccgggcggcgccggggccacgctccgcggcgtgccgctcgacgtcggcgtcgacaagggcgaccgcatccgcttccgctccgacgtgctcgagttcaaccagatgtcagaactacttaatcagaaatcttcagtccaagggaaagttccttcaggctattttaatgctctttatgaactaagtggagcatggttgactgatgccagagaaactaagcacctagcatttgatggatatttcatttccttgtacaacctgcacctaaaagcttctccgttagttcttcgggatgaagtcaaaaaggctgttccatccaagtgggatcctgttgcattagcctggttcatcaaaacttatgggacacatataattgttgaaatggcaatcggaggtcaggatgttatatgtgttaaacaaaatcattcttcaaccgtttcagctgctgatttaaagctgcatatggaggatcttggtgattttttattttctgatgggaagagccattccccaatacatcgcaaaacaaagagcaaggtgcctgatgtttttgtcaggatagtgcaacaacctaataacctgcacctttctacctactctgaaacatcaaccaaggatggcctgacagttacatgttctaagaggggaggagaagtatacatacaaaaccactccaaatggctgcaaacagtgccaaggaaacctgatgctattatgttcaaatttgtccctatcacttctcttcttactggtattcctggtagtggttacctcagccatgccatcaatttatatcttcgctataaacctgatcttcaagacttgcagtatttcttggagtttcaagtgcctctacaatgggcacctatgttcaatgagcttgtccttggacctcaaaagagaaaaggttcctacccttccatgcagttcagatttctcggtcccaaactccatgttagcacctcccaggtatctagttctcagaaacccatagttggcctacggctatacctggaggccaggaagtgcaaccggctggccatccatgtccagcacctgtcaagtgccccaagcatgctggctgactccatggcgtcctcaatgtccgagtggcgcgagtccgaagacaccgacccgggctacatcgaggccatccagtggaagaactactcgtgcgtctgcacctccgccgtcaagtacaaccccgagtggcacaagcgagccccgggtggcgtcttcgtcgtcaccggcgcccagctggtgaccaaggggacctggtccaagaaggtcctccacctccgcctcctctacacccacatccccaactgcagcatccagaggaccgagtggacgagggctcccgcggcgtcccagaaggggagcttcctgacgaccatcagcacgacgctgagctcccccttcacgcagcgcgacgcccaccagcagcacgcgccgaggcacgagccggcgcagctcaactccggcgtctaccccgacgggccgccggtgccgctccggtcccggaagctcctcaagttcgtggacatgtcggaggtggtcaaggggccgcacgacgtcccgggccactggctggtgatcgccgcgaagctcgtcaaggagggagggaagatagggctccacgtcaagttcgcgctgctgggctacgatgggcagcagtcgcagggtgacagtgacagcttcgcaagctgagctgagctgatgatctgatcttcgtacataacaacagtggctgatcattgtacattgcagggttttgggagaagccagcagcattaggacaaaggattttttgttgatttttttcccattttggtcgataggaagtgtacagaggcagataataaaccaatcagcgctgtgttgacaagctccatggattttcgtgctttgtaactagggtcggtagttgtaaattactatgagagaaaaaatcaatacctgttgagccatgcatgtgccctccttgttacaatgtcaagagcttcgtcatccaatcaaggaaaatgaccatcaccaagagggcacttttactct

SEQ ID NO: 18188 - protein, 615 aa, Panicum virgatum
  misc_feature: Ceres CLONE 1796121
  misc_feature (118)..(313): Pfam Name: MACPF Pfam Description: MAC/Perforin domain
MMEVGEEAVRALGAGFDLTSDFRLRFAKASAGRRLVELGGETRDVPLPGGAGATLRGVPLDVGVDKGDRIRFRSDVLEFNQMSELLNQKSSVQGKVPSGYFNALYELSGAWLTDARETKHLAFDGYFISLYNLHLKASPLVLRDEVKKAVPSKWDPVALAWFIKTYGTHIIVEMAIGGQDVICVKQNHSSTVSAADLKLHMEDLGDFLFSDGKSHSPIHRKTKSKVPDVFVRIVQQPNNLHLSTYSETSTKDGLTVTCSKRGGEVYIQNHSKWLQTVPRKPDAIMFKFVPITSLLTGIPGSGYLSHAINLYLRYKPDLQDLQYFLEFQVPLQWAPMFNELVLGPQKRKGSYPSMQFRFLGPKLHVSTSQVSSSQKPIVGLRLYLEARKCNRLAIHVQHLSSAPSMLADSMASSMSEWRESEDTDPGYIEAIQWKNYSCVCTSAVKYNPEWHKRAPGGVFVVTGAQLVTKGTWSKKVLHLRLLYTHIPNCSIQRTEWTRAPAASQKGSFLTTISTTLSSPFTQRDAHQQHAPRHEPAQLNSGVYPDGPPVPLRSRKLLKFVDMSEVVKGPHDVPGHWLVIAAKLVKEGGKIGLHVKFALLGYDGQQSQGDSDSFAS

SEQ ID NO: 18189 - DNA, 696 bp, Panicum virgatum
  misc_feature: Ceres CLONE 1796144
  misc_feature: Encodes the peptide sequence at SEQ ID NO. 18190
atcaaacccccagacttttccgccagcgccatcctcagccagccgccaagccttcgagaaccctccggagctcgctagatccgatcggacccggcgcgggctgccgccatggcggacgaggcgaaggccaagggtaatgcggcgttctccgccggccgcttcgaggaggcggcgcggcacttctcggacgccatcgcgctcgccccgggcaaccacgtcctctactccaaccgctccgccgcgctcgcctcgctccaccgctactcggacgcgctcgtcgacgcgcagaagaccgtcgagctcaagcccgactgggccaagggctactcgcggctcggcgccgcgcacctcggcctcggcgacgccgccagcgccgtcgccgcctacgagaaggggctcgcgctcgaccccaccaacgagggcctcaaggcggggctcgaggacgccaggaaggccgccgccgccccgccgcgccgcgggccgtccgggcccgacgccatcggccagatgttccagggccccgagctgtggagcaagatcgcggccgaccccaccacgcgcgcctaccttgaccagccagactttatgaagatgctgcgcgaggtgcagaggaacccaagcagcctcaacatgtacctctccgatccccgcatgtctaccccgccgccgccgccgcagcagcagcagacgacgcct

SEQ ID NO: 18190 - protein, 195 aa, Panicum virgatum
  misc_feature: Ceres CLONE 1796144
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFSDAIALAPGNHVLYSNRSAALASLHRYSDALVDAQKTVELKPDWAKGYSRLGAAHLGLGDAASAVAAYEKGLALDPTNEGLKAGLEDARKAAAAPPRRGPSGPDAIGQMFQGPELWSKIAADPTTRAYLDQPDFMKMLREVQRNPSSLNMYLSDPRMSTPPPPPQQQQTT

SEQ ID NO: 18191 - DNA, 705 bp, Panicum virgatum
  misc_feature: Ceres CLONE 1796152
  misc_feature: Encodes the peptide sequence at SEQ ID NO. 18192
atcactcccgattctccctctctcttccccatccgggccaaccaaccctagcgcggcggcgatggcgtcggacccgcccccggacgacgcggctacgcccccggcggcgaacggccacgtccgcgaccacgacaacggccacggcccgtccccggcgaagcgcccccgggcggtgatctcggcggccgagatctgcgccgagttcgcgcaccacgacgccgccgtcgcgcgcgtcaacaacggcagttttggctgctgcccggcctcggtcctcgccgcgcaggcccgctggcagggcctcttcctcgcgcagcccgacgccttctacttccacggcctccagcaggggctgctccgctcgcgcgccgccgtcgccggcctcgtcggcgccggcgacgtctccgaggtctccctcgtcgacaacgccaccaccgccgccgccatcgtcctgcagcacgccgcctggagcttcgccgaggggcacttcgcccgcgggaacgccgtcctcatgctccactacgcctacggcgccgtcaagaagtccatcaacgcctacgtcgcgcgcgcgggggccaccgtcgtcgaggtgcccctgccgttccccgtcgcgtccgccgacgcgattattgccgagtttcgggccgcgctcgccgtcgccaaggaaggggggcagagggtccgcctcgcggtcatcgaccacatcac

SEQ ID NO: 18192 - protein, 214 aa, Panicum virgatum
  misc_feature: Ceres CLONE 1796152
  misc_feature: Functional homolog of the protein sequence given in SEQ ID NO 50803
  misc_feature: Useful for making plants with modulated nitrogen use efficiency
MASDPPPDDAATPPAANGHVRDHDNGHGPSPAKRPRAVISAAEICAEFAHHDAAVARVNNGSFGCCPASVLAAQARWQGLFLAQPDAFYFHGLQQGLLRSRAAVAGLVGAGDVSEVSLVDNATTAAAIVLQHAAWSFAEGHFARGNAVLMLHYAYGAVKKSINAYVARAGATVVEVPLPFPVASADAIIAEFRAALAVAKEGGQRVRLAVIDHI

SEQ ID NO: 18193 - DNA, 662 bp, Panicum virgatum
  misc_feature: Ceres CLONE 1796152-R
  misc_feature: Encodes the peptide sequence at SEQ ID NO. 18194
agaaagtgattgagatgggtaggatgcttgctgaggcgtgggggacatttcttggctcaccaccagaattgtgtgggagcatggttatggtggggctgccaggttgccttgctgttgagagtgatgatgatgcaatgagagtgaggactatgttgaggaaggatttccaggtggaggtgccaatatactataattcaagaagggtggaaggacaagagatggcaaaggacaagagtggtgatccagtgacagggtatgtgaggatctcacaccaggtttacaatgtcagggaggactacgagagactaaaagatgctatcaataaacttgtttctgaggggttcaccagctgcaagttgcggccttcagagaagcaagaagcttaggagtgatgaccttctagccaggcagcagtccacccgaagatgctgtggctgactacttaagtgtgggtcgggtcaacgcagccagtgcctcatcgtgatgtctctcccatggcatagccaagccagttgatgaatgtagtgtgtcttcaggaactgacatgtgttgtatttggcgttcagtgtatgtaacaataatgccctggcatgtcgtcttccctcctctcattttccttttctgctgtaacctgagaataatctgaatgtaaggtgatttac

SEQ ID NO: 18194 - protein, 127 aa, Panicum virgatum
  misc_feature: Ceres CLONE 1796152-R
  misc_feature: Functional homolog of the protein sequence given in SEQ ID NO 50803
  misc_feature: Useful for making plants with modulated nitrogen use efficiency
KVIEMGRMLAEAWGTFLGSPPELCGSMVMVGLPGCLAVESDDDAMRVRTMLRKDFQVEVPIYYNSRRVEGQEMAKDKSGDPVTGYVRISHQVYNVREDYERLKDAINKLVSEGFTSCKLRPSEKQEA

SEQ ID NO: 18195 - DNA, 1779 bp, Panicum virgatum
  misc_feature: Ceres CLONE 1796155
  misc_feature: Encodes the peptide sequence at SEQ ID NO. 18196
accccaccgggagcggccgaggaagcaggcagccaccagccatgtcgtgcggcgggtgcggctgcgaggcgccggcggggacgggggcgtacctgagcggcgagccggtgcgggaggcgcgggagctggtggcggagctctgccgccacttctacgcgcaggggtgggtcaccggcaccggcggcagcatcaccgtcaaggtcaacgaccccgccgtgccgctcgccgaccgcctcatcgtcatgtcgccctccggtgtgcagaaggagaggatggtggcagaggacatgtatgtgatggctgcagatgggaaagtgctctctgcaccagcagcaaagccatggccaaacaaacctccaaagtgtacggactgtgctcctctgttcatgaaggcctatttgatgagaggagctggggctgtcattcacagccatggaatggagacttgcatagcaacaatgcttaaccctggtgcaaaggagttcaggatgactcatatggaaatgattaaaggaatcaaaggtcatggctaccgtgatgaattggttattcctattatcgagaatactccttatgagtatgagctcactgactccctaagtgaggcgattgcagcatacccaaaggcaactgctgtccttgtacggaaccatggaatatatgtgtggggtgactcttggatcaatgccaagacacaggctgaatgctaccattatcttttagatgcttgcatcaagctctatcaactaggaattgattggacaactcctgaacatggtccgctaaacagtgcaaagagactgcgcagcattttgagccctgaaattcctaatggacatcatgctgctgaagcatcaaagtgtgttgtacttgacattgagggcacaacgactccaatatcatttgtgactgatgttatgtttccttatgcctgtaacaatgtgcgaaagcatctaatttctacgtttgattctgaagaaaccaaagaagacatcaatttactgcgcatccaaattgaagatgatttaagaaatggaattgctggggctgttccagttccacccgatgaggctggcaaagaagaggtcatcaattcattggtggccaatgttgaatcaatgattaaagcagaccggaagattacgtcactgaaacaacttcagggtcatatatggaggactggatttgaaaagaaagaactatatggagttgtctttgaggatgttccagtggcactaaagaactggcatgctagtggcataaaggtctacatatactcgagtggaagtcgagaggcacaaaggcttctatttggcaatacaacgtatggtgacctgcgaaagttcctgtgtgggtattttgatacaacaactggtaacaaaagagaaaccaagagttattttgagatctctcagtcacttggtgttgacagtccatctcaaatcttattcgtcactgacgtctaccaagaagccattgctgccaaaaacgcaggttttgatgtgataatctccattcgcccgggaaatgctccacttccggagaaccatggtttccgcactatcaagtcattcagcgagatctgacgaatgcagacttgtggatgtgtaatggcataggatttgtgtgtaatttacaagtgctttctgggctaatattagcccgccgatcagtccatgcaatagcagcagtatagcgcctcagcatggcagaatgaggtgacgcaacaataaaccgtaatggcaaaataaaattgtacatgctggtccgttatgtttc

SEQ ID NO: 18196 - protein, 514 aa, Panicum virgatum
  misc_feature: Ceres CLONE 1796155
  misc_feature (28)..(245): Pfam Name: Aldolase_II Pfam Description: Class II Aldolase and Adducin N-terminal domain
  misc_feature (272)..(494): Pfam Name: Hydrolase Pfam Description: haloacid dehalogenase-like hydrolase
  misc_feature: SWISSPROT Homolog: EC 3.1.3.77 Acireductone synthase
MSCGGCGCEAPAGTGAYLSGEPVREARELVAELCRHFYAQGWVTGTGGSITVKVNDPAVPLADRLIVMSPSGVQKERMVAEDMYVMAADGKVLSAPAAKPWPNKPPKCTDCAPLFMKAYLMRGAGAVIHSHGMETCIATMLNPGAKEFRMTHMEMIKGIKGHGYRDELVIPIIENTPYEYELTDSLSEAIAAYPKATAVLVRNHGIYVWGDSWINAKTQAECYHYLLDACIKLYQLGIDWTTPEHGPLNSAKRLRSILSPEIPNGHHAAEASKCVVLDIEGTTTPISFVTDVMFPYACNNVRKHLISTFDSEETKEDINLLRIQIEDDLRNGIAGAVPVPPDEAGKEEVINSLVANVESMIKADRKITSLKQLQGHIWRTGFEKKELYGVVFEDVPVALKNWHASGIKVYIYSSGSREAQRLLFGNTTYGDLRKFLCGYFDTTTGNKRETKSYFEISQSLGVDSPSQILFVTDVYQEAIAAKNAGFDVIISIRPGNAPLPENHGFRTIKSFSEI

SEQ ID NO: 18197 - DNA, 1975 bp, Panicum virgatum
  misc_feature: Ceres CLONE 1796172
  misc_feature: Encodes the peptide sequence at SEQ ID NO. 18198
atcgatcgctcgcacgctgacgctaccttcacgtcctccactactacgaccacctcgcgcctgccagttcctgcgccccacaaccacgccgcccactgcgctccctcccccccggcggggcaccacggcgatgcccgccgcccagtgaagataccggcggcatgccggacgacgctgcctacctcctctgcgccgaggaagccgccgccgccttcttcggcgccgcggccgccggcagcagcgcctgcaccggggcaggcggcgaagacgacgacgacgggagctgctgctccgccggcgaggaggtggaggagtcggcggcctccatcgccgagctcatcggcggcgaggccgactacgcgccgcggccggactaccccgaccggctccggtcgcggtccatcgacccggccgcccgggccgagtcggttgcatggattctcaaggtgcaggagtactatggattccttcccttggcagcctacctcgccgtcaactacatggaccggttcctctccctccaccgtctgccgcaggaggacgggtgggcgatggagctgctggccgtgacctgcctctccctggccgccaagatggaggagatcctcgtgccctccctcctggacctacaggtcgagggcatcagcaggtacgtgttcgagcccggggcggtcggccggatggagctgctcgtcctgactgcgctgaattggcggctccggtccgttacgcccttcactttcatcgacttcttcgcctacaaggtcgatccgggagggaggcacacgaggtgcctcattgcccgggccacacaagttatcctagctgcaatgcatgacatcgagttcttggaccactgcccatcgtcaatggccgcagcggccgtgctctgcgccaccggcgagacgccgtcgctggagtccgtcagccccggggccgccgtccgctggtgcattggccttgcagaggatgcgatcagcagctgctacagactgatgcagcagctcgtgatcggcaacgttcggacaagagcagccagcaccacagcgtcggcagcgaacctgtgctgctcggacgaggtcctgtcctcgcactcctcatcctcctcgtcgcctcccccggctaagaggaggaagaggtcgccgccggggatttgaaatggaagaacgcaagtagatagcattattttcatggggcttttttttggcagattaacagggtttgatcgatttccttgcagtttgctgttgtgttcctgcgattctttctttcttttttccccccttttgttctcttcttttggggttggatcgttacacctatgtggggggctccgcctgctcgatcggcccagccatgatggcggcctctggcctctgcactgccagccagtctgtgtataggtgtcgagatggaggcatctggagagagaaaggcagcagctgcagcagcagacacatttgtgtttctctgtgcaacgctcagtgggtcttcttcaacccccgacgcagagctgcagaggaaccattgattggtcagcgagcaagccatggcggcacggcagatggagaggagtaaaaaaaggaggcagtgagatgcagggagtggatggtagggttaaatggggtggtcaaagagcggtcagtgctcctgccaagatgcagccgggggtcctgcccctgcaaagttgctgttcatattcatgagggcaaaaattgtttgtttccgagtggtttgttggtattttgttgatgctactgaagtgagcgtcggagggaggggggcatgctttgctgtgatgggaggcacatgcaaacgtgccctggtgtgtggtggtgctccggagggaaatatttgtccatctccggggctaacagtgtccaagcatgaggcttttgggggccccttgctatttgttcccatttgtatctcttttttgagcatcaataaggatcttgccatttgaattggcttg

SEQ ID NO: 18198 - protein, 331 aa, Panicum virgatum
  misc_feature: Ceres CLONE 1796172
  misc_feature (54)..(187): Pfam Name: Cyclin_N Pfam Description: Cyclin, N-terminal domain
  misc_feature (189)..(309): Pfam Name: Cyclin_C Pfam Description: Cyclin, C-terminal domain
MPDDAAYLLCAEEAAAAFFGAAAAGSSACTGAGGEDDDDGSCCSAGEEVEESAASIAELIGGEADYAPRPDYPDRLRSRSIDPAARAESVAWILKVQEYYGFLPLAAYLAVNYMDRFLSLHRLPQEDGWAMELLAVTCLSLAAKMEEILVPSLLDLQVEGISRYVFEPGAVGRMELLVLTALNWRLRSVTPFTFIDFFAYKVDPGGRHTRCLIARATQVILAAMHDIEFLDHCPSSMAAAAVLCATGETPSLESVSPGAAVRWCIGLAEDAISSCYRLMQQLVIGNVRTRAASTTASAANLCCSDEVLSSHSSSSSSPPPAKRRKRSPPGI

SEQ ID NO: 18199 - DNA, 736 bp, Panicum virgatum
  misc_feature: Ceres CLONE 1796176
  misc_feature: Encodes the peptide sequence at SEQ ID NO. 18200
atccgttccatttcttatcccctcccctcccatggcgtccctcctcacgctccccgcgctcgcgctctccaaccctagtacctcaacctccggcgccgcccgcccccgcgccgctgccttccgctgctgggcgctgcggcggcgcgggtgggcggcggcgggggccgtggcctcgcccaactccgtgctcagcgagcacgccttcaagcggctgcagctcgggagcgacgacgaggatgacgaggagggggcgtacgggagcgacgcggacgaggggatggaggggttccagggggacgagggggagctcgccattgccaggctcggcctgcccgacgagctcgtcgccacgctcgagaagcgcgggattacgcgcctcttccccatccagagggctgtgttgatccctgctcttgagggtcgtgacctgattgctcgggcaaagactggaactggaaagacactggcctttggtatacccatgatcaagcgattaatggaggattatgatggtcgtagtacgaggcgaggtcgtattcctcgggttttggttctggcacctaccagggagttagccaaacaagttgagaaggaaataaaggaatcagcacccaagctcagtacagtgtgcgtttatggtggtgtttcgtataatgtccagcagaacgcactctcacgcggtgttgatgttgttgttggaacaccgggtcgcataattgatttgataaatggtgga

SEQ ID NO: 18200 - protein, 234 aa, Panicum virgatum
  misc_feature: Ceres CLONE 1796176
  misc_feature (117)..(234): Pfam Name: DEAD Pfam Description: DEAD/DEAH box helicase
MASLLTLPALALSNPSTSTSGAARPRAAAFRCWALRRRGWAAAGAVASPNSVLSEHAFKRLQLGSDDEDDEEGAYGSDADEGMEGFQGDEGELAIARLGLPDELVATLEKRGITRLFPIQRAVLIPALEGRDLIARAKTGTGKTLAFGIPMIKRLMEDYDGRSTRRGRIPRVLVLAPTRELAKQVEKEIKESAPKLSTVCVYGGVSYNVQQNALSRGVDVVVGTPGRIIDLING

SEQ ID NO: 18201 - DNA, 674 bp, Panicum virgatum
  misc_feature: Ceres CLONE 1796185
  misc_feature: Encodes the peptide sequence at SEQ ID NO. 18202
cctttctcctgagctccttccattccattcccaagctaagctagcagacaaggccgcggatccatgggcgtcttcacggtgaccaagctgtccgagggccccgtgcggccgtccgccgccacgccgtcggggacgctgcccatggcctgggtcgaccggtacccgacgcaccgcggcctcgtcgagtccgcgcacatctaccgcaacgtcgacgacatgccggcgccggcatcggagcgagaggctggtggcactggcgccaaggccgccgccgccgccctcgccctgcaggcgccggacaaggaggcgatgatgaacggcagcaagtccccggccgcggtggtgcgcggcgcgctggcggacgcgctggtgcactactacccgttcgcggggcggatcgtggaggacgtccccggccggcccgctgctgctcgccaaggagcagctcgtgccgtgccgcacaacaccctcgccatgatacaggtcacgaccttcacctgcggcggcttcgtggtcggcctgcgcaccaaccacgcggtggcggacggcacgggcgcggcgcagttcctgaacgccgtcggcgacctcgcccgcgggctgccggagccccgcgtgaagcccgtctgggcccgggaccgcttccccgacccggacatcaagcccggcccgctccc

SEQ ID NO: 18202 - protein, 203 aa, Panicum virgatum
  misc_feature: Ceres CLONE 1796185
  misc_feature: SWISSPROT Homolog: EC 2.3.1.166 2-alpha-hydroxytaxane 2-O-benzoyltransferase
  misc_feature: Functional homolog of the protein sequence given in SEQ ID NO 50699
  misc_feature: Useful for making plants with altered carbohydrate content
MGVFTVTKLSEGPVRPSAATPSGTLPMAWVDRYPTHRGLVESAHIYRNVDDMPAPASEREAGGTGAKAAAAALALQAPDKEAMMNGSKSPAAVVRGALADALVHYYPFAGRIVEDVPGRPAAARQGAARAVPHNTLAMIQVTTFTCGGFVVGLRTNHAVADGTGAAQFLNAVGDLARGLPEPRVKPVWARDRFPDPDIKPGPL

SEQ ID NO: 18203 - DNA, 703 bp, Panicum virgatum
  misc_feature: Ceres CLONE 1796185-R
  misc_feature: Encodes the peptide sequence at SEQ ID NO. 18204
cgcgccatcggcgccgctcccggcgccgacgtcaggctctgcttyttcgccagcgcccgccacgtgctgaagctggagccggggtactacggcaacgccatcttccccgtgaaggtgtcggcgccggcggagaaggtggccgggtcgtcggtgatcgagctcgtcggcatggtgcgcgacgcgaagcggcggatggccgaggagtgcctgagctgggcggagggccgcaccggcgggcgcgacccgttccagatgaccttcagctacgagtccgtgtacgtgtcggactggagcaagctcgggttcaacgacgtggactacgggtacggcacgccggtgtccgccggcccgctggtgaactgcgacctcatcgcgtcggccatcgtcatgagggcgccggcgccgctcgccggcacgcggctgctggccagctgcgtcaccaaggagcacgccgacgacttcgcccgcaggatgcgggaggatctcgtgtgatgatgcgggcttgcatacgtgaaggaactcggccgccgtaccgtatgtccgtatcacatatctacctatctacgatacgtgtcatcgatcagagctagtggtggtgggagctacatacgaaatgggaattggtgttcctgtctggaccgtaactatatagtattgcactagttgttgtacaatgtgtgtgcaaatgaacaaattttcatag

SEQ ID NO: 18204 - protein, 163 aa, Panicum virgatum
  misc_feature: Ceres CLONE 1796185-R
  misc_feature: SWISSPROT Homolog: EC 2.3.1.162 Taxadien-5-alpha-ol O-acetyltransferase
  misc_feature: Functional homolog of the protein sequence given in SEQ ID NO 50699
  misc_feature: Useful for making plants with altered carbohydrate content
RAIGAAPGADVRLCFFASARHVLKLEPGYYGNAIFPVKVSAPAEKVAGSSVIELVGMVRDAKRRMAEECLSWAEGRTGGRDPFQMTFSYESVYVSDWSKLGFNDVDYGYGTPVSAGPLVNCDLIASAIVMRAPAPLAGTRLLASCVTKEHADDFARRMREDLV

SEQ ID NO: 18205 - DNA, 1804 bp, Panicum virgatum
  misc_feature: Ceres CLONE 1796190
  misc_feature: Encodes the peptide sequence at SEQ ID NO. 18206
agacctaatccaatcaagcatttacacgaaaacaaaagaagaaaacatgacgtgctgttcgctccaagaaggcccaagcagaggctcatgaagtccgctatgattgcagtactggcactgatgctggtttataggtgtggatacgtccaatgcgcgacggtcccccaggacagcacggacaatgctggccctgatcgatttcaggcaagcaatcaccggagatcccagaggattcttcaattcctggaataatagtgtcgactactgcaattggaatggcgtcacatgcagcaaaacgcaccgagggcgcgtcagggagctcaacctcacaggccagagcttggaaggccggatctctccatctcttgggaacttaaccttacttaagatactagatctctcctcaaataatctctctggtcagttgcccgatcttaaccgcctccgtaagctgcagatccttgttctggaattcaacaacttgcaagggcttgctcctaacgcacttaaaaactgttccagcctacaagctctaaacattgctggaaacatgttagcgggttcaatcccacctgaacttggtttcctccataaccttttggctctgaaccttgcatcgaatcatttcaatggatccatcccatcaagtctgggcaacatcactgaactagtgtatctcttcctaaatgacaatcagctcgaagggagcattcctacagagcttgggcaatcagcagagttgattcaattgggcttaggagagaataggctatcaggtagcatcccaacaacacttttgaaccattcttctcttgccattctggatgtgaatacgaactttctacttatggaattgccatctaccattggcaatacccttctgaggaatgagcagtactcactcctggctgtgatgagtgaattgtcaaccgtgcggtgtgatcgtgtgcttggtctttggttgcaggtacacgggcgtcgagtgtcgacggagagctatcgtggaggtgctgtgaccgatggactgtgcggtggatggcggtgaagggcagccgggaccggagctcgggccgggcggcagctgtggcgttcaatcctggatcaagggcgcaagcaccggtggatggcgggtttcttggtttgcgccacaaaaccaagctggcggacggcggttgaagacgccaagtcgtggaggcacgggcgtcggtctcgggactggcggaggaacgggcgttgacggcgtctagggcctcgctgcgggcgaggaggtgatgggcgtcgggcggcgtctagggccgtcagaaggccgaggcgggaacggcgtctagggccacggcgtggaggcgggaatcttcccgcgcgtggagttttggcggttttctcaaaaccggccacctacccgggtttcgtgaaccctccaaaaccgcagaccggatctttatcgacatggcggcatcgcggagaaggcttcgagtcgaagaaagaaacttcgccgtcggatgagatcttgtacccttttccggttttgcccctacgggcgttttatgttgttttatagagtggaggtcaaatctgggagggaccggtctgaccggtttgggaaaccggtctgaccggtcgccctcgaggacggatatatacatctcacctgcccccttggacaggtgagcctccaagccacgagtcattttctatttttccttgctcctccctgaaagtcccttgtttggttttggtaattgagtgacaacttaggtggactaataagtgtttatgtcgagatacacaggagattagtccatag

SEQ ID NO: 18206 - protein, 287 aa, Panicum virgatum
  misc_feature: Ceres CLONE 1796190
  misc_feature (2)..(37): Pfam Name: LRRNT_2 Pfam Description: Leucine rich repeat N-terminal domain
  misc_feature: SWISSPROT Homolog: EC 2.7.11.1 Non-specific serine/threonine protein kinase
MLALIDFRQAITGDPRGFFNSWNNSVDYCNWNGVTCSKTHRGRVRELNLTGQSLEGRISPSLGNLTLLKILDLSSNNLSGQLPDLNRLRKLQILVLEFNNLQGLAPNALKNCSSLQALNIAGNMLAGSIPPELGFLHNLLALNLASNHFNGSIPSSLGNITELVYLFLNDNQLEGSIPTELGQSAELIQLGLGENRLSGSIPTTLLNHSSLAILDVNTNFLLMELPSTIGNTLLRNEQYSLLAVMSELSTVRCDRVLGLWLQVHGRRVSTESYRGGAVTDGLCGGWR

SEQ ID NO: 18207 - DNA, 666 bp, Panicum virgatum
  misc_feature: Ceres CLONE 1796196
  misc_feature: Encodes the peptide sequence at SEQ ID NO. 18208
aacagaatcgctagctttttgccaacgaccaagaggtagcgagctcctgctcctcacgtttgtagtacagaagccgggtggcggcggcgggcgatcggcggcgagcgcatgggcaacgccctggggtgcgccggactcggcgagcggctggcggccgccgcgagggacggcgacgcggcggaggtgcggcggctgctggaggcgaacccggggcacgcgcggtgcgccgccttcggcagcctcaactcgccgctccacctcgccgccgccaaaggacaccacgagatcgctgcgttgctgctgcagaacggagctgacgcgaacgcccgaaacatttacggacaaacggcgttgatgcaagcgtgccggttcggccaatgggaggtggttcagacgctgctggttttcagatgcaacgtgtcgaaggtggacagcctcagcagccggacggcgctgcacctcgcagcggccggcggacacgtcaagtgcgccaggctgctgctggccgcggccgccggcgacggcggcaggttcgtgaacagggcgggcagcggcggcgtcacggcgctgcacctcgcggcgctgcacggccacgccgactgcgtgcacctgctcatcgacgagcacgccgacctcgccgcgcagaccctcccctgcgtcgcgtcg

SEQ ID NO: 18208 - protein, 185 aa, Panicum virgatum
  misc_feature: Ceres CLONE 1796196
  misc_feature (44)..(76): Pfam Name: Ank Pfam Description: Ankyrin repeat
  misc_feature (149)..(181): Pfam Name: Ank Pfam Description: Ankyrin repeat
  misc_feature (77)..(109): Pfam Name: Ank Pfam Description: Ankyrin repeat
  misc_feature: SWISSPROT Homolog: EC 2.4.2.30 NAD(+) ADP-ribosyltransferase
MGNALGCAGLGERLAAAARDGDAAEVRRLLEANPGHARCAAFGSLNSPLHLAAAKGHHEIAALLLQNGADANARNIYGQTALMQACRFGQWEVVQTLLVFRCNVSKVDSLSSRTALHLAAAGGHVKCARLLLAAAAGDGGRFVNRAGSGGVTALHLAALHGHADCVHLLIDEHADLAAQTLPCVA

SEQ ID NO: 18209 - DNA, 669 bp, Panicum virgatum
  misc_feature: Ceres CLONE 1796196-R
agtctgcctggaaagaccctgcaacgtagctgccgaagtgtgcgggcacgagctgtgcgtcaagtgcgcgctggacctgtgctcggtgatcaagtcctacgacgtgccggggatcgccggaagcatcccgtgcccgctctgccggagcgcgatcgcctcgttcaggaaacgggcagcctcggaagcagaggacgggctcgagcctgacctgagcgccgcctgctccggcggcagccactgcaagagctgcagcagcgccggcgaccaccaggcgtcgtccagcccggagaagaaacggagcacggattcggatcagcccatcggcatcctccccctctactctcctcccgccgtcctgtcctgaaggtcgtcagggttgcagttgcagctcgatgcgtgttagcagatgcagaggagctgcatcaccattagaacaatgtgcagtattatgcaagtacagataggtagattgctcagggacagacagattgtttgattctcttgcgttcgttgtgctaatcgatggcatttgcagatcattttatggcggtgtacatagtatgggtgtaacgtgtacgtctgattggtttgttgtagagtggttgtgttgtagaaaggaactaaaaagaaagaacattctttgctgtaaaaggttctggattttgactc

SEQ ID NO: 18210 - DNA, 215 bp, Panicum virgatum
  misc_feature: Ceres CLONE 1796204
  misc_feature: Encodes the peptide sequence at SEQ ID NO. 18211
gggatcatgcgccctctgccccgccgcggggacggcatccttctccgacgggcgcgacggcccgctcggcccccacgccccgggggagaccgcgctgagggcacccgctgacgccttgttcgcggtggcgatcctcgggttcgggcgcatcggccggaacttccgccggtgctggctcggccgcatggactccccgctcgatggcatcgtcctcc

SEQ ID NO: 18211 - protein, 71 aa, Panicum virgatum
  misc_feature: Ceres CLONE 1796204
  misc_feature (2)..(71): SWISSPROT Homolog: EC 1.2.1.13 Glyceraldehyde-3-phosphate dehydrogenase (NADP(+)) (phosphorylating)
  misc_feature (42)..(67): SWISSPROT Homolog: EC 1.2.1.59 Glyceraldehyde-3-phosphate dehydrogenase (NAD(P)(+)) (phosphorylating)
GSCALCPAAGTASFSDGRDGPLGPHAPGETALRAPADALFAVAILGFGRIGRNFRRCWLGRMDSPLDGIVL

SEQ ID NO: 18212 - DNA, 2146 bp, Panicum virgatum
  misc_feature: Ceres CLONE 1796205
  misc_feature: Encodes the peptide sequence at SEQ ID NO. 18213
aaaacatccacacgctaaggaaggggcccaggaagccaggagaaacggagcagaagcaccggtccacctgttgctcctacctcgccgggcgccgccgccgccgcctcacgagcccccacgagctcccgcccgcaaacctcgccatgagcgcagccgcacctagccgccgcacccgcagccggccgccctcggcctcctcccgcaagtccgaagacccctcggccgccgccgccgccgccgccgccgccgccaacgggaatgggaacgggaaggtcgcctccaagcccgcctctccccaccagctcacaggggagaggacggtgaagaagctgcgtctgtccaaggcgttgacgattccggaagggacgacggtgtcggatgcgtgccggcggatggcggcgaggcgggtcgatgccgtgctgctcaccgacgcccaaggcctcctttcaggaatagtcaccgacaaggacatagctacaagggtgattgctgaggggcttcgggtggagcaaaccatcatgtccaagatcatgacacacaatccaacttatgtgatgtctgacacgcttgcaattgatgcattgcagaagatggttcaagggaaatttagacacctccctgtagtagaaaatggtgaggttattgctatgctggacactgcaagatgcctatatgacgcaatagcaagactggaaaaggctgcagaacaaggaagtgcgatagcagctgctgttgaaggggttgaacgtcaattaggaggcaacttttcagctccttctgctctaattgaaactctaagagagaggatgttcaaaccatctttgtcaaccatcatcacagagaacacaaaggtagcaattgtttcgcctacagatcctgtgtgtgtagcagcacagaaaatgcgagagtttcgagttaattcggtggttgtcgctacaggaaacacattgcaggggatatttacctcaaaagatgtacttatgcgtgttgtcgcacaaaatatttcccctgagttgaccctagtagaaaaggtgatgactgccaacccagattgtgccacattggatacaacaattcttgatgcattacatataatgcatgatggcaaatttttgcatattcctgttattgacagagatggacaaattgctgcttgcctggatgtcctacagcttacccatgcaaccattcaattggttgaaggagggaatggaactgtaaatgatgtagcaaactcagtaatgcagaggttctgggactctgctcttgctttggagcctccagatgaggaatttgatagccatagtgaggtatctttactcctgccgtcagaggctggagatggaaagagtaatgtttaccccactgcgattggcaattcatttgcctttaagcttcaagacagaaagggccgtgtgcatagattcacttgtggctctgagagcttggatgagcttgtctcttctgtaagacaaagattaaatattacagatgaaaaggaaacagtacaactcttgtatgaagatgatgaaggtgaccgagtgctgctgacaacagactccgatctggccggtgctgtgctctttgccaaatcatctggattgaaggtgctgaagttgcacatcgaagacccgggtttgtatactgaagtgacaaaaccatcacaggagatggctccacctcccagcaggagtgggatatcgccagttcatgttggattgatggccagtgcagttgctctcagtgccgtagcagtgatgctttacttgaaacgatctcagctgtgatttccctttttttccccatttttctgaagagcggggatcggtggcattccaaattagcattgccatcagctaatgctcactcggtaccagctaatatcacatccgtggtctgttgaactcacggtccagggtccagacaggtcacgggacaagattgttgcttttggagtaggtgaatttctggcagatgagcctgcctatgctcgttcattctgcacgaacgtgaacagtttcacgactacggtgtaatgtctaagcattacatatgcgttgactgttcattcttatgtgtgcttgtctatatagataaaccgatgaattgagctcgtttcagcagatgacactgctgtttcagattc

SEQ ID NO: 18213 - protein, 547 aa, Panicum virgatum
  misc_feature: Ceres CLONE 1796205
  misc_feature (62)..(180): Pfam Name: CBS Pfam Description: CBS domain pair
  misc_feature (231)..(349): Pfam Name: CBS Pfam Description: CBS domain pair
  misc_feature (413)..(497): Pfam Name: PB1 Pfam Description: PB1 domain
MSAAAPSRRTRSRPPSASSRKSEDPSAAAAAAAAAANGNGNGKVASKPASPHQLTGERTVKKLRLSKALTIPEGTTVSDACRRMAARRVDAVLLTDAQGLLSGIVTDKDIATRVIAEGLRVEQTIMSKIMTHNPTYVMSDTLAIDALQKMVQGKFRHLPVVENGEVIAMLDTARCLYDAIARLEKAAEQGSAIAAAVEGVERQLGGNFSAPSALIETLRERMFKPSLSTIITENTKVAIVSPTDPVCVAAQKMREFRVNSVVVATGNTLQGIFTSKDVLMRVVAQNISPELTLVEKVMTANPDCATLDTTILDALHIMHDGKFLHIPVIDRDGQIAACLDVLQLTHATIQLVEGGNGTVNDVANSVMQRFWDSALALEPPDEEFDSHSEVSLLLPSEAGDGKSNVYPTAIGNSFAFKLQDRKGRVHRFTCGSESLDELVSSVRQRLNITDEKETVQLLYEDDEGDRVLLTTDSDLAGAVLFAKSSGLKVLKLHIEDPGLYTEVTKPSQEMAPPPSRSGISPVHVGLMASAVALSAVAVMLYLKRSQL

SEQ ID NO: 18214 - DNA, 1916 bp, Panicum virgatum
  misc_feature: Ceres CLONE 1796208
  misc_feature: Encodes the peptide sequence at SEQ ID NO. 18215
atccgcacatgtaggcgccacagatccgacccgcccccgctcctgtccgcgaggccggcgagggagccaagctaccaaaccccatccaccctcccgccaccggcacgaccccaatccagtgcccagggcgatgctgctccgcagggtgtggggatccgtgctcgcgcgcgcggcgccggggcccagcccggcgcctccaggctcccggcggggccgccgcgcgcagccgcccgccgagcagtactgcgcgtcgctgtcgctcggcgcgctcgacgccgtcccgaccgacgtggtcgcccagatcctgcgcctgctcggccccgtcgaggccgcgcgctccaccgccgtctgccgcgcctggcgcatcctcgcctccgacaacggcctgtgggccttcttcctgcgcctcggccccgagccatgggacctcgtcgtcttcgccgagacgcacctcgctgccggccccgattcgcacccgtggctgtacttcgataacacgccgcagctctcgttcaaacagatttacggcctccgagcggtggtcccgggtactctcatagtggatggtggatctgggtattgcaagtacggctggagcaagtatgctgctccttctgggcgttgtgcgacattcttggaatttggtaacattgaatcacctatgtatgcgaggcttcgtcacttcttctctacgatctatacgaggatgcaagtaaagccttccactcaaccagttattgttgtccttccactgtgtcataccgatgataccgagtctgctagggcctcaagaaagcaatacaaggagacgatatactctgtcttgtttgatatgaatgttcctgctgtttgcgctgttgatcaagcagttttatctttgtatgcttctaaaaggacctccggaatcgttgtccacattggattcaataccacttctgttgttcctatttttgaaggcagggtaatgtatgagataggtgttgaaactgtggggcaaggagcccttaaactcactggatttcttaaggagttaatgcaccaaagaaacatatcttgtgagtcactgtatactgtccggaccatcaaggagaaactttgctacgtagcagctgattatgaagctgaactacgtaaagatacgcaagcttcttgtgaggttgacggtgaagggtggttcactctgtcaactgagagattcaagactgcagaaattctatttcagccccatatgggaggaatgcgtgctatgggcttgcataaagcagtagctctatgtatggatcactgctacaattcagaagtagttggtgatgacagctggtacaagacaattgttttatctggtggatcgtcatgtttacctggtttaccagagaggctggagaaagagcttcgtcaacttcttccaccttacatctctgaaggaataagggtagttcctcctccatttggcattgattctgcctggtttggtgcaaagatgatcagcaatgtgagtactttcactgaggcatggtgtgtgaagaagaagcagttccgccagaagataggcaggaatggtccattgtttgtgaatgcttggtaataagtatcccatatacagttatgattgcacaacaatcagcaacaagtcgtgatcgagaaataaacatggagtttccatggagctatcctctatgggttcacagcatccagttcaggctccattattaagtatgaataattacatgtatcatgtatatggattatgagcaaaagcaccatagattattgttgttatagcatgtttttgtgagtttactgttaatagagaatgttcgaggaaacaattctttcgctattggatttaagtcgtctttgtaattattcaagtttgagtttggtacagtaataaatgttgtcatatattatagacc

SEQ ID NO: 18215 - protein, 484 aa, Panicum virgatum
  misc_feature: Ceres CLONE 1796208
  misc_feature (140)..(469): Pfam Name: Actin Pfam Description: Actin
  misc_feature (45)..(92): Pfam Name: F-box Pfam Description: F-box domain
MLLRRVWGSVLARAAPGPSPAPPGSRRGRRAQPPAEQYCASLSLGALDAVPTDVVAQILRLLGPVEAARSTAVCRAWRILASDNGLWAFFLRLGPEPWDLVVFAETHLAAGPDSHPWLYFDNTPQLSFKQIYGLRAVVPGTLIVDGGSGYCKYGWSKYAAPSGRCATFLEFGNIESPMYARLRHFFSTIYTRMQVKPSTQPVIVVLPLCHTDDTESARASRKQYKETIYSVLFDMNVPAVCAVDQAVLSLYASKRTSGIVVHIGFNTTSVVPIFEGRVMYEIGVETVGQGALKLTGFLKELMHQRNISCESLYTVRTIKEKLCYVAADYEAELRKDTQASCEVDGEGWFTLSTERFKTAEILFQPHMGGMRAMGLHKAVALCMDHCYNSEVVGDDSWYKTIVLSGGSSCLPGLPERLEKELRQLLPPYISEGIRVVPPPFGIDSAWFGAKMISNVSTFTEAWCVKKKQFRQKIGRNGPLFVNAW

SEQ ID NO: 18216 - DNA, 2451 bp, Panicum virgatum
  misc_feature: Ceres CLONE 1796226
  misc_feature: Encodes the peptide sequence at SEQ ID NO. 18217
gacatatacatactagtggtagtagtagaattgtagaaatgccgcaaatgctctcgtcttcgtctgtctatcgatccaattgttgagttgcaatccaacccagagaagaggggcactgcagcctgtcagtgtcagtcttgtctgcaacttactgcacactggagcaacttctctgctgctgctgctgctgctgctctgcaagaagttaagatcgatccagattactcttccgtcttctaccccggcgcggccggccggcggtcgatcgagatgcggcccggcgccgcgggcatctgcgcactcctgctgagcctcctcctccctgcctccatcgcctttccgctatgcaccgacgcgagggcgccggtgctgctcaacaccacgctcaagttctgctcctcctccggcagcacaagcagtagcagctgctgcgatgccgccgccgacgccgcgctcagcacccagttcgacgccatgaacgtctccgacgccgcctgcgccgccgtcctcaagtcaatcctctgcgctaaatgcagcccatattctgctgatttgtttgatgctgggccaaagattcggacaattcccttcctctgcaactccacctcctcagcaacttctgcccagtccaaggaaaccactcaggatcaggactactgcaaacatgtctgggaaacttgcaaggatgtcaaaataacgaactctccctttcaaccacccctgcaaggcagtgcaccgcctccgacctcatcaccgtcgaagctgactgatgcctggcaatccgaaagtgacttctgtacctcgtttggtggtgcacccaatgatcagtctgtatgcttcagtggcgacacggtttcattcaacgccacccagccttcgccctctcctaaagggatatgcctggagaggattggtgatggatcctaccttaacatggctcctcaccctgatggatccaatagggtcttcttgggcagccaagctgggaagatatggctggcaactgtccctgatcaaggatccgggggcactctacaattcgaagaagctagcccattcgttgatctgactgatcaggtgcactttgattcagcatttggactcatgggtatggcgttccatcctgactttgcaaccaatggccgtttctttgcatcttacaactgcgatagaacaaagtcacccagctgtacgggaagatgctcatgcaattctgatgtgggctgtgatcccacgaagctaggtaccgacaatggtgctcagccatgccagtatcaagtggtgatttcagaatattcagcaaaaggttcctcggcaaacgtttccgaggctacatctgctgatccatctgaggttagaaggatttttactatggggctgccttatacatcacaacatggaggccaggtactttttggacctgatggctacctctacctcatgatgggggatggtggaggaaagggagatccttttaatttcgctcagaacaagaagtcactcttgggaaaaatcatgaggcttgacattgacagtacgccgagagcaagtgaaatcagtaacacgagtttgtggggaaattattctattccaaaagataacccgtatgctgatggtagcgagttacaaccagaaatttgggcactgggtcttagaaacccgtggaggtgcagttttgattctgagaagccatcctacttctactgtggagatgttgggcaggatcaatatgaagaagtggatttgatctccaaaggtgggaactacggatggcgtgcgcttgagggtcctcttgtttaccatccaccatgggcaccaggaggcaacacatcacttgactccataaacgccatcccacctatcatgggttacagtcactctgatgtgaataagaacatcggatccgcatcgatcatgggaggttatgtctatagagggtctgctgatccctgcttgtatggaaggtacttgtacgccgacctgtacgcttcggccatgtggaccggcacagaggccccggagagcagcgggaactacacctccactctgattcccttcagctgctccaaggattctccgatcgcctgtgagacagctgctgggagctctctcccgtctcttggctacatatactcctttggcgaggacaatagtaaggacatctttttgctgacgagcaaaggtgtctaccgagtcgtcaggcccagcctctgcagctatacctgcccaacagagaaacctgcgacgaacagcgggagaacgcctcctggttcttcatcaaaggcgccagcagccatggcactgagcaatcagatgggaatgcttttgctgtctgttattatgttttgggtcttgataagataggatccttctctgagtcagtcatgtgcaaggatggatgatgatacgctccatactttacgaagaaaccgaaataagaatgtttcagcg

SEQ ID NO: 18217 - protein, 697 aa, Panicum virgatum
  misc_feature: Ceres CLONE 1796226
  misc_feature: SWISSPROT Homolog: EC 1.1.5.2 Quinoprotein glucose dehydrogenase
MRPGAAGICALLLSLLLPASIAFPLCTDARAPVLLNTTLKFCSSSGSTSSSSCCDAAADAALSTQFDAMNVSDAACAAVLKSILCAKCSPYSADLFDAGPKIRTIPFLCNSTSSATSAQSKETTQDQDYCKHVWETCKDVKITNSPFQPPLQGSAPPPTSSPSKLTDAWQSESDFCTSFGGAPNDQSVCFSGDTVSFNATQPSPSPKGICLERIGDGSYLNMAPHPDGSNRVFLGSQAGKIWLATVPDQGSGGTLQFEEASPFVDLTDQVHFDSAFGLMGMAFHPDFATNGRFFASYNCDRTKSPSCTGRCSCNSDVGCDPTKLGTDNGAQPCQYQVVISEYSAKGSSANVSEATSADPSEVRRIFTMGLPYTSQHGGQVLFGPDGYLYLMMGDGGGKGDPFNFAQNKKSLLGKIMRLDIDSTPRASEISNTSLWGNYSIPKDNPYADGSELQPEIWALGLRNPWRCSFDSEKPSYFYCGDVGQDQYEEVDLISKGGNYGWRALEGPLVYHPPWAPGGNTSLDSINAIPPIMGYSHSDVNKNIGSASIMGGYVYRGSADPCLYGRYLYADLYASAMWTGTEAPESSGNYTSTLIPFSCSKDSPIACETAAGSSLPSLGYIYSFGEDNSKDIFLLTSKGVYRVVRPSLCSYTCPTEKPATNSGRTPPGSSSKAPAAMALSNQMGMLLLSVIMFWVLIR

SEQ ID NO: 18218 - DNA, 1768 bp, Panicum virgatum
  misc_feature: Ceres CLONE 1796234
  misc_feature: Encodes the peptide sequence at SEQ ID NO. 18219
actccaaatcatccggcagtccggtaaccctccctcccgagtcctctcggcccccgccaccaccaccaccactgccaactcgagttcccctccccggcggcggctcgctgacggagagaaccccactcacttacctagggttcccgtaaccctagccccgacccgtacgcgcgagggccccggcgacacgaggaggaggcggcggagaggggagggggcggaaggcgcgggaggcgcaggcctgtgctgtatgtcagatcgtgggagccggcgaggcggaggcggaggcggagactacggacacggtcagctcgcgaacccgctccaatggccgcaactcaggaaaaggcgtcggcatgctgccgcgccgcgcccgcgcgcgtcgctggaggcgccgccgccgtccccgtgcgggcgatcgccgcgcccccgcccgggaaggtcgtcgccatcgcctcggggtccggtgagcgcgtggccgcgtccgctgccggcgcgggcggcgccgtgatcgaggagatggccgcggtccagcccacaacggcgaaggcctcctccaaagggataccaataatgacaagagcccagaggtgccaccctttagacccattatctgctgctgaaattgcagttgctgtagcaactgtaagagctgctggaagatctcctgaggaaagagatagcatgcgttttgttgaagttgtactgttgacgcagacaccacagaccgcagggcaccccgtgtcggcagctgagcagaagcagcgagcgatccatggcggcccaggctctcctctccgggcggcagctgctcggccgccccgtgcagtcggctgtctcccggtcctcgtcggccaggaaggcgcccttcgtcgtcagggccagctccagcccgccggccaagcaaggcgccgaccggcagctgtggttcgcgtccaagcagtccctctcctacctcgatggcacgctgcccggcgactacggcttcgacccgctggggctgtcggacccggagggcaccggggggttcatcgagcccaagtggctggcctacggcgaggtgatcaacggccggttcgccatgctgggcgcggcgggcgccatcgccccggagatcttcggcaagctgggcatcatcccggcggagacggcgctgccgtggttcaagacgggggtcatcccgcccgcgggcacctacaactactgggccgactcgtacacgctcttcgtcttcaacatggcgctcatgggcttcgccgagcaccgccgcctccaggactggtacaacccgggctccatgggcaagctgtacttcctcgggctcgagaagttcctcggcggctccggcgacccctcctacccggggggcccgctcttcaacccgctcgggttcggcaagacggagaaggagatgaaggagctcaagctcaaggagatcaagaacggcaggctcgccatgctcgccatcctcggatacttcatccaggggctcgtcaccggcgtcggcccctaccagaacctgctcgaccacctcgccgaccccgtcaacaacaacgtgctcaccagcctcaagttccactagatgccgccgccgccgccgccgcctgttgtcgttgtagtggaagcgagaggtgatcgtcgatgtgctgttcatatgctggcgggctggctggctgatggaagaggtttgcatcgtgtatgatctatccatggccggcctgcttgctgcttgtaacaaattagtaaatccatcctgttaattgagacc

SEQ ID NO: 18219 - protein, 268 aa, Panicum virgatum
  misc_feature: Ceres CLONE 1796234
  misc_feature (56)..(239): Pfam Name: Chloroa_b-bind Pfam Description: Chlorophyll A-B binding protein
MAAQALLSGRQLLGRPVQSAVSRSSSARKAPFVVRASSSPPAKQGADRQLWFASKQSLSYLDGTLPGDYGFDPLGLSDPEGTGGFIEPKWLAYGEVINGRFAMLGAAGAIAPEIFGKLGIIPAETALPWFKTGVIPPAGTYNYWADSYTLFVFNMALMGFAEHRRLQDWYNPGSMGKLYFLGLEKFLGGSGDPSYPGGPLFNPLGFGKTEKEMKELKLKEIKNGRLAMLAILGYFIQGLVTGVGPYQNLLDHLADPVNNNVLTSLKFH

SEQ ID NO: 18220 - DNA, 2388 bp, Panicum virgatum
  misc_feature: Ceres CLONE 1796243
  misc_feature: Encodes the peptide sequence at SEQ ID NO. 18221
atgcatcatcgagttgggcaatcatcgatctgccaagcgcccaagcaagatggcttagtagggcatggcatgtgcaactatacctggcatggctctcggtggccacaaacgacggacggacggacggcctgccggacagacaggcttcaagtccagtccaccaaattgtacttgaatattggttctgcatcctgcagttgcttcaagcctttctttacagggaacaggtactccgcctccctatgctatgattcccaataagcattggctgtagctgttgcctcctgccctgatccctgacatcgatcggctgcttgcttgctttctctgtcctcagtagtgtttctttgctgcttgctcggagtttgacttgtgtgagtccatccttgtgtgcctgttctaactctgatgactcttaaatccaatctatcttccgagtgtggtgtggattctttacttgaacatacagccgcacttccaagatcctcccctacttctctgtctcgttctcacaagttccacatctgctatccctttttcatcctaggaattgaccaagcacgcccttagctttatgatacgtacgtatcttgcaggggaggggacggacaaatcacaaatggagattattccatcatggcaactcgattcgtttcttgaggtgctatgcaatccaatccaatccaacggccccttccacagctaccgcaaaagatggatgtggtgagctttccgacatctagctagctttgcttgcttgcttgcacaagtccgtccgtcagtcagtcagtcaatccccactcttcacagtagactagagagaagagatcagagctctgatcttggacttggccacagaaatggagaagatcaaagctgcggcctatttgctattcttctccttgcttgtgtctcacacacttggctcatgtgcttccatcaatcaacaagggaaaactcttttcagatctggagcagatacaccagctggatcttcctcaaaccggggactgagttgctcagacgaaggcaaggcggtgaccttaaaaggtaggagtgtcatccagagacggctcctacatcaatgggatcaccaagttgcagaatcacccaagtctaatggaaatggatctgaaagaaggacgataccccactgggccatccacacattagccatcagtggagcagttctctttgtggttgcatctgcaaccgccatgtatctactcttttctcgtcgaaagaaggataatactgtcatgccttggtctactgggctcagtggaccgctcaggaaagccttcgtggcaggtgttccttctcttggaaggacagagcttcagacagcatgtgagaacttcatcaatgtgatcggctcttcatccgaatgcatagtgtataaaggaactctgtcaagtggagttgaaatagcggtagtctccacttcagttgactctgccaaagattggtcagatagctctgaggagcaatttaagaacaagatctctatgttgtccaaagtgaaccataagaacttggtgaacctacttggttactgcacatgcgacgagccgttcacaagaatgatggtcttcgagtatgctccgtgtggttccctctttgaacacttgcatattcgagaagcagaagatttggactggcctacacggctgcgcatcatcatgggagtagcatactgcttggagcacatgagccagctggacccacctgtgatgccagcagccctgagctcctcatccatctacctcaccgaggactgcgcggccaagatctcggacatggagttgtggaaagttgcagcgccgggagatgaagagagcatcgtgtacaggtttggcatcctgctgctggaggtgatctccggtcggctgcccttgtccaaggaccacggcctgctcgtgctgtgggcgtccagctacctggacggcaagaggccgctgaatggcatggttgatccgatgctgaggtcgtccgtgcgtgacaaggatctggcggtgctgtgtgacgttgtgaggctgtgcatccactctgacaaggacaagagaccggccatggctgaggttgccaggctcatgagaggcgccaccgccgtgtcgccggagcaggcgaccccgagagacaacccactatggtgggccgagcttgagattgcctccaccacggtggagtccgggtgaaattcacaaccaaacgggcacgacatgcatgataactagtactatactgaattgcctctttgctttcgttctttgtgtcatcaatcagttccttttgctgtatactatgtagtataactttagctgctgatcacggtgattctgcaaatttgtacaagtggagaacaagaaatagcatttgttgttccag

SEQ ID NO: 18221 - protein, 445 aa, Panicum virgatum
  misc_feature: Ceres CLONE 1796243
  misc_feature (166)..(412): Pfam Name: Pkinase_Tyr Pfam Description: Protein tyrosine kinase
  misc_feature: SWISSPROT Homolog: EC 2.7.11.1 Non-specific serine/threonine protein kinase
MEKIKAAAYLLFFSLLVSHTLGSCASINQQGKTLFRSGADTPAGSSSNRGLSCSDEGKAVTLKGRSVIQRRLLHQWDHQVAESPKSNGNGSERRTIPHWAIHTLAISGAVLFVVASATAMYLLFSRRKKDNTVMPWSTGLSGPLRKAFVAGVPSLGRTELQTACENFINVIGSSSECIVYKGTLSSGVEIAVVSTSVDSAKDWSDSSEEQFKNKISMLSKVNHKNLVNLLGYCTCDEPFTRMMVFEYAPCGSLFEHLHIREAEDLDWPTRLRIIMGVAYCLEHMSQLDPPVMPAALSSSSIYLTEDCAAKISDMELWKVAAPGDEESIVYRFGILLLEVISGRLPLSKDHGLLVLWASSYLDGKRPLNGMVDPMLRSSVRDKDLAVLCDVVRLCIHSDKDKRPAMAEVARLMRGATAVSPEQATPRDNPLWWAELEIASTTVESG

SEQ ID NO: 18222 - DNA, 2573 bp, Panicum virgatum
  misc_feature: Ceres CLONE 1796244
  misc_feature: Encodes the peptide sequence at SEQ ID NO. 18223
gcaaggctgctgctgctgtccccatccctccctccttccctccctctctctctctagattccaatactttcctctgttcctgggcaagcccctgaggtgaggccgtgaggggaggggggaggcgctgcccagcctactctagcctgggtctggagagagagaagacgagggagtaatacaacagaaccgaggaaggagagagaaagaggagcagagaacccaaagaggcaaggcaagcaagtagggagaagccccaagattgggggcgactgatcagggcgaggagcagaggcgccgtctcttggattcgcgccgccgtctcctggggggcaagtgttgttgggttcgccggcgccgcggatggccggcgtggacgcggcgaggtatgcgcacagcccggcgcaccacgccgtggcgacgcgggaccacgccgcgctgcgccgcgtgctggatgcgctcccgcggggccgccggcccgaggagatccggacggaggcggactccgtcgccgaggaggcccgcgccgaggccgtctcggcggtcatcgaccgccgcgacgtgccgggccaggagacgccgctccacctcgccgtgcgcctcggcgacgccgcggcggccgagatgctcatggcggcgggcgcggactggagcttgcagaacgagcagggctggagcgcgctgcaggaggctatctgcgcgcgcgaggagacgctcgcgcacgtcatcgtgcgccactaccagccgctcgcctgggccaagtggtgccgccgcctgccccgtctcgtcgccgccatgcgccggatgcgggacttctacatggagatcaccttccacttcgagagctccgtcatccccttcatctcccgcatcgctccctcggacacctacagggtctggaagcacggcgctaacctccgcgccgatatgaccctcgccggcttcgatggcttcaagatccagcgctctgaccagaccatactcttcctcggtgagggcactgaggacggcaaggtgccgccagggtcgctgttgatgatcaaccacaaggacaaggaaattatgaatgcgctggagggggcaggcgcaccggcctcagaggcagaggtccagcaggaggtcactgcaatgtcgcagactaacatcttccgtccaggaattgatgtcactcaagcggtgctgctcccacagctcacatggcggcgccaggagcggacggaggcggttggcccatggaaggcgaaggtgtatgacatgcaccatgtggtggtcagcgtcaagtcaaggagagtcccaggggcgatgacggatgaggaattcttctcagcttgcaatgacaatgatacggagagtgaggggttcgatgatgttctgactgaggaggagaagaagcagttggaggctgcgctaaaaatggactctccagatgctggtggtgaagaccagtctgactcatttgctggccctcggcatagttgcgttgagctgagggagagggagataccaattgaggacgtgactgtctctggaaatggggagagtaagcatgataagaaaggttggtttagtaattggggaaagagatgtcaggctagcaagccggatggggtgaagaaggtggcacctccaaggagttcgctctgtgcagatgagaaggtgagcgacctcctcattgaatcgccatcaaatgtaccaacaagaccgggaaggcattcagtagatgtagtcagagcaaatgacaacagaaggatcagagaaagggataataggagacatgctgcttccacagagaatgagcataggcgcagggaaggttccaaagaaagcgagtacaagaaaggcctaaggcctgtgctgtggctctctccaaacttccctcttcgaactgaggagctcctgccattacttgatattcttgcaaacaaggtgaaggcaatccatcgtttgagggatctacttacaacaaaactgcctccaggaacatttccagtcaaggttgccattccggttgtaccgacgatcagggtgcttgtgacattcacaaaatttgaagaactacagccactagaggagtttaccacaccaccctctagtcctgacaacagcaagagcccagcagtacagccttcttcaagttcctggattcagtggatcaaggctccttaccgccagaacttctcggctcctggcccgagcagccgtgtggaggacatccaggacccgtttgccatcccttcagattatgtctggacaacgccagaagagaagaaaaagaagacacaggaaaacaaaaacaagtcgaagaaaggcaggaacggatcttagatagatgttagcattggttggggaagggggattacgttgtgctgcgggtgaaatgggctatactcgtctaacaggagggatgatggaagatttggagattcgaccgctgtctgatgtcgaatgccgagaagtgaccgcttgtcttctttcatcatgttaacagatttgttgtcaacattctttcataacctgaatcgtttcggccctgattatcgttgcaatctattggtagattttggccggtggcttct

SEQ ID NO: 18223 - protein, 653 aa, Panicum virgatum
  misc_feature: Ceres CLONE 1796244
  misc_feature (69)..(101): Pfam Name: Ank Pfam Description: Ankyrin repeat
MAGVDAARYAHSPAHHAVATRDHAALRRVLDALPRGRRPEEIRTEADSVAEEARAEAVSAVIDRRDVPGQETPLHLAVRLGDAAAAEMLMAAGADWSLQNEQGWSALQEAICAREETLAHVIVRHYQPLAWAKWCRRLPRLVAAMRRMRDFYMEITFHFESSVIPFISRIAPSDTYRVWKHGANLRADMTLAGFDGFKIQRSDQTILFLGEGTEDGKVPPGSLLMINHKDKEIMNALEGAGAPASEAEVQQEVTAMSQTNIFRPGIDVTQAVLLPQLTWRRQERTEAVGPWKAKVYDMHHVVVSVKSRRVPGAMTDEEFFSACNDNDTESEGFDDVLTEEEKKQLEAALKMDSPDAGGEDQSDSFAGPRHSCVELREREIPIEDVTVSGNGESKHDKKGWFSNWGKRCQASKPDGVKKVAPPRSSLCADEKVSDLLIESPSNVPTRPGRHSVDVVRANDNRRIRERDNRRHAASTENEHRRREGSKESEYKKGLRPVLWLSPNFPLRTEELLPLLDILANKVKAIHRLRDLLTTKLPPGTFPVKVAIPVVPTIRVLVTFTKFEELQPLEEFTTPPSSPDNSKSPAVQPSSSSWIQWIKAPYRQNFSAPGPSSRVEDIQDPFAIPSDYVWTTPEEKKKKTQENKNKSKKGRNGS

SEQ ID NO: 18224 - DNA, 2525 bp, Panicum virgatum
  misc_feature: Ceres CLONE 1796245
  misc_feature: Encodes the peptide sequence at SEQ ID NO. 18225
ttcgccgctgcctccttccccctcctcctccccgattgcgccgccccgcgattggcctcgccaacccgcgcccgccgccgcagtataaatccggcccgagcgagccctccgcgccgtccccaccgcgctccgaccacaaccctagcggcgcgcgccggcatgggctagggttcccccgcggcaaagatggagtgggatagcgactccgacggcggcggcggcggcggagacgaggatgaggaggaagaggaggaggaggaggaggtccaggccgggaccgggcccccggggttctcgctggccatcgagggcgtgctgggcgcgtgcgggatggtggtctccgacgcgctcgagcccgacttccccatcatctacgtcaaccgcgggttcgaggacgccaccgggtaccgcgccgaggaggtgctcgggaggaactgccggtttttgcaatgcagaggaccatttgctcagaggagacatccccttgttaatgctgcagtagttactgggattcggagatgtttagaggatgggaccaaattccagggtgatctgttgaattttagaaaagatggttctccatacatggcaaagctgcaattaacaccaatatatggagacgatgacacaataacacactatatgggcattcagtttttcaatgattccaatgttgatttggggccatctcctggctctgtaacaaaggaacttgtgagatctacatggattgcaccagataacactcccccaccgtcttcagtgggcaagggtaacttatgggaacattctagtctcttcctactgagtgatgaggtactgtgccaaaagatcttctcaaaactgtcacccagagatatagcctctgtaaactctgtttgtaagagactgtaccacttgacaaagaatgaacacctttggaggatggtttgtcagaatgcatggggcagtgacgctactcggacccttgagagtgtggcaggatcaagaagtttagcttgggaacggctagctcgagagttgaccaccctggaagctgttgcctggaggaaattgacaatcggtggtgcggtggagccatctcggtgcaacttcagtgcctgcgctgtagggaaccgtgttgtcctttttggtggagaaggtgttaacatgcagccaatgaatgatacatttgtgctggatttgagtgccagcaagccagaatggaggcacgtccatgtgagctcggctcctcctggtcgctggggccataccttatcatgcctaaatggatcacggctggttctgttcggtggctgtggggggcaggggctactgaatgatgtcttcattttggatctggatgcacagtatccaacttggcgcgagattcctggccttgcaccaccagtgccacggtcgtggcatagctcctgcacagtggatggtacaaagctggtggtttctggtggctgtgctgactctggtgtacttctaagcgatacctacctcctagatgttacaatggaaaaacctgtgtggagggagatacctgcatcttggactccaccttctagacttgggcactccctttctgtttacgacggcaagaaaatcttgatgtttggtggtcttgccaaaagtggccctctacggctcaggtccagcgatgtattcactttagatttaagtgaagacaagccatgctggcggagcatcactggcagtgggatgccaggagctggtaatcctgctggagttggcccacctcctcgccttgatcacgtcgcggtgagccttcctggaggtagagttttgatatttggtgggtctgtggcgggtcttcactcagcctcgcagctttacctcctggatccagctgaagagaagccgacctggaggattttgaatgttccagggcggcctccacggtttgcttggggccacagcacctgcgtcgtgggaggaacaaaggcagtagttcttggaggacaaactggagaagaatggacactaactgaaatgcatgagctttctctgcttagctcattagtttgaagatgaaaagcttccttgaagagacatttctggtgaacagctgcctcttcgtgtgtgtgactcaggctgaaacaattttttccaacagtggggctacaaaaatagggttcgcgaagtgattttactctgttatctcagggcagttgtggagtagcccctgaggtggatcgaatctgattactcaatctatgtctgggagtcgcctcatctagaaggagagctggcgttatgtagctggagccatgcgacacactcattgtgttatgatggcgcacatgctgacaccgccattgttgagaagcgatgctgtggtcttctggtttttgacccatcgattgctgctatctggagaagctgtaacactgttgtatttacttatacttttgcattactttgtgcttacaccaagtgatagtgatacttgtgacattttctttaccgtcttgattatcaaaggatgaatctcaataattccatcttattcgtac

SEQ ID NO: 18225 - protein, 616 aa, Panicum virgatum
  misc_feature: Ceres CLONE 1796245
  misc_feature (352)..(399): Pfam Name: Kelch_2 Pfam Description: Kelch motif
  misc_feature (456)..(508): Pfam Name: Kelch_2 Pfam Description: Kelch motif
  misc_feature (523)..(571): Pfam Name: Kelch_2 Pfam Description: Kelch motif
  misc_feature (202)..(250): Pfam Name: F-box Pfam Description: F-box domain
  misc_feature (50)..(178): SWISSPROT Homolog: EC 2.7.11.1 Non-specific serine/threonine protein kinase
  misc_feature (255)..(564): SWISSPROT Homolog: EC 3.1.3.16 Phosphoprotein phosphatase
MEWDSDSDGGGGGGDEDEEEEEEEEEVQAGTGPPGFSLAIEGVLGACGMVVSDALEPDFPIIYVNRGFEDATGYRAEEVLGRNCRFLQCRGPFAQRRHPLVNAAVVTGIRRCLEDGTKFQGDLLNFRKDGSPYMAKLQLTPIYGDDDTITHYMGIQFFNDSNVDLGPSPGSVTKELVRSTWIAPDNTPPPSSVGKGNLWEHSSLFLLSDEVLCQKIFSKLSPRDIASVNSVCKRLYHLTKNEHLWRMVCQNAWGSDATRTLESVAGSRSLAWERLARELTTLEAVAWRKLTIGGAVEPSRCNFSACAVGNRVVLFGGEGVNMQPMNDTFVLDLSASKPEWRHVHVSSAPPGRWGHTLSCLNGSRLVLFGGCGGQGLLNDVFILDLDAQYPTWREIPGLAPPVPRSWHSSCTVDGTKLVVSGGCADSGVLLSDTYLLDVTMEKPVWREIPASWTPPSRLGHSLSVYDGKKILMFGGLAKSGPLRLRSSDVFTLDLSEDKPCWRSITGSGMPGAGNPAGVGPPPRLDHVAVSLPGGRVLIFGGSVAGLHSASQLYLLDPAEEKPTWRILNVPGRPPRFAWGHSTCVVGGTKAVVLGGQTGEEWTLTEMHELSLLSSLV

SEQ ID NO: 18226 - DNA, 1813 bp, Panicum virgatum
  misc_feature: Ceres CLONE 1796248
  misc_feature: Encodes the peptide sequence at SEQ ID NO. 18227
atccaagagctcggaatcttcaaggcaaggctggcgggcagcggcgaggcatcggctgcggagggcggaggccgcggcgggttgggacttgggagctagctagctagtggagagcagagggagtgaggaggcggggggcggacgaggatggcgtcgcggaagcagccggcggtggcggcggggaaggagggggaggagggggagcagggggagcggtgcccggtggaggaggtggcgctggtggtgccggagacggacgacccgtcgctgccagtgatgacattccgggcgtggacgctggggctgggctcctgcgtcgtcctcatcttcctcaacaccttcttcacgtaccgcacgcagccgctcaccatctcggggatcctcgcccagatcctcgtgctccccgcggggcgcttcatggccgccgtgctgcccgaccgcgaggtcaggatcctcggcgggcggctcggcagcttcaacctcaacccggggcccttcaacgtcaaggagcacgtcatcatcaccatcttcgccaactgcggcgtctcctacggcggcggcgacgcctactccatcggcgccatcaccgtcatgaaggcctactacaagcagacgctcagcttcgtcctcgccctgctcatcgtcctcacaacgcagatactggggtacggctgggccggcatgctgaggaggtacctggtcgaccctgccgagatgtggtggccttctaaccttgcccaggtctcactcttcagggcgctgcacgagaaggaggagggcgacgagaagtcccggggcccgtcgcggatgcgcttcttcctcatcgtcttcttcgcgagcttcgcctactacgcgctaccggggtacctgctgccgatcctgaccttcttctcgtgggcgtgctgggtgtggccgcacagcatcacggcgcagcaggtcgggtcggggtaccacggcctcggcgtcggcgccttcacgctggactgggcgggcatctcggcgtaccacgggagcccgctggtggcgccgtgggcgtccatcgccaacacggccgtcggcttcgtcctgttcatctacgtcatcgtgccgctctgctactggcagttcaacacgttcgacgcccgcaggttccccatcttctccaaccagctcttcacggcggcggggcagaagtacgacaccaccaaggtgctcaccaaggacctggacctcaacgtcgccgcctacgacagctacggcaagctctacctcagcccgctcttcgccatctccatcggctccggcttcctgcgcttcaccgccaccatcgtccacgtcctgctcttccacggcagtgacatgtggaagcagagcaggtcggccatgaacgcggcgaagctggacgtgcacgcgaagctgatgcagaggtacaagcaggtgccgcagtggtggttcctcgtgctgctgctgggcagcgtggtggtgtcgctgctcatgtccttggtctggaaggaggaggtgcagctgccgtggtgggggatgctcttcgccttcgcgctcgccttcgtcgtcacgctccccatcggcgtcatccaggccaccaccaaccagcaaccggggtacgacatcatcgcgcagttcatgatcggctacgcgctgcccggcaagcccatcgccaacctgctcttcaagatctacggccggatcagcaccgtgcacgcgctctcgttcctcgccgacctcaagctcggccactacatgaagatccccccacggtgcatgtacaccgcccagctggtcggcacggtggtcgccggcgtggtgaacctggcgg

SEQ ID NO: 18227 - protein, 555 aa, Panicum virgatum
  misc_feature: Ceres CLONE 1796248
  misc_feature (43)..(555): Pfam Name: OPT Pfam Description: OPT oligopeptide transporter protein
MASRKQPAVAAGKEGEEGEQGERCPVEEVALVVPETDDPSLPVMTFRAWTLGLGSCVVLIFLNTFFTYRTQPLTISGILAQILVLPAGRFMAAVLPDREVRILGGRLGSFNLNPGPFNVKEHVIITIFANCGVSYGGGDAYSIGAITVMKAYYKQTLSFVLALLIVLTTQILGYGWAGMLRRYLVDPAEMWWPSNLAQVSLFRALHEKEEGDEKSRGPSRMRFFLIVFFASFAYYALPGYLLPILTFFSWACWVWPHSITAQQVGSGYHGLGVGAFTLDWAGISAYHGSPLVAPWASIANTAVGFVLFIYVIVPLCYWQFNTFDARRFPIFSNQLFTAAGQKYDTTKVLTKDLDLNVAAYDSYGKLYLSPLFAISIGSGFLRFTATIVHVLLFHGSDMWKQSRSAMNAAKLDVHAKLMQRYKQVPQWWFLVLLLGSVVVSLLMSLVWKEEVQLPWWGMLFAFALAFVVTLPIGVIQATTNQQPGYDIIAQFMIGYALPGKPIANLLFKIYGRISTVHALSFLADLKLGHYMKIPPRCMYTAQLVGTVVAGVVNLA

SEQ ID NO: 18228 - DNA, 653 bp, Panicum virgatum
  misc_feature: Ceres CLONE 1796248-R
cggcacgggctgtaccgcaacctggtgtggctgttcctcgctggcgccgtgctcccggtgccggtgtggctgctgagcagggcgttcccggagaagaagtggatcgcgctcgtcaacatccccgtcatctcgtacgggttcgccggcatgccgccggcgacgcccaccaacatcgccacctggctcgtgaccggcaccatcttcaactacttcgtcttccggtaccgcaaggggtggtggcagaagtacaactacgtgctctcggcggcgctcgacgccggcaccgccttcatgggggtgctcatcttcttcgcgctgcagaacgcgcaccacgagctcaagtggtggggcacggaggtggatcactgcccgctcgcctcctgccccaccgcgccgggcatcgccgtcaagggctgcccggtgttctagctgcttctttctaaactgaccgtagtacgtccgtggtaatcatgtcactatgtcagggcggggggtaacgctgcacctgcttttcagaagcatggatttcagacgcatcgattaagcgatgcagcgttttgtcacccgtgaatgtaacaatttcttcatcacaaagttgccaatgacatgaacaagttgctctatgaacaccgggtttcggggtatcgcaattc

SEQ ID NO: 18229 - DNA, 1823 bp, Panicum virgatum
  misc_feature: Ceres CLONE 1796268
  misc_feature: Encodes the peptide sequence at SEQ ID NO. 18230
aagcaaaactactgcaaagtaaaaaaaaaagttcgacaagcaagctaagccacccccatcatggagatggagctaagtgcagccacgctcctattcgtcttcctcatctccttgccaatccttgtgaccttgctgagccacaaatcaacttcgacctccaagaagaggcgtcctccaggcccgtggaacctcccattgattggaagcctcctccacttcgtcaagtcgcatccgccggccgttctccgggacctggccaacaagtatggccccgtgatgttcctacggatgggccaaatcgacactgtcgtgataacctcgccggcggcggccgaggaggttctccgcgataaggatgtcatcttcgcgtcgaggccgagcatcgtggcttcggagctcttctgctaccaaaaccgcgacatcgtcttctcgccatatggctcttattggcggacgctgcgcaagctctgcacggtggagctcctcagtgcaaagatggtgcggcagttcgcacccataagggataacgagacgttgtccctcatcagaaatatccaagctgctggacgaggtggtgagccggtccagctcgcgaggcacctcttatcttgcaccaactcgatcaccgcaaaggcggcttttggccaggtttgcagcagcgagctccgggaccagttcctgtcgtcgattgctgtggcgataagctacagcgggggcttcaccgtcggtgatgtctttccatcgctacgcttcattgacgtcgtcactgggctcaggcgaaggatgtggcgagcacgcttgcagctggacgacgtttttgaaaagatcattgctcaatctgaggcgcaacgaggtgatgacctggtgggcatcctccttcggatcagggacgagggggagctagagctccctatcagcacaataaacatcaaggcaattatattggatatgttcgctggaggaacggagacgacgtcgtcagctgcagagtggaccatgtcagagctcatgaggaacccagatgtgatggccaaggcacaagccgaggtgcgacgagtattcgatagcgtgagcccacaagcccatgaagccaagatggacgagctgaagtacattaaaatggtggtcaaggagagcttgaggctgcacccagtggtgccattgttggttccccatttctgtcgggagacttgcagtgtaggagggttccaagtcacggagggcaccagggtcatgatcaatgcgtgggccatggcaaggagccccgagtattggcatgacgcagagaagtttaggccggagaggtttgagggtggcatgcttgacttcaaaggctctgggttcgagtacttgccatttggagccgggaggagaaggtgccctggtgataccttcgggctggctgtgctggagctcattattgcacgccttctctactacatcgactggagcctcccagtcgggatgcagcctgatggcattgatatggaaatgattgtttccgcaacagctaggagaaagaacctgctgcacttagtagcatcgccatataagaaggttcccgtgcaatactgattgacgagatagtatgtgctttggccaatatctacagttgtgtcagagtacttcataataggtacgtgtcttgtttgtccaatgggaatgcacaaataaatataaatataactacggtcaatggcgtgaatacctctccattgaaggtacaagcgagtggaacattatagtcttatagaaagtccaacataatgtcacacgttgtattaaacataattgcttcatcgataattatgcatatgttcact

SEQ ID NO: 18230 - protein, 504 aa, Panicum virgatum
  misc_feature: Ceres CLONE 1796268
  misc_feature (38)..(492): Pfam Name: p450 Pfam Description: Cytochrome P450
  misc_feature: SWISSPROT Homolog: EC 1.14.13.68 4-hydroxyphenylacetaldehyde oxime monooxygenase
MEMELSAATLLFVFLISLPILVTLLSHKSTSTSKKRRPPGPWNLPLIGSLLHFVKSHPPAVLRDLANKYGPVMFLRMGQIDTVVITSPAAAEEVLRDKDVIFASRPSIVASELFCYQNRDIVFSPYGSYWRTLRKLCTVELLSAKMVRQFAPIRDNETLSLIRNIQAAGRGGEPVQLARHLLSCTNSITAKAAFGQVCSSELRDQFLSSIAVAISYSGGFTVGDVFPSLRFIDVVTGLRRRMWRARLQLDDVFEKIIAQSEAQRGDDLVGILLRIRDEGELELPISTINIKAIILDMFAGGTETTSSAAEWTMSELMRNPDVMAKAQAEVRRVFDSVSPQAHEAKMDELKYIKMVVKESLRLHPVVPLLVPHFCRETCSVGGFQVTEGTRVMINAWAMARSPEYWHDAEKFRPERFEGGMLDFKGSGFEYLPFGAGRRRCPGDTFGLAVLELIIARLLYYIDWSLPVGMQPDGIDMEMIVSATARRKNLLHLVASPYKKVPVQY

SEQ ID NO: 18231 - DNA, 1181 bp, Panicum virgatum
  misc_feature: Ceres CLONE 1796272
  misc_feature: Encodes the peptide sequence at SEQ ID NO. 18232
ggcccggtcctgtctcccggcgtcgtcgtctcgtcctccacccccatgaggccgcccccgagacatgcctcgtagccccggcgtcaccagaagcagcagcagccccttcctccgccgcgcctcgcccgcgcccgcgccgcccgcctcccacgcctcggcgccgcggccatggcgatgccgttcgcgcggcgcgacatcgaggcgatgggcgccggcgccggcagcgacgactcgccggccgctaagaagggcaagccggagctccccggggcgcgccccgcgctgacgcggtccgaggcgttcgcgttcgcggccgtgctcgcgctcttcaccgcggggatcttctgcgtcttcctcacagcgccgcggcgcgagttcgggcagatcctccgcctcccgcgcagcctcgccgatgtccgcctcctcaaagacaacctcgctgtttatgctagagattatcaagcaaacttcatactggggtattgctccatatacatattcatgcagacattcatgatccccggaacgatattcatgtctttacttgccggggccctctttggagtgatcaaaggtggcattttggtcgtcttcactgccacagctggtgcatcatcttgctattttgtctccaagttgattggtagacccatagttagttggttgtggcctgaaaaattgagatattttcagtcagagattgctaagcggaaagaaaagctgttgaactatatgctttttctgagaataacaccaactttacccaacacattcataaatatggcgtcaccaattgttgacatacctttccacattttctttgctgcaacactagtgggcctcattccagcatcctatattactgtaaaggctggtagagccctaggtgatctgaaatcagttagggagttgtatgacttcaagacattggtagttctattccttattggatcagttgctgtcgctccaacgatcctgaaaaggaagaaaacatacgaatgatgctccagagcatttaaatactttcttcagatgctctaaaatgtattagtttttttcacctttctttttcttttttgatattgtatacctgttccattctagctgtagagatgtaacattgaatgctttctaatacgagatgaccccgacactttgtctgccggtcccatgttcgctac

SEQ ID NO: 18232 - protein, 277 aa, Panicum virgatum
  misc_feature: Ceres CLONE 1796272
  misc_feature (117)..(238): Pfam Name: SNARE_assoc Pfam Description: SNARE associated Golgi protein
MAMPFARRDIEAMGAGAGSDDSPAAKKGKPELPGARPALTRSEAFAFAAVLALFTAGIFCVFLTAPRREFGQILRLPRSLADVRLLKDNLAVYARDYQANFILGYCSIYIFMQTFMIPGTIFMSLLAGALFGVIKGGILVVFTATAGASSCYFVSKLIGRPIVSWLWPEKLRYFQSEIAKRKEKLLNYMLFLRITPTLPNTFINMASPIVDIPFHIFFAATLVGLIPASYITVKAGRALGDLKSVRELYDFKTLVVLFLIGSVAVAPTILKRKKTYE

SEQ ID NO: 18233 - DNA, 719 bp, Panicum virgatum
  misc_feature: Ceres CLONE 1796281
  misc_feature: Encodes the peptide sequence at SEQ ID NO. 18234
atcccaaatccaccggagacactactcactcagaaccaaggcgaccaaagatctgcgagctaagcaaccgagagctgataagacgaagatgtgtccgacgatcaagaaggagatgagcgccgagtcgagcccaccgtgctgcagctgggcgtcgacctcaacctcgtcgccggagcaggcgcaccaccagacggtgtggacgtcgccgcccaagaagccggcggggcggaccaagttccgggagacgcggcaccccgtgttccgcggcgtgcggcgccgcggcaacgccgggcggtgggtgtgcgaggtgcgcgtgccgggccgccgcggctgcaggctctggctcggcaccttcgacaccgccgaggccgcggcgcgcgcgcacgacgccgccatgctcgccatcgccggcgcgggcgcctgcctcaacttcgccgactccgcatgcctgctcgccgtcccggcctcgtacaccagcctcgccgaggtgcgccacgccgtcgccgaggccgtcgagggcttccagcgccgcgaggcgctctcggtctcggaggatgacgccgcgtcgttgtcggcgccctcctcccccgccagcgtcgaactcgacggggcttccaccgacggggaggagtcgccctccccggcgttcgaactggacgtgttcaacgacatgagctgggacctgtactacgcgagcatggcgcaggcgatgctcatgg

SEQ ID NO: 18234 - protein, 210 aa, Panicum virgatum
  misc_feature: Ceres CLONE 1796281
  misc_feature (56)..(109): Pfam Name: AP2 Pfam Description: AP2 domain
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7138277
  misc_feature: The sequence is a functional homolog of SEQ ID NO 1248 in the 10/374,780 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1221 in the 10/374,780 US patent application
  misc_feature: The sequence is a functional homolog of SEQ ID NO 1410 in the 10/412,699 US patent application
  misc_feature: The sequence is a functional homolog of SEQ ID NO 720 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1228 in the 10/374,780 US patent application
  misc_feature: The sequence is a functional homolog of SEQ ID NO 722 in the 11/435,388 US patent application
  misc_feature: The sequence is a functional homolog of SEQ ID NO 752 in the 11/435,388 US patent application
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1236 in the 10/374,780 US patent application
MCPTIKKEMSAESSPPCCSWASTSTSSPEQAHHQTVWTSPPKKPAGRTKFRETRHPVFRGVRRRGNAGRWVCEVRVPGRRGCRLWLGTFDTAEAAARAHDAAMLAIAGAGACLNFADSACLLAVPASYTSLAEVRHAVAEAVEGFQRREALSVSEDDAASLSAPSSPASVELDGASTDGEESPSPAFELDVFNDMSWDLYYASMAQAMLM

SEQ ID NO: 18235 - DNA, 639 bp, Panicum virgatum
  misc_feature: Ceres CLONE 1796281-R
  misc_feature: Encodes the peptide sequence at SEQ ID NO. 18236
ggggccggtacgcggcggagatccgagaccccgcgcgcaaggcgcgcgtgtggctgggcaccttcgacacgcccgaggaggcggcgcgcgcctacgacgccgccgcgcgcaggctccgcgggccgcgcgcccccaccaactaccccgccgccgcacacgcccaggacccgaacgcggcgctgtccgaggacgcgcggtcgtcgtcgtcgtccttgtcctcttgccgggactcgccgctggcggtggccgtcgcggcggcgcccccgtcgctggacctgagcctggcggtcccggccacgccgccgccgccgtaccacatgtgcctggaaacggccgtggcgccagcgctgctgcagtttctgccgcccaagcacgaggaagagcggatcttctcaggggcgtcgtcggtggtgttcgacgcggcgccggccgtgggcctggggctggacctcaacctggcgctgccggcggccgggatggtgatgtagagtcggttaattagcacagtagagtaggtacgagctcatgcatggatcaagatgtcatcagatgtaaataggctgcagatttgtgcgtgcgctgcgatggtgatgcagcgattttaggaaatttgccaaggcttaaaaggcttcatcttag

SEQ ID NO: 18236 - protein, 161 aa, Panicum virgatum
  misc_feature: Ceres CLONE 1796281-R
  misc_feature (1)..(41): Pfam Name: AP2 Pfam Description: AP2 domain
GRYAAEIRDPARKARVWLGTFDTPEEAARAYDAAARRLRGPRAPTNYPAAAHAQDPNAALSEDARSSSSSLSSCRDSPLAVAVAAAPPSLDLSLAVPATPPPPYHMCLETAVAPALLQFLPPKHEEERIFSGASSVVFDAAPAVGLGLDLNLALPAAGMVM

SEQ ID NO: 18237 - DNA, 2754 bp, Panicum virgatum
  misc_feature: Ceres CLONE 1796282
  misc_feature: Encodes the peptide sequence at SEQ ID NO. 18238
gacccggcccgtggaaaccgccggtaaccttgccattcccgtcgctcgccgccgcggcggccgccgccgtctcgtaattcgtgaatactactactagccgctaccccaccacgcccccacgaactccccccctccgtcctccccggcccggccagcggcgccaccctcggccggacccttcgctccgggaggttgatgcttccatgctgcacttgaagatttggtcagctgttgacgccttgctggcgctgtttctcctctaggattagaaggaaaccatggcgggccgagaggagagatatgtgaggtttcaggactggagatcagagcaatctgtttctgttgtttcggatagggtagtttcagaaaaagggcataacgtctttgggttgctaaagggcagaactgcaggagccttttcattcctagggaactcttcacattctgaaactctaaacaaatctgcttcggaggaaaggaagcgcaaaacaagagttcttgatccccaagggccatttctgcagagatggaacaaaatatttgtgatatcatgtctttttgcagtttttgtggacccattgttcttgtatatcccggtaatcaatggtgacaaaaaatgcatgcacttggacaagaagttggaaaccgcagcaagtatcctgcgctttttcacagatatcttctatttactccatataatgtttcagttcaggacgggctttattgctccttcttctagagtgtttggtcggggtgtcttggttgaggacacgtttgcaataacgaagcggtatatgtcaacattttttctggttgatttcttagctgttctacccctccctcaggtatttgtgttggtggtgctgcctcatctcgaaggttctgaaattatgaaggcaaaaattgtactactgattattattatatgtcaatatgtgcctcgactgctccgaataataccactttaccttcaaatcacaagatctgctggcatacttacagagacagcatgggctggtgctgctttcaacctgataatttatatgcttgccagtcatggctttggagctctttggtacatgctttccatccaacgattagactcctgttggagacaagcatgcagcaatcagactggctgtcatcctacatctttatattgtgagactaatacatttggaaataatgctttcttgcaacatgtttgcgcaacaaatagcgatgccaagccagacccgacatttggaatttttctaccagctctccagaaagtttcaagttcaaagaatttcttcgagaaactattctattgcttttggtgggggctacaaaatctaagttctcttggtcagaacatgattacaagcactaatacattggagaatctgtttgcggtttttgtctcaacatcagacttggttctatttgcactacttattggtaatgtgcagacctatttacagtcagcctctgtgcgtatagaagaaatgagaatgaaaaggcgtgatacagagcagtggatggcacataggctacttcctgaaaatcttaaggagcggattatgcgccatgaacaatataggtggcaagaaacaagaggtgtcgatgaagagggccttcttacaaatcttcccaaggatcttcgaagagagataaagagacatctttgtttgtctcttctgataaaggttccaatgtttgaaaacatggatgagcagctcttggatgctatgtgtgatcgtctaaagcccatgctgtacacggaaggaagctgcatcgttcgtgaaggtgacccagtgaatgaaatgctcttcatcatgaggggaacactagagagtacgacaacaaatggtggacagactggcttcttcaactctaatgttctaaaaggtggcgacttctgtggtgaagagctcctcacatgggcccttgaccccacttcagcatcgaatctccctggctcaactaggacagtgaagacgctgactgaagtcgaagcttttgctttgagggctgacgacttgaagtttgttgccacccaattcaggaggcttcacagcaaacagctccagcataccttcagattctactcacagcaatggagaacttgggctgcttgcttcatacaggcagcatggcacagatactgcagaaagaagcttgaagagactttgtacgaaaaggaaaagaggttgcaggcagcaattatatgcgacggcactacttcgctcagtcttggtgcagcgctctacgcttcgcgttttgctggtaacatgatgcggatcttgcggaaaaatgccacccgaaaggcccgtttgcaggaaagagtgcctgtaagattattacagaagccagcagaacccaacttttttgttgaagatcagtgatctcatctttgggggcaccctgtaacaagcagaaattattcatgatcaaaccggtacaaaactcacgtgattggatgctgcacaagtgtacatagatggaccaggtggtctaaagccgtctggtttgaatcacggaattcaatgtgtatctacgattcttttatcagatacactatattaaattattaattctgcatacaagatgcatgtatttatattttattagcataccagattttacctcttgtgaatctcgaaaacagaagatactgtaaatgtaactgatcaatagtttgttgattttgggatgtgctcgcatgtgaactgtgagaggaagcgattaatatgaactgaaaaagggtccgtg

SEQ ID NO: 18238 - protein, 702 aa, Panicum virgatum
  misc_feature: Ceres CLONE 1796282
  misc_feature (128)..(390): Pfam Name: Ion_trans Pfam Description: Ion transport protein
  misc_feature (491)..(591): Pfam Name: cNMP_binding Pfam Description: Cyclic nucleotide-binding domain
MAGREERYVRFQDWRSEQSVSVVSDRVVSEKGHNVFGLLKGRTAGAFSFLGNSSHSETLNKSASEERKRKTRVLDPQGPFLQRWNKIFVISCLFAVFVDPLFLYIPVINGDKKCMHLDKKLETAASILRFFTDIFYLLHIMFQFRTGFIAPSSRVFGRGVLVEDTFAITKRYMSTFFLVDFLAVLPLPQVFVLVVLPHLEGSEIMKAKIVLLIIIICQYVPRLLRIIPLYLQITRSAGILTETAWAGAAFNLIIYMLASHGFGALWYMLSIQRLDSCWRQACSNQTGCHPTSLYCETNTFGNNAFLQHVCATNSDAKPDPTFGIFLPALQKVSSSKNFFEKLFYCFWWGLQNLSSLGQNMITSTNTLENLFAVFVSTSDLVLFALLIGNVQTYLQSASVRIEEMRMKRRDTEQWMAHRLLPENLKERIMRHEQYRWQETRGVDEEGLLTNLPKDLRREIKRHLCLSLLIKVPMFENMDEQLLDAMCDRLKPMLYTEGSCIVREGDPVNEMLFIMRGTLESTTTNGGQTGFFNSNVLKGGDFCGEELLTWALDPTSASNLPGSTRTVKTLTEVEAFALRADDLKFVATQFRRLHSKQLQHTFRFYSQQWRTWAACFIQAAWHRYCRKKLEETLYEKEKRLQAAIICDGTTSLSLGAALYASRFAGNMMRILRKNATRKARLQERVPVRLLQKPAEPNFFVEDQ

SEQ ID NO: 18239 - DNA, 546 bp, Panicum virgatum
  misc_feature: Ceres CLONE 1796283-R
  misc_feature: Encodes the peptide sequence at SEQ ID NO. 18240
catttccagttccctgttggtcgtatccaccgccaacttaagcagaggactcaggcaaatggtcgtgttggtgccactgcagctgtctactccgctgccatcctggagtacttgaccgctgaggttctggagctggctgggaatgctagcaaggatctgaaggttaagcgtatcaccccccgccacctccagctcgccatccgtggagatgaggagctcgacaccctcatcaagggcaccattgcaggtggaggcgtcatcccgcacatccacaagtccttgatcaacaagtcctccaaggagtgagtgaggtgctagagatgatgtgcatcttagtttaaactggacttttgtgtgcccttgtgttgtaagtcctggtttgtcaagtagttttagtggagctgtctggttgaagtgatccttctgtgtattgctctcctggtgctgcttttgttatttgaacatcgtgtctgtgttgagtcgtttacttaagtgatgcgaacctggatgcttatttagttatttgcgactggtttgtttcttctt

SEQ ID NO: 18240 - protein, 101 aa, Panicum virgatum
  misc_feature: Ceres CLONE 1796283-R
  misc_feature (2)..(70): Pfam Name: Histone Pfam Description: Core histone H2A/H2B/H3/H4
  misc_feature: SWISSPROT Homolog: EC 2.7.7.7 DNA-directed DNA polymerase
HFQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 18241 - DNA, 680 bp, Panicum virgatum
  misc_feature: Ceres CLONE 1796283
gatttcccgaatcgccagcgagatccgcccgattcgcgccccgatctgcgctgatcggcccctgcgctgttcgatttggtcctgttcgctgcagggtcacagtttccctcggagcagaggagatggccgggaagggaggcaaggggctgctcgcggcgaagacgacggcggccaagacggcggagaaggacaagggaaagaaggcccccgtctcccgctcctcccgcgccggcctgcaggtgactcgcggcgtcccctcttccttgcgtactctgcttttcgctcgcttgcttcgtcgcgccgcgggtgatagggcgcgcccagatttgaactgccgcgttagcgcgcgcggctgtaggtcgcacgtttattcaacctgctgctagggcgcgcgtgtgaatttgtgtgtctcgcccgggtcatgtgaggtctgaggcttcgtacggttagcagaggtgctgtcttccttttagattcgcgcgtgtgggttggatgagttgtggctttgcgaaggttgcgcgcgtgtagtctggtcaaagccaggttttaaaaatcatagggcttctgttgttctgccaaagttttgatctggaatagtggttgctctgcctgcctttgtcatgtagaccggcgggcacatgattatgtttgttcaatttgcgcattagcatgttataagc

SEQ ID NO: 18242 - DNA, 1897 bp, Panicum virgatum
  misc_feature: Ceres CLONE 1796284
  misc_feature: Encodes the peptide sequence at SEQ ID NO. 18243
attctaagcatcaaaacgtagctaacgtcgcccttccccctcaccggcgtcgacctgacctgtgcagccgacaaaaatgggttcccgcctcctagtcagatcagcggcggcgcgcctcctctcccaactccgccgcaggacgctagaccctacccatcgcctccttccccatggagcctccttggagtccctcctggggcccaccggtgacatccccgccgccgccgactcagccctcctccgctacccagcgcggtggtactcttcgtccacggcggcggtttcagaggtgccgatgacggcggacggcctgacggtggattcgattgccggcaaggggtggacgatcctccccgaggccgagagcgactggcgcagccacgccgccgccgtcgcgcagtccatcaggctcattaagaagcgcctcaagtggggatggatacttgagagaacgaagcaactggctgtggtgttggagaagccagacctctgggatgatccagcttttgctggaagggttagccgtgagcacggtgagctcatgggcaagatcaaatcagtgaaccagtttgagcaggaattaattgaacacatcgagatgttaaggctcgcacgtgaagaaaatgataatgaacttgagatggaaagcatgagggctttggctgatatgagaagaagtgcaaaggagaaagaactcaatgctctactttctggagacaatgattcttgctcttgcttcattgaggttcaggcaggggctggtggcactgaaagcatggactgggctgcaatggtcatgaacatgtatagatcatgggcccagcgacggggatatacaatcactgtggtagaagagatgcctggtgaagtagcaggaatcaagagggccactatcaaagttgacggtgaatatgcatttggatatgccaaagccgaagtaggagttcatagattagtgcgaatttctccatttgacagtgggaagcggcggcacacttcctttgctgctgttgctgtaatccctattcttggcgatgcctctagccgataccagataaaagactctgatcttcggatagaacgtttccgttccggtggtcctggtggccagcatgccaacactactgaaagtgccattcgaattgtgcacattccaactggtattagcgcaacatgtcaaaatgaaagatcacaacacatgaacaaggcatcagcaatggcggtgctccaatctcgtctggaccaacttgagattgcccgtcaagcacagatgaatgcagagcacacacagtcactcaatgaaatcagctggggcaaccaaataagatcttatgttctccatccataccgtatggtcaaagatctccggacaaactatgaagtatcagaccctgactccgtccttgaaggagacctagatgatttcatcttaaattatttgtcttcgtcactagatgaaggtgatgtaagtgtctgaactgaaatcatgcttagcatttttcacgagcactaacctactgaatagcttgccttcaaaacaatacaaatgagacatattgttcaagtgatagcaagttgatatactgctgcaatatttaccacatcaatgggtgcgatgggagctcaaatgctgaaaaagttaaggtgcggatagtacaccggttgcaagtgcaaaagcggatgaatgctatagtttagcgatgtagttagggtcttagagaaggcagtacaataatcacactcgcttcatggctagtgtgtagttaccttttgtctgtactgcagttcccgttggtgatgcatattgtaagcagtcatatctagtcaattgtagtgacacccaaccagattgaggtgttctatgaataattgatcaatttcttcagttccttgctac

SEQ ID NO: 18243 - protein, 393 aa, Panicum virgatum
  misc_feature: Ceres CLONE 1796284
  misc_feature (245)..(358): Pfam Name: RF-1 Pfam Description: Peptidyl-tRNA hydrolase domain
  misc_feature (104)..(214): Pfam Name: PCRF Pfam Description: PCRF domain
MTADGLTVDSIAGKGWTILPEAESDWRSHAAAVAQSIRLIKKRLKWGWILERTKQLAVVLEKPDLWDDPAFAGRVSREHGELMGKIKSVNQFEQELIEHIEMLRLAREENDNELEMESMRALADMRRSAKEKELNALLSGDNDSCSCFIEVQAGAGGTESMDWAAMVMNMYRSWAQRRGYTITVVEEMPGEVAGIKRATIKVDGEYAFGYAKAEVGVHRLVRISPFDSGKRRHTSFAAVAVIPILGDASSRYQIKDSDLRIERFRSGGPGGQHANTTESAIRIVHIPTGISATCQNERSQHMNKASAMAVLQSRLDQLEIARQAQMNAEHTQSLNEISWGNQIRSYVLHPYRMVKDLRTNYEVSDPDSVLEGDLDDFILNYLSSSLDEGDVSV

SEQ ID NO: 18244 - DNA, 667 bp, Panicum virgatum
  misc_feature: Ceres CLONE 1796297-R
  misc_feature: Encodes the peptide sequence at SEQ ID NO. 18245
tcacattggtcactttcttctaacaaacctcctattggagaacatgaaaagcacatgtagggacagcggcaccgagggacggattgtcaatgtgacgtcagtagggcatgccatgatgacttatcctgaagggatatgctttgacaaaattcatgatccttccggtttgaatgactttattgcttactgccaatccaagcttgccaatattcttcactccaatgaattatcacgaattttcaaggaggaaagagtgaatatttcagccaatgccgttcatcctggtgtcatcatgactaacatttttaggaacaggactattgtcggtgcgttttttaacaccattggaagaatcatatgtagaagagttgaacagggtgccgcaacgacatgctatgtggcgatgcatcctcaagtgaaggggataagtggaaagtacttcgccgattgtaacatatccagcccgagcttacaagcttcagatgctgagctggccaagaagctatggcagttcagcttacagacattgtcttcttgatcaagctatgcttgcctgaacgagtgatgcacgtattgttgtacttaatgcttacatagctcttccggatgtttgttatcggtgtatttagttactgcgctatgaatcaaaatgtctcaatcttgattc

SEQ ID NO: 18245 - protein, 178 aa, Panicum virgatum
  misc_feature: Ceres CLONE 1796297-R
  misc_feature: SWISSPROT Homolog: EC 1.3.1.33 Protochlorophyllide reductase
HIGHFLLTNLLLENMKSTCRDSGTEGRIVNVTSVGHAMMTYPEGICFDKIHDPSGLNDFIAYCQSKLANILHSNELSRIFKEERVNISANAVHPGVIMTNIFRNRTIVGAFFNTIGRIICRRVEQGAATTCYVAMHPQVKGISGKYFADCNISSPSLQASDAELAKKLWQFSLQTLSS

SEQ ID NO: 18246 - DNA, 691 bp, Panicum virgatum
  misc_feature: Ceres CLONE 1796297
gtctagtccaacaaacattaatacagtgtcgtccgaaactgctgcttgatgtggtggttctaccgcaaggggccctcgggcttctccagcgcctccacggccgaggaggtcaccgccggcgtcgacggccgcggcctggtcgccgtcatcacaggtgcaaatacttacctccctggcctgctcgctgtacatgctcactgtcattccatcccatgacgttcggagtttgcaaccatgacaatcacctctggcctggccggagttggaacgacggccaacccgggctggcaggaggaattcaggattccaagtctctccgaccaaccccgggcttgtcaaggatcccgagattgccatttacggcaaagcaatgacatgtggtgagcacctgagctgatgagcctcctagctgcctgagcaggtgcgtcgagtggaatcgggctggagacggcgcgcgtcctggcgctgcgaggtgtgcacgtcgtcatgcccgtccgcaacgtcgccgccgggctcgcagtcaaggagtccatcgtggccaagatccccgtcgcaagaattgacgtgctggagctggacctcagctccatggcatcggtaaggagattcgcctccgagtttgaatctctgaacctgcccctgaacattctcatcaacaacgctggagttctgacaaggaaccacacgtgtt

SEQ ID NO: 18247 - DNA, 1526 bp, Panicum virgatum
  misc_feature: Ceres CLONE 1796305
  misc_feature: Encodes the peptide sequence at SEQ ID NO. 18248
aggacctcccccttttgaagggctcaggcctccttcgttgccttcgtgtggcttatcgttcggcgtcaggacagaagactcgaggagtcaacagggcgaagagcggcgctgcgctggtaaatcattcgccgggcggcggcggcggcgacgacgagatcgaggccgggctcccgttcggctcttctccgtcttgctacctagacctcgcacacgtgcctgtacggagcgccgcctccctcaccgtcaacgacgcagcagttgcaagggcgccggcacctatctctccgtcacctccgtgctcaactccgtcgaatctacagcctcccctgcccctccgcatcctccgccatcaaactcagtcgctcaggtcgggtccgacaacgagatcaaggaaattgtaactactaggaaaggaaactttatggttgagttgattcgatatttgtaagctttggacttatctacaatattttcacgactccattgaaagcttactttgtaggttttctactatattttttagtggttctgcctttcttgacacaatggtgaagctgaccatgatagcgcgtgtcactgatgggcttccactggcagaagggttggatgatgggcgagatcagaaggatgctgatttctacaagcagcaagctaaacttatttttaagaacttgtcaaaagggcatcacgaagcttcccggatgtcaattgagacaggggcctactttttccactacatcattgaaggccgagtatgttatctgactatgtgtgaccggtcttatccaaagaaacttgcattccagtacctagaagatctgaaaaatgaatttgagagggtcaatggcaatcaaatagaaactgctgcaaggccatatgcgtttatcaagtttgatacattcatccagaagactaagaaactatatttggatacaagaactcaaaggaaccttgcaaaactgaatgatgagctctatgaggtgcatcaaattatgacccgcaatgttcaagaggttcttggtgttggtgaaaagctagaccaggtcagtgaaatgtcaagtagattgacatctgacacaagaatatacgcagataaggcaaaggacctcaatcgacaggccttgatccggaagtatgctccggttgcgattgtgattggggtagtcttcattctcttttggctgaagaacaagatatggtgaatgtaacatactacaaaggaagccgtgccccatttgactggagaaggacggatgaaattctggttggtcgattctggatcaagagatgcttctggtgacttgtatcccgtatctgcccattcaagcgtgtactttagcttccttttgctcctaccttacaagctattcaggtgaattcgttgtagtacagaccttactcatgaggaactcgaattttgtggatccgtgaaattggtaaatacaaggggtctgtagaggtgattttacggcatcgggattgtaattttttctggtgaaactattagtaaggattcaggctgatgg

SEQ ID NO: 18248 - protein, 218 aa, Panicum virgatum
  misc_feature: Ceres CLONE 1796305
  misc_feature (132)..(218): Pfam Name: Synaptobrevin Pfam Description: Synaptobrevin
MVKLTMIARVTDGLPLAEGLDDGRDQKDADFYKQQAKLIFKNLSKGHHEASRMSIETGAYFFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVFILFWLKNKIW

SEQ ID NO: 18249 - DNA, 1738 bp, Panicum virgatum
  misc_feature: Ceres CLONE 1796307
  misc_feature: Encodes the peptide sequence at SEQ ID NO. 18250
atcgatcaatcggaagatcgaattccgaaatctcccccataaaattctctccgcgttcccctctttcgactcaccactcacgttagggatccccctcgcgttacgaaatccgtcgctcccaccgtgggcgatctcaccggcggcgtcgggaaacacgcaaaccctaggcctcgcctcgcccgcccgcgatgtcggccgccgccgtcgccccgacccctccgcccgcggccttccaggtggcgcccccgccgtcctacccggccgccgccgccgccgccgcgcccgccgagggccacgacgaggacctgtacggccgcctcaagtcgctccagcgcgccctggagttcatcgagatccaggaggactgcgtcaaggacgagctcaggaacctcaggcgcgaggagctgcacgtgaaggaggaggtcaagcgctgccgcgcgacgccgctcgagatcggccagttcatggagatggtcgacgccgaccacggcatcgtggggcccaccagcggcggctcctactacgtgcgggtcctcagcaccatcgaccgcgaggagctcaagccctcggcgtccgtcgcgctcgaccgccactcccacgcgctcgtcgacgtgctgccacccgaggccgattccagcatttcgctgctcggctcgtcggagaagcccaacgtcacctacaatgatattggaggatgtgatatccagaagcaagagatcagggaagctgttgagctacccttgacacaccatgaattgtacacccaaattggtattgatcctccaagaggtgtgctattgtttggtcctccaggtactggcaaaaccatgcttgccaaagctgtggcacatcacacaactgctgcttttatccgagtagttggttcggaatttgtacagaagtacttgggtgagggccctaggatggttcgagatgtattccgtttggctaaggagaatgcccctgctatcatattcattgatgaggttgacgcaatagccactgcacgctttgatgctcagactggtgctgatcgagaagttcagcgtattcttatggagctcctcaatcagatggatggatttgatcaaacagtaaatgtgaaggttataatggcaactaaccgggcagatactctagatcctgctctgctgcgtccaggtagacttgatagaaaaattgagttccctgttcctgaccgacggcagaagaggcttgtgttccaagtctgtactgccaagatgaacttgagtgatgaggttgatttggaagattttatatccagaccggataagatcagtgctgcagatattgctgctatatgtcaagaagctgggatgcatgctgtccgcaagaaccggtatgtcatcctccaaaaggacttcgagaagggctaccggaccaatgtgaagaagcctgagacggacttcgacttttataagtgaagaaagcatgagtgttagaatgcagtggttgactaattgctccatacacgacttctgccattttaactgaaaagcttggacatgctgtgtcggactcatactaggtagtagtaaagtaagcgacaatgaattcaattcaaacgggcatgatgccccggtgccttatgccgcctactggtgtgacaaatgacaaatccaccgaaccatagattacaatagatgatatgggtcactcgtgtggattttgtactacagcagttttctgataatcgagtctggcatttgtcctccag

SEQ ID NO: 18250 - protein, 418 aa, Panicum virgatum
  misc_feature: Ceres CLONE 1796307
  misc_feature (201)..(388): Pfam Name: AAA Pfam Description: ATPase family associated with various cellular activities (AAA)
  misc_feature: SWISSPROT Homolog: EC 3.6.4.3 Microtubule-severing ATPase
MSAAAVAPTPPPAAFQVAPPPSYPAAAAAAAPAEGHDEDLYGRLKSLQRALEFIEIQEDCVKDELRNLRREELHVKEEVKRCRATPLEIGQFMEMVDADHGIVGPTSGGSYYVRVLSTIDREELKPSASVALDRHSHALVDVLPPEADSSISLLGSSEKPNVTYNDIGGCDIQKQEIREAVELPLTHHELYTQIGIDPPRGVLLFGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPVPDRRQKRLVFQVCTAKMNLSDEVDLEDFISRPDKISAADIAAICQEAGMHAVRKNRYVILQKDFEKGYRTNVKKPETDFDFYK

SEQ ID NO: 18251 - DNA, 1657 bp, Panicum virgatum
  misc_feature: Ceres CLONE 1796314
  misc_feature: Encodes the peptide sequence at SEQ ID NO. 18252
aagcaacggctcgattgatttgctcggggccccaaaaccctcgagatctcggccggtgcctagtggtgtccccccctccggtttcccctcttcgcgcgagggctcccccgcctccgaagcttcgatcccgactccccgccggcgagcgccgcagcggcgggtccgagatgcgccccaacatcatcaccgaggctgggattccaactaggttgaatcagtggtggagcagcattccattcgttacttctggtgttgtctttatatgtggagtaatttatctgctgtgcttgttggttggctatgactcctatgacacgatatgcttcttgccttctgcagtagcatcacattttcaagtatacaggttctacacatctgttctttttcatggttctttgcttcacgtgctattcaacatgcttgcattggtacccttgggcaccgagttggaaagaattatgggatcagtccgtcttttattcttgatgttccttcttgcatcaacaaatgcaattctccatctcacaattgctttcttggtggcttacaatcctttgtaccctgtcccatatcttgtgaaagaatgctccattggcttttctggagttatattctcaatgattgtcattgaaacaagtctcagtggtgtgcaatcgcgaagtgtcttcggcctcttcaatgttcctgcaaaatggtatgcatggattttgctggtactgtttcagtttctcgcaagcaatgtttcattgctgggccacctgtgcggcatcttgtcgggatttgcatacacttatgggcttttcaactacttgcttcctggaccatcattttattctaaaattgagggcttgtcagcactatctgtttgtgtgaggcggcctggttttattctatgtactggagggactacatatggtcagcttcctacatactctaacacgtctgccgcaccaagtgctctcattaatggaaatttgttgagaaatatatcttcatggatgccaaacaggcaggcatccactgttcaggaaggagaagaccccaggtttccagggagagcacgaacacttggttctacaggcactgaacctactgtaagggaggcaaatgcaaatttgcatgcgaggttgttggataacacaactccaagtgaacccgtaacgaattcacagcatgcagttgcaaacacagtccgagctgatgcaacggtaacaacagatcaggctgatacatttgatgaagaacttaagaagctggttgggatgggttttgaaaagactcaggctgaagttgcacttgctgcagctgatggagatccgaacgttgccattgagattctgatgagtcagcagggctgaagtttaatcgtacactacaaattcaagggaagcacggatgtcgagtcaatttttttcttcttatgaaagtgcaaaagttagctgtaactagaaattagaaatggagcatgggcgtgactggattgtgctttggtggttgctgaaaaggatgcccccgatcatgtgcagcctagttgtatttctcaaggctgtcttcagaatatatgtaaaatagaaattaacgttgaaggttctgtcgaactttgacatacggacaatctggacaatgctgaattgaatcctaaaacacctagtggttg

SEQ ID NO: 18252 - protein, 396 aa, Panicum virgatum
  misc_feature: Ceres CLONE 1796314
  misc_feature (58)..(216): Pfam Name: Rhomboid Pfam Description: Rhomboid family
  misc_feature (355)..(391): Pfam Name: UBA Pfam Description: UBA/TS-N domain
  misc_feature: SWISSPROT Homolog: EC 3.4.21.105 Rhomboid protease
MRPNIITEAGIPTRLNQWWSSIPFVTSGVVFICGVIYLLCLLVGYDSYDTICFLPSAVASHFQVYRFYTSVLFHGSLLHVLFNMLALVPLGTELERIMGSVRLLFLMFLLASTNAILHLTIAFLVAYNPLYPVPYLVKECSIGFSGVIFSMIVIETSLSGVQSRSVFGLFNVPAKWYAWILLVLFQFLASNVSLLGHLCGILSGFAYTYGLFNYLLPGPSFYSKIEGLSALSVCVRRPGFILCTGGTTYGQLPTYSNTSAAPSALINGNLLRNISSWMPNRQASTVQEGEDPRFPGRARTLGSTGTEPTVREANANLHARLLDNTTPSEPVTNSQHAVANTVRADATVTTDQADTFDEELKKLVGMGFEKTQAEVALAAADGDPNVAIEILMSQQG

SEQ ID NO: 18253 - DNA, 1821 bp, Panicum virgatum
  misc_feature: Ceres CLONE 1796316
  misc_feature: Encodes the peptide sequence at SEQ ID NO. 18254
aacgcttcccctgctctgatttcctcagctccgctcactcaccacgctccgtcgcgcgcttgaagctccagccctcgccgcaccgcacgtactcccgctcgattcgaacccgacgaccaagccaaggaagctgctgccggtaccatcatggcgcacgacttgcgcgacgacctggagctcgtcggcggcgactactactacttcgacgacgacggcgacgaattccatgacgggttccagaccggcagcggcggcgcttccgggctgcagcatgagcagatggatgatacttctgcttcggattataaagaagggaaagacatccaagggataccctgggaaagattgaactacagtagggaccagtaccgcaagatgaggctgaaagaatacaagaactatcagaacctcactaggtcacgcagcagactagagcaggaatgcaaacaggtggagagaaaggatactttctatgatttccagtccagtacgagatatgtcaaatcgacgatagtccattttcagctgaggaacctcctgtgggctacttcgaagcacgacgtgtacctggtgcagaactactcggtgatgcactggtctcctctgcacctgagagggagagaagtgctcaatgtggccggacaattgactccaacagagaatgtcaaaggggctaggccactgtcgagggttcagatcagcaccatggcactgaaggacaacctcatggtggccggtggcttccagggagaactcatatgtaagtttgttgataaacctggagtggcgttctgcacgaacctgaccggcaacaacaactccatcacgaacgccgtggacatctaccaggcgcccaacggcgccacccgagtgacggccgcgaacaacgactgcgtcgtcaggacgttcgacgccgagagatacagcctcctcacccagttcaccttcccgtggtccgtcaataacacgtcggtgagcccggacggcaagctgatggcggtcctgggcgacagctccgactgcctgctcgccgactcgcagtccgggagggagatcgcggccctgcgcgggcacctggactactcgttcgcgtcggcgtggcaccccggcgggcacgtcgtggcgacggggaaccaggacgcgacgtgccgtctctgggacgtccgcaacccgtccgcgtcgctcgccgtgctcccgggccggatcggcgccgtccgggggctccggttctcccccgacgggcggttcctggccgcggccgaggcggccgacttcgtgcacgtgtacgacgccgcggccgggtacgccggcgccgagcaggaggtggacctgttcggggaggtggccggcgccgcgttcagccccgacggggaggccctgttcgtgagcgtcgccgaccggacctacggcggcgtgctcgagttccggcggcggcggtcgtacgggtacctcgactcgtgcttcttctgaggtgcccggtccgtgtggcgtgcccggactatatagagcgtgtactgtgtactgttggtattttctgtagtgtatgggaaagcgcagtgtttttggcgtacgcgggtcctgagatgactggtgctgcctgcatttcgctcttttagaactgcggagtgacaggtgctatcaggaggtttgtttgggtattatcaaacaattgggcaccttaaacgtgctgttttaggcactgtagtgtcaagaattgtaaatctgtgaatctgtggggtttgccaatgtaagaagagagcttgttcgagtcattaatatctaaaaattgggcaccgaagcccaaaagtgtcataacaggcc

SEQ ID NO: 18254 - protein, 440 aa, Panicum virgatum
  misc_feature: Ceres CLONE 1796316
  misc_feature (300)..(338): Pfam Name: WD40 Pfam Description: WD domain, G-beta repeat
  misc_feature: SWISSPROT Homolog: EC 2.3.1.48 Histone acetyltransferase
MAHDLRDDLELVGGDYYYFDDDGDEFHDGFQTGSGGASGLQHEQMDDTSASDYKEGKDIQGIPWERLNYSRDQYRKMRLKEYKNYQNLTRSRSRLEQECKQVERKDTFYDFQSSTRYVKSTIVHFQLRNLLWATSKHDVYLVQNYSVMHWSPLHLRGREVLNVAGQLTPTENVKGARPLSRVQISTMALKDNLMVAGGFQGELICKFVDKPGVAFCTNLTGNNNSITNAVDIYQAPNGATRVTAANNDCVVRTFDAERYSLLTQFTFPWSVNNTSVSPDGKLMAVLGDSSDCLLADSQSGREIAALRGHLDYSFASAWHPGGHVVATGNQDATCRLWDVRNPSASLAVLPGRIGAVRGLRFSPDGRFLAAAEAADFVHVYDAAAGYAGAEQEVDLFGEVAGAAFSPDGEALFVSVADRTYGGVLEFRRRRSYGYLDSCFF

SEQ ID NO: 18255 - DNA, 2707 bp, Panicum virgatum
  misc_feature: Ceres CLONE 1796338
  misc_feature: Encodes the peptide sequence at SEQ ID NO. 18256
aaaagctgctcgcctgctctgcatcgtgtcaagcctgccccgagtcccacccacctcgtcgtctcccacctcgccctcgcccgctccgccgcgcccgtacgacggcgccatggtcgagtaccgcctcggcgtccagctgcacgggcacgccgacgacgttcgtggcatttgtgtatgtggtgatactgggattgcaacatcatcaagagatgagaccgtgaaattctggacacggaacccagaaaagaagagtgaatatattctctctaagacactcgcaggacattcaagttttgtaggcccattggcttggatccctccttcagaccgcttttctgaaggaggaattgtttctggtgggatggatacatttgttttcctctgggacctgcataaaggagaagttgttgagagaatgaaagggcacaattcacaagtcactggactagctgtagacactaatggtgacatcatctcttcttcaatggattgtactgtaagacggtggagaaatggcaacgctgtagaggtttgggaagcgcacaaggttgcagtgcaaactgttctaaagctgcccacaggagaactctttactggttcaagtgactccaccattaagctgtggaaaggaaggacctgtatacagacattctccggacatgcagatactgttagatgtttagcagcaatgccaggtctaggaattctttctgcctcacacgacagcactatcaagttatgggcgttgacaggtcagcccctgctggagatgattgggcattcttctcttgtatattctgtggatgcacattctccaggtctaattgctagtggcagtgaggatcgctctttgaagatatggaaagatggagtttgtgttcaaagcattgaacacccgggatgcatatgggatgctaaattcttggaaaatggagatattgtaactgcttgttctgatggtactgcaaggatatggacgaccgatactaacaggttctgcagtgatgaggaacttgcagcttatacagatcttatttctcaatacatgcttagcagaaagaccgttggcggactcaagttgacagatctaccaggggttgaggcactgcaagttccagggaattctaatggccagacattgattgttagagaaggggacaatggtgtcgcttattcatggaattcagcagagttcaaatgggacaaaattggtgaagtagtggacggacctggggacgctgcacaaggccaggtttatgatggtgtgcagtatgattttgtttttaatgttgatattggagatggagaacctatacgaaaactgccctataaccgttcagacgatccatacgcagtcgcagacaagtggctcctgaaagaaaatctgcccttgacatatcgccaacaggtggtagaatttatactgcagaattccggccagaataactttgttccagatccatcttttcgtgatccctatactgggggtaatgcatatgtacctggtgggcaaccatcttcatcaaatggtaatgctccaaaacaaattttcaagcacatacccaagagtggaatgctgtcatttgagacagctcagttcgacggaatcctcaagaaagttacagaattcaacacagcactttcatctgactcggaacagaaacaattgtctctgtctgagactgagatgtcaagattacctgccatagtgaaagtattgaaagaaacttcattttatcatacaagcaagcttgcagatgctgacatggcattgttggtaaaaatattgtcttggccagcaaaaatgatgtttccagttgttgattttctgagaatgttcgtgttgcatcctgatggagctgctttacttctcaagaccattgaaactggaaacgatgtacttatggagaccttccttaaagctgtagcaccacctgtgcaaccagcaaatttgcttacaatccttaaagctgtgacaaacttatttgatagctcatgcttgcaccaatggttgaggatccactgtgccgagatcattgattccttgactaactgcaagtcttcgtttagcaagaatgcacacttggcgtatgccacgcttttgctgaactattctgttctttcaattgaagcaaaggatgaacagagtcagactcaaattctttctgctgcccttgaaatcgcagaagatgacgctcaagattttgactccaaataccgggcactcgttgcaattggttcccttatgcaaaagggccttgtgaagtcccttgctctcgaccttgatgttaaaagcgttgcaagcagcgcaaaagcttctatggactcgaagattgctgaagtcggagctaacatcgagctgctaacaagatgagaagagggttgaatgcagtttggggaaattcctccatggaggtgccattgcgcatgatttagctgaggagccggggttcgcgtggcaagccgattcagatgcactcctggagctaccacggttttcctcctgaagaccatagggttatgattagtgtcaacttgtaaccatcacgggactatagaagtgtggattttgggtggttacgctttgcttttgtaaattgaaatgaccggatagttgcctcgatcaaaagttttatgcggcaatgtttacatggacggtgatagcccaatcggcatacttcaacagtttaactgttgaattcttatc

SEQ ID NO: 18256 - protein, 754 aa, Panicum virgatum
  misc_feature: Ceres CLONE 1796338
  misc_feature (482)..(749): Pfam Name: PUL Pfam Description: PUL domain
  misc_feature (334)..(448): Pfam Name: PFU Pfam Description: PFU (PLAA family ubiquitin binding)
  misc_feature (215)..(252): Pfam Name: WD40 Pfam Description: WD domain, G-beta repeat
  misc_feature (175)..(212): Pfam Name: WD40 Pfam Description: WD domain, G-beta repeat
  misc_feature (97)..(134): Pfam Name: WD40 Pfam Description: WD domain, G-beta repeat
  misc_feature (4)..(41): Pfam Name: WD40 Pfam Description: WD domain, G-beta repeat
  misc_feature (50)..(93): Pfam Name: WD40 Pfam Description: WD domain, G-beta repeat
  misc_feature: SWISSPROT Homolog: EC 2.7.11.7 [Myosin heavy-chain] kinase
MVEYRLGVQLHGHADDVRGICVCGDTGIATSSRDETVKFWTRNPEKKSEYILSKTLAGHSSFVGPLAWIPPSDRFSEGGIVSGGMDTFVFLWDLHKGEVVERMKGHNSQVTGLAVDTNGDIISSSMDCTVRRWRNGNAVEVWEAHKVAVQTVLKLPTGELFTGSSDSTIKLWKGRTCIQTFSGHADTVRCLAAMPGLGILSASHDSTIKLWALTGQPLLEMIGHSSLVYSVDAHSPGLIASGSEDRSLKIWKDGVCVQSIEHPGCIWDAKFLENGDIVTACSDGTARIWTTDTNRFCSDEELAAYTDLISQYMLSRKTVGGLKLTDLPGVEALQVPGNSNGQTLIVREGDNGVAYSWNSAEFKWDKIGEVVDGPGDAAQGQVYDGVQYDFVFNVDIGDGEPIRKLPYNRSDDPYAVADKWLLKENLPLTYRQQVVEFILQNSGQNNFVPDPSFRDPYTGGNAYVPGGQPSSSNGNAPKQIFKHIPKSGMLSFETAQFDGILKKVTEFNTALSSDSEQKQLSLSETEMSRLPAIVKVLKETSFYHTSKLADADMALLVKILSWPAKMMFPVVDFLRMFVLHPDGAALLLKTIETGNDVLMETFLKAVAPPVQPANLLTILKAVTNLFDSSCLHQWLRIHCAEIIDSLTNCKSSFSKNAHLAYATLLLNYSVLSIEAKDEQSQTQILSAALEIAEDDAQDFDSKYRALVAIGSLMQKGLVKSLALDLDVKSVASSAKASMDSKIAEVGANIELLTR

SEQ ID NO: 18257 - DNA, 1565 bp, Panicum virgatum
  misc_feature: Ceres CLONE 1796341
  misc_feature: Encodes the peptide sequence at SEQ ID NO. 18258
gctacaaaacgaatccttctcctaccgggggaagaaaagaaaaaaaaaatctttgtcagggtttgactccctcgcctcctatctcgccgcccgagaagcgaggaaggggccaaggcgcgagatgggcggctacgagaacggcgactccccggcggccttcgcgggtgaggacggcgttatcctgggcgtggatggcggcaccaccaacaccgtctgcgtctgcctgccggccgcaatgccgccgccggagtcgcccgccgccgtccccgtgctcgcccgcgccgtcgccggcagctccaaccgcaactctgtcggagaaagcgctgcattggaaactctagagcaggtcatgacacaggctctagcaatggccaacacagatcgttcagctgtccgtgcagtttgtttagctgtatctggagttaaccatccatcagatcagcagaggatgctggaatggatacgggatctgttcccaggcaatgccaaattttatgtggaaaatgattccgtagcagctcttgctagtggtacaatgggaaagctgcatggctgtgtgttgattgcgggcactggaagcattgcttacggggtcacggaagatggaaaagtggcaagagcagctggtgctgggcctgttttgggcgactggggtagtggatatggcattgctgcacaggcccttacagcagtaataaaagcatatgatggccgtggaccacaaactagtcttacacaagatatccttaagaagcttgaactttcttcaccagatgaaatcattgggtggacatacacagatccatcttgggcacgtattgcagcacttgtacctgtggtggtatcttctgctgaagatggtgatgaagtagctaacaaaatcttgcatgattcagtgcaagagttagctgatactgttatagctgttgttcggcgtcttagattgtgtggtgaagatgaaaaggacaaattccctcttgttttggttggaggggtccttgaaggaaataaaaagtgggatatttgtggtgaggtcataaagtgcatttccaaggtcttcccaggcaccaatccaatttggcctgaggttgaacctgcaattggtgccgccttactagcctggagccatcatcgcaaaggattgaagctggagaatggaagttgattcctggcatgggaggatgtgacttgtccattgaggagttggccaacttaatgacacatttggtcccaaagacacattcatcagcatggaggctgctgttgtgtaaataataaatcttggatgggatgcaaacataaggcggcgatcagggatgaaaacatatttctgatgtaagtaggtagtgtccaaagagttgtaaaatagacctttgataactcttgtgatctttgtatgtgtgctgtttacgtttggaggggcgaatatgtatcggtgtatcatggataattgatctttcaaatgtacaatagttttttacatcttcagtttacttggcctctaaacttagttgaaatgttgaacttgagattaatggccagccttttttgctgttattatgtcg

SEQ ID NO: 18258 - protein, 347 aa, Panicum virgatum
  misc_feature: Ceres CLONE 1796341
  misc_feature (21)..(333): Pfam Name: BcrAD_BadFG Pfam Description: BadF/BadG/BcrA/BcrD ATPase family
  misc_feature: SWISSPROT Homolog: EC 2.7.1.59 N-acetylglucosamine kinase
MGGYENGDSPAAFAGEDGVILGVDGGTTNTVCVCLPAAMPPPESPAAVPVLARAVAGSSNRNSVGESAALETLEQVMTQALAMANTDRSAVRAVCLAVSGVNHPSDQQRMLEWIRDLFPGNAKFYVENDSVAALASGTMGKLHGCVLIAGTGSIAYGVTEDGKVARAAGAGPVLGDWGSGYGIAAQALTAVIKAYDGRGPQTSLTQDILKKLELSSPDEIIGWTYTDPSWARIAALVPVVVSSAEDGDEVANKILHDSVQELADTVIAVVRRLRLCGEDEKDKFPLVLVGGVLEGNKKWDICGEVIKCISKVFPGTNPIWPEVEPAIGAALLAWSHHRKGLKLENGS

SEQ ID NO: 18259 - DNA, 1705 bp, Panicum virgatum
  misc_feature: Ceres CLONE 1796343
  misc_feature: Encodes the peptide sequence at SEQ ID NO. 18260
acttgcagtttcgagatctgcgccataccctctcttttcccttcttcttccagacccttcctcgcacctgaccaccacctcccacgcggccggcggcggcagcgactcccactcctcctagcgctgcggcgaggcggcttccccgatcatcttgggtgcgggatgcggaagaaggggagggcggtgccggagtggctcaacagcccgatttggtccgcgcccccgccggcgccggccccgccggacccttacggtgtcgaccttgccccgccgccgccccccaagcccccgccgacccccgcgtctgacacgcccgtgccgccgccgccgtcctacgagcaggcggtgcgggggcgcgggcgaggggatgaggaggatgagggcggcgccggggctgcagccctgcgggcgcatctgctcgccgacttcaaggccgcgctgttgaagaaggtggtgaacatgggggagctgcggcggctggcctgccttggcgtgcccgacggcggcgcaggcgtgcgaccggtcgtgtggaagcttctcttagggtatttgccaactgatcgtggtttatggccctatgagttagaaaagaagcggaaccaatacaatgcatacaacgaagagtttcttctaaatccttcggaaaaactacggagaatcgaggaatcaaagctgtcaagaaaaaaagaactaaatatggagaggactggcttgcttccgagattgaaggttactaatgaagagcatcctttaagctctggtaaatctagcttatggaaccaatattttcaggactcagagatattagaacaaatagatcgagatgtaaagcgaacacatctggatatgccatttttctcagctaagtcgaaccaggattctctgaggcgtattctgattatcttttcaaaattgaaccccagcataagatatgtgcaaggaatgaatgaagttttggcacctctattctacgtattaaagaatgaccctgacccaagtagttcagcttcagttgaagcagacacatacttttgctttgttgagttgttgagtggttttagagacaattattgcaagcatcttgacaatagcagtgtgggtattcgatctacactgtcaaagctgtcccaactcttgaagcgacatgatgaagagctatggcgtcacatggaggttactactaaggtgtacccacaatattatgggtttagatggatcacgttgctgttgacgatggagttcagtttcaatgtatgtatacatatttgggatgctatcttgggcgatccggaaggcccaccggacacactgatgaggatatgctgtgccatgctcatcctagtccggaagcggctgttggctggagacttcactgccaatatccagttgctgcagcattacccagctactaacatcgatcacctcctccacatcgccaaccgattgagagggacagttgccggctagtggttcaatgtcttccctcatacctgtatttcagttttgtccttgttgatagcttggaacatatcggtgttcctagagtggcgtttggcattgcctttatgttctgtttcgccctttttggtgtggccagtcagtccgagactctgagtagaaattctgttttagtatacatcgaaaacactcctgggctccttccagctttcagtacagtaaaagaaggaatgattgcattccatcc

SEQ ID NO: 18260 - protein, 434 aa, Panicum virgatum
  misc_feature: Ceres CLONE 1796343
  misc_feature (166)..(401): Pfam Name: TBC Pfam Description: TBC domain
MRKKGRAVPEWLNSPIWSAPPPAPAPPDPYGVDLAPPPPPKPPPTPASDTPVPPPPSYEQAVRGRGRGDEEDEGGAGAAALRAHLLADFKAALLKKVVNMGELRRLACLGVPDGGAGVRPVVWKLLLGYLPTDRGLWPYELEKKRNQYNAYNEEFLLNPSEKLRRIEESKLSRKKELNMERTGLLPRLKVTNEEHPLSSGKSSLWNQYFQDSEILEQIDRDVKRTHLDMPFFSAKSNQDSLRRILIIFSKLNPSIRYVQGMNEVLAPLFYVLKNDPDPSSSASVEADTYFCFVELLSGFRDNYCKHLDNSSVGIRSTLSKLSQLLKRHDEELWRHMEVTTKVYPQYYGFRWITLLLTMEFSFNVCIHIWDAILGDPEGPPDTLMRICCAMLILVRKRLLAGDFTANIQLLQHYPATNIDHLLHIANRLRGTVAG

SEQ ID NO: 18261 - DNA, 1753 bp, Panicum virgatum
  misc_feature: Ceres CLONE 1796349
  misc_feature: Encodes the peptide sequence at SEQ ID NO. 18262
ctcaggactgagagagggggagtgcaggaggagatgggaggatcttttgggggccaagggatgggcgccgcggcggtgaggccgttgctgcacctgctggtggggctggtgctgtacgaggtggcggaggagatggtcgtgccggcactcgtcgacaaggtcaccgccgcgctctgccccgaccacggcaggaagtgcccggaggccatctacctcaccggcattcaggcttcggtaggagcaattttcaagataataggatttcctctaatgggccagctagctgatgaatatggtcggaagcctatcctcctcctaactgcctctgcgtccataatcccttttgccgtgcttgcatggaatgattcgaggaccgttgtgtatgtctaccttattctgcgcaccttttcattcttgattggccaaggaacattgttcatcatttcacttgcatacacggcagatgtggttgaaccgtcaaagagggcgactgcatttggcttcataacaggaattgcctctgcctctcatgctttgggggatgttttcacaaggtttctacccaagagttggattttccaggtgtctgttattctgttgatctgttcagtcctctacatgaaaatatttctggttgagacacttcaaagagctccatcttcacctagtcggcattcatcattatcatctttggttatcagggtaccacaacaacgttgggaatctatcaaagagaacattaatatatttaaaaacagtgaatcacttaggcgaatagcatgtgttgacttcttctataaattgggcatgagtggcattactgatgtccgactgtattacttgaagtcagtatttggctttgacaagaatcaattctcagaaattcttatggtggtagacattggttccatcttttctcagattttggtccttccccttattggccacgttattggcgaaaaaggaatcttatgtgtttccatccttgcatccattgcttatgcttttctttatggtgttgcatgggcttggtgggtcccttattttagctctttatttggcatcatctttgtgatggccagaccagctatccatgcaatcatttctagggaagtactctcaacggagcagggaaaggcacaaggtttcatcgcgactgtacaatctattgctataatgctggcacctctgtttatgaacccactaacctcttacttcatttcacaggaggctccctttaattgcaaaggtttcagtttcatcgtggctagtgttgtcttggtagcctccttatgttttgcttgtacactgcatcgaaaaagcgcggacaaatgcacagaagttgcagtttcagatgagcctagtgaggaagcattgcaagcccctttattggcttaaaacgccagctggcgaccatcaatgaggtgagagccatctcaaagcggcagacgaatggttaccacagttcacaacgaggttttgctgaaaagcttagtggagtgcatcaacaaccaccgttgttcacaagcagaggaacatgatcagatattccaattcacattgtttgttgatcatcaattattataacatgtttagtattactccctccatttttaaatatatgggtcttatgctgtttaggacaagctaaaatgatataattaccttgtcctaaacatcatatattaaaaaaatagagggagtggtaaatgttataggccttgaagtttgaaatcacaaccattatattatg

SEQ ID NO: 18262 - protein, 454 aa, Panicum virgatum
  misc_feature: Ceres CLONE 1796349
  misc_feature (21)..(385): Pfam Name: MFS_1 Pfam Description: Major Facilitator Superfamily
MGGSFGGQGMGAAAVRPLLHLLVGLVLYEVAEEMVVPALVDKVTAALCPDHGRKCPEAIYLTGIQASVGAIFKIIGFPLMGQLADEYGRKPILLLTASASIIPFAVLAWNDSRTVVYVYLILRTFSFLIGQGTLFIISLAYTADVVEPSKRATAFGFITGIASASHALGDVFTRFLPKSWIFQVSVILLICSVLYMKIFLVETLQRAPSSPSRHSSLSSLVIRVPQQRWESIKENINIFKNSESLRRIACVDFFYKLGMSGITDVRLYYLKSVFGFDKNQFSEILMVVDIGSIFSQILVLPLIGHVIGEKGILCVSILASIAYAFLYGVAWAWWVPYFSSLFGIIFVMARPAIHAIISREVLSTEQGKAQGFIATVQSIAIMLAPLFMNPLTSYFISQEAPFNCKGFSFIVASVVLVASLCFACTLHRKSADKCTEVAVSDEPSEEALQAPLLA

SEQ ID NO: 18263 - DNA, 1499 bp, Panicum virgatum
  misc_feature: Ceres CLONE 1796354
  misc_feature: Encodes the peptide sequence at SEQ ID NO. 18264
gagcgccgagcgcaactgggaagctgcagagtgggaagatgagaaaggggaagcgagctcgccgccgccggtgaaggcgccggcactgacgtcaccgatcgccgcctgcttcctagagactttgacatcatgcagaacaccagcaaaatatcgagcaccacaatcacgtcgctgagcgacgacgtgctcaccgagatcctcttccacctcccgtccctggcctcgcttgcccgtgcggccctcacctgcccacggtggcgccgcctggccacctcccgccacttcctcgccggcttcggcgcgcgccacgcctcgctcccgctcctcggctgcttcttctgcgccgacgacggctacttcgaggtgcccgtcttccagcgcgcacgaaacctccctgacatggacttggccgctgtggtccgcggcggcgacttcctgctatccagcttctttgaagatgacctgtggacgttcaaagacatttgtcagggcctcctcctcttcgccagcgacgacgagctcgccgtgttcaacccggtgtcgcggcgctgcacgtgcgtacccttgccaaacacatctgaattcggtgagcatgatagggaggcctcggtcgactgcttgctccctgcttgcggcgccgccgacgcggcattccgtgtggtttccctagagcgcgatgagaaagagcgggtgcgcgtccacgggtacaactcccgcacgggcgagtggcgccccagccgtggacgccgcacggcatcatcaattggagtccggacgattcgttgcgggcgatgcacgctgccgggcgtatctactggaagcacagcaacaagctgctctgtctcgagatggcacctagcgggtcactgcaggtaagccacattgccctcccaccggtgccaggcttactagaggtggcggcgtcgtacgtggtcggggacatggaggacggcacctgctgcctcgcttgcgtcgcaatgtctcgacgtctccggagtccggacccgtactttgcaggtgtggcttcgcagggaggatggcggcgggtcctgggagttgggatgggagaccaagtttctctcaggatattcactctgcgcggtgaatgccggcattgtgctgttcgaggaatacagggcctatcgcctcagcgagattgacgagttgcgttttggaggctatcctgggacggaggcatccttcttcgccggccgtggatcggaggcgtacccgtatgtggcatgctccaccgtgctgctgggcaggctcatacaagacgacggagatgaggcacgcgcgccgcctgggtgatcaactgccgaggctgaacatcatcaattttctgaccggacgtgatagtcactgtagcattactgtagacaaccatcaattaattaggtttgttagattcgcctcagtaaaataacatccatctttgaaaatgttttgtatatagactttgtttagtacttcatatgtaaaaaaaaattgtacgagcg

SEQ ID NO: 18264 - protein, 248 aa, Panicum virgatum
  misc_feature: Ceres CLONE 1796354
  misc_feature (10)..(58): Pfam Name: F-box Pfam Description: F-box domain
MQNTSKISSTTITSLSDDVLTEILFHLPSLASLARAALTCPRWRRLATSRHFLAGFGARHASLPLLGCFFCADDGYFEVPVFQRARNLPDMDLAAVVRGGDFLLSSFFEDDLWTFKDICQGLLLFASDDELAVFNPVSRRCTCVPLPNTSEFGEHDREASVDCLLPACGAADAAFRVVSLERDEKERVRVHGYNSRTGEWRPSRGRRTASSIGVRTIRCGRCTLPGVSTGSTATSCSVSRWHLAGHCR

SEQ ID NO: 18265 - DNA, 1245 bp, Panicum virgatum
  misc_feature: Ceres CLONE 1796363
  misc_feature: Encodes the peptide sequence at SEQ ID NO. 18266
gattccgccactggtggtgtccgatggcaatcaggcggcagatgattctcagcttcccgtcgagtgagcgagcactttgctgacacggcgagcagcaggctataagcaagctccaacttgtgagtgatcagcaaccgtgatggcgtcggagaagaccaagatcctggtggtcggcgccacggggtacctgggccggcacgtcgtggcggcgagcgcgcggctgggccacacgaccttcgcgctcgtcagggacgcggcgccgtccgacccggccaaggcggcgctgctcaagagcttccaggacgccggcgcgacgctcctcaagggcgacctctacgaccaggccagcctggtgagcgccgtcaaggccgccgacgtggtcatctccacggtcgggtcgttgcagatcgccgaccagaccaggctcgtcgacgccatcaaggaggccggcaacgtcaagaggttcttcccgtcggagttcgggctggacatggaccgcacgggcatcgtggagccgggcaggacactcttgtcgggcaaggtggccgtccggcgcgccgtcgaggccgccggcatcccctatacgtacgtggtgaccggcttcttcgcgggctactcgctgcccgggatcgggcaggccctcgcccaggggccccccgccgacaaggccgtcgtcctcggcgacggcaacgccaaggccgtgtacatggaggagggcgacatcacgacgtatacggtgctcgccgccgacgacccgcgcgccgagaacaagacgctgtacgtgcggccgcaggccaacacgctgtcgcacaacgagctgctggcgctgtgggagaagaagaccggcagggcgctcgagcgggagtacgtcccggaggaggccatcctgaagcaaatccgagagtcgccggtgccggcgaacatcgtcctggcgatctggcacgcggcgcacgtgaggggggagcagaccggcttcgaggtcgacccggcgaagggggcggaggccgccgagctgtacccggacgtcaagtacaccaccgtcgacgagtacctcgacaggttcctctgaggaagacgacgcgcgtgatcatagatgtgtctccgattgatgcagtgtccaggtcgtgatgtcaatttgcacggcaataagatccgttccctttcgtggatcgtgatccagttttttgttgcattggtgtactgtatgtgctgctactcttgtaatggacggccctgccatttctt

SEQ ID NO: 18266 - protein, 309 aa, Panicum virgatum
  misc_feature: Ceres CLONE 1796363
  misc_feature (8)..(300): Pfam Name: NmrA Pfam Description: NmrA-like family
  misc_feature: SWISSPROT Homolog: EC 1.3.1.45 2'-hydroxyisoflavone reductase
MASEKTKILVVGATGYLGRHVVAASARLGHTTFALVRDAAPSDPAKAALLKSFQDAGATLLKGDLYDQASLVSAVKAADVVISTVGSLQIADQTRLVDAIKEAGNVKRFFPSEFGLDMDRTGIVEPGRTLLSGKVAVRRAVEAAGIPYTYVVTGFFAGYSLPGIGQALAQGPPADKAVVLGDGNAKAVYMEEGDITTYTVLAADDPRAENKTLYVRPQANTLSHNELLALWEKKTGRALEREYVPEEAILKQIRESPVPANIVLAIWHAAHVRGEQTGFEVDPAKGAEAAELYPDVKYTTVDEYLDRFL

SEQ ID NO: 18267 - DNA, 2003 bp, Panicum virgatum
  misc_feature: Ceres CLONE 1796371
  misc_feature: Encodes the peptide sequence at SEQ ID NO. 18268
ctctcccaccgcctcctgcgactcctctccgttccccccctcctctccctcgcgaacccaccacaagagaatcaatcaagaagaagaagcgggagaagggagatggcgaagaagaaggagaaggcggtgaacgtgtcgggcaagccgcggcactcgaacgacgtcaaccgccccaatgacaagaagggcgccggcggcggcgccggcggcggggcccggtccgcggcgaccgtccggcggctgaagatgtacaagacgcggcccaagagggaccgctccgggaaggtgctcaggaacgagttccagtccaaggagctccccaacacccgcatcgagcccgaccgccggtggttcggcaacacccgggttgtgggccaaacacagcttgcattgtttcgggatgaactcaagaatcgtctttctgacaacttcagtgtcatcctgaaagaacggaagctaccactatcacttctgcaggatcatcaaaagcaagcgagagcacatttgcttgatgttgaaccttttgagcatgcttttgggccaaagggcaagaggaaacgcccgaaactaactgctctggactatgaatctttgctgaagaaagctgatgattcccaagatgcatttgagcaaaagtatgcttcctcaacgttgccaagggaggaagaagaagatggcttaagggatctagtgaggcacacgatgtttgagaagggacagagcaaaagaatctggggtgaattgtacaaagttattgactcttcagatgttgttgtgcaggtgttggatgctagggatccaatgggcactcgatgctatcatctagagaaacatctaaaggagaattgcaaacacaaacacttggtattcttactaaataagtgcgatctaatccctgcttgggctacaaaaggatggttaaggaccctgtcaaaggactatcccaccctagcattccatgctagcatcaacaagtcatttggcaaaggatctcttctgtcagtattgaggcagtttgctcgtttgaagaatgacaaacaagctatatctgttggatttgttgggtaccccaatgttgggaagtcatctgttattaacacattacggtcgaagagtgtttgcaaggtcgcgcccattcctggagagacaaaagtgtggcaatacatcactctcactaaaaagatctttttgatcgattgtcctggcgttgtgtatcaaaataatgattcagaaactgatatagttctaaagggtgtggtacgagtgacaaatttagaggatgctgctgagcacattggtgaagttctgaggcgtgttaaaaaggagcatctgcaaagagcatacaaaattcaagattggactgatgataacgattttcttctccagctgtgcaggactactggaaaacttctcaagggtggggagcctgacctgacaacggccgccaagatggttcttcatgactggcagaggggtaaaattcccttttttgtaccccctccgcagcagagtgatgatggtgcatctgaaattgctgagcctgttgagaaaaccgaagaggatggagtaagcagcgaccggactgctgccgccatgaaagccattgcacggataatttcgtctcagcagaacctgaatgtaccttgccataaggaacatgatgcagacaatgaagacattgaaagtgaagataacgaggagatcgaacttccagagcaatcagagtaacttcgggtacggatatggactaaagttgatatgtcagcactcaggagtgtgtagttacttaacctcgttatcactgtagttccagaaaaggattcatgttggttcagccgctacaaaggatggtgatttgcttagccactcgcctaattttttgtagcttttatcgtacctaaatcttgtaatagtgcaaatagagcagttttgctagctacctcgttggatcgcakggtttatstgcttcaaattcagttatatatacatttttcttaaaaagg

SEQ ID NO: 18268 - protein, 541 aa, Panicum virgatum
  misc_feature: Ceres CLONE 1796371
  misc_feature (49)..(175): Pfam Name: NGP1NT Pfam Description: NGP1NT (NUC091) domain
  misc_feature (315)..(417): Pfam Name: MMR_HSR1 Pfam Description: GTPase of unknown function
MAKKKEKAVNVSGKPRHSNDVNRPNDKKGAGGGAGGGARSAATVRRLKMYKTRPKRDRSGKVLRNEFQSKELPNTRIEPDRRWFGNTRVVGQTQLALFRDELKNRLSDNFSVILKERKLPLSLLQDHQKQARAHLLDVEPFEHAFGPKGKRKRPKLTALDYESLLKKADDSQDAFEQKYASSTLPREEEEDGLRDLVRHTMFEKGQSKRIWGELYKVIDSSDVVVQVLDARDPMGTRCYHLEKHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLEDAAEHIGEVLRRVKKEHLQRAYKIQDWTDDNDFLLQLCRTTGKLLKGGEPDLTTAAKMVLHDWQRGKIPFFVPPPQQSDDGASEIAEPVEKTEEDGVSSDRTAAAMKAIARIISSQQNLNVPCHKEHDADNEDIESEDNEEIELPEQSE

SEQ ID NO: 18269 - DNA, 2997 bp, Panicum virgatum
  misc_feature: Ceres CLONE 1796372
  misc_feature: Encodes the peptide sequence at SEQ ID NO. 18270
tccgcacggccgcagccaacgacgccaccacggcgacgctacgcccgagcaaaaccgttgtcggcacacgccaccacggcgccgccgacacaccgcagtgcaggtagaccagacgccgccgagatcgcagccgcaagccgggcgccgagtgcggccgtcgctcacccccccggccgccaaggccgcgggcgcccccgtccacacccacgcccagcaacgcaccactgcgggagcgctgccgccgcgcgctagctggaacaagtgccgccactccggcaccggagcgccatgtgcccagtcgcgccgggccgcgagcgccgccgcggccggcaccgcagtgcctcgtgcccagccgccgcgggcagcgagtgccgccgcctccgcgtcctgcaatgcaaggccgcggcaggcaacacccccgcgcaccactgctccacgccgccgccgccgcaccccgccccgccgagcgccccgccgagccccagggaggtcagatccggcgaccgggggtgcggatccggccgctggccgccgggagcggcggccgccgccacggacaggccgtcacagcgcaggagccgcgccgccgccccccgacgcgcctaggaggctagatccggcggcgtagggtgcggatccggccgcccgggaggtggatcaggccgctggacgccggagtcggccaccacggccatgactggcgagctaccaagcgagggcgagggggagggaaggagagagcgagaggaaggtggagccccgccgccgccttccttgcggccgcacgggcttccggcggccgctcaggcggcggcgaggcggttggggcatggcctggggcgcggcggctctcggggctggttctgcccgacttcagtactcgtctgcagttatttttgtacatgctggtggtttctattttttttttttcacactacttgaactctgctcaggcctataccagcacgtgccgtgatacccatttatgccagttctgatggatcaacagaagacgggagcctcatgtcatcaaatcaacaaggacagcgcgactcttcatctctaccaacaacatcttcatgcccaagtgaattcgttaacgacattcatcaacatggctatcatttgtctccagaatatgctcggcgatatatggatggagatgctcatagtgcactaaatcctggacacgtctacagtccattgttgccaaccacatgctctgaatcaaactgccaccatttaacagaagatgatgatgctgaactaagtctctttaaggttgaacggaaccaaaacaacagtgatatgcttccgtggaagtacatagaggaacacaaggagccggcaagaaacccggaaagttcctcttccaaccttccatctcagagaaacagaccggatgtagaaccgtgtagtcagtcagcaattggcccaaagcataaacacttgagccttgacactttatcttctgacagtcaacgcagagaaagaatcactgaggaatttatagatcatgattaccatgatatcacccaaccgctgttgaaacgctggccaccgattcagtcacctagagaggacaatatagttggatctgctcaggaagggtctcacatactcccactcacccttaaagccttgccaaggccaatcgagacgaaacggatgctggaatgtctccctacaagactcgaatgcagaatattcaagcctgatgatatcacgaacgcgactcagcatttctctgacgagctgaagattggggaaggaggctacggacccgtctacaaagcgacacttgacggcactgttgtggccatcaagatcctctattctaatataactcagggactgaagcagtttcaacaggaggtcgagctgctgaataacattcggcaccccaacatggtgcacctggtgggcgcgtgcccggagtacggctgcctggtgtacgagtacatgccgaacggcagcctggaggaccgcctcttctgccggtccggcacgccgccgctgccgtggccgctccgcttcaagatcgcggtggagatcgccagcggcctgctgtacctgcacaagatgaagcccgaggcgttcgtccaccgcgacctcaagccgggcaacatcctcctggacgccggcttcgtctccaagatcggcgacgtcgggctggcgcgcatcatcccgcggtccatggacggcggcgccgccgcgacgacgcagtaccgggagacggcggcggcgggcaccttctgctacatcgacccggagtaccagaagacggggctggtctgcaccaagtccgacgtgtacgcgctgggcgtcatctacctccagatggtcaccgccagggagcccatggggctcgcctacaccgtctccgacgcgctggaggagggcacgttcgccgacgtcctggaccacaaggtgaccggctggccggtgcaggaggcccgggcgctcgccgagctggcgctcaagtgctgcgagatgcggcgcagggaccggccggacctggagaccgtcgtgatgcccgagctgatccggctgcaccggctcgtctcgccgtcggaatatcctcctccttccatggatcaggctcatcaccgttcatcaagtgagaaggatttgcgtttggatgatgacctggttcacattctgagcgatgggcccatgaaaggaggaatatcatttgcaatataaacaccatgaggaccacaagtaggtctgattgtactataagtgctttcattggaatctgcagtggtttctatgattttgttttttgtaaataccgccttagcccggcaattttggggatcattatgcttggaattctgccatgatcaggacaatgcatgagtagtgacaaaaatcatcagcttggtattttttttaattttatgtacgtccactgaaggatattatctatgaaagattcagatgacaacatcgttgtacaatttcccatggtataaataaaaaattgaatgc

SEQ ID NO: 18270 - protein, 517 aa, Panicum virgatum
  misc_feature: Ceres CLONE 1796372
  misc_feature (198)..(465): Pfam Name: Pkinase Pfam Description: Protein kinase domain
  misc_feature: SWISSPROT Homolog: EC 2.7.11.1 Non-specific serine/threonine protein kinase
MDGDAHSALNPGHVYSPLLPTTCSESNCHHLTEDDDAELSLFKVERNQNNSDMLPWKYIEEHKEPARNPESSSSNLPSQRNRPDVEPCSQSAIGPKHKHLSLDTLSSDSQRRERITEEFIDHDYHDITQPLLKRWPPIQSPREDNIVGSAQEGSHILPLTLKALPRPIETKRMLECLPTRLECRIFKPDDITNATQHFSDELKIGEGGYGPVYKATLDGTVVAIKILYSNITQGLKQFQQEVELLNNIRHPNMVHLVGACPEYGCLVYEYMPNGSLEDRLFCRSGTPPLPWPLRFKIAVEIASGLLYLHKMKPEAFVHRDLKPGNILLDAGFVSKIGDVGLARIIPRSMDGGAAATTQYRETAAAGTFCYIDPEYQKTGLVCTKSDVYALGVIYLQMVTAREPMGLAYTVSDALEEGTFADVLDHKVTGWPVQEARALAELALKCCEMRRRDRPDLETVVMPELIRLHRLVSPSEYPPPSMDQAHHRSSSEKDLRLDDDLVHILSDGPMKGGISFAI

SEQ ID NO: 18271 - DNA, 724 bp, Panicum virgatum
  misc_feature: Ceres CLONE 1796375
  misc_feature: Encodes the peptide sequence at SEQ ID NO. 18272
actcgttcgccgctggcctcgcttcgcttcctccttcccctggccctcgccgattgcgccccgcgatggagtgggacagcgactccgacggcggcggcggcggcggcggtgacgacgaggaggaagaggaggaggaggaggtccaggccgggcccgggcccccggggttctcgctggccatcgagggcgtgctgggcgcgtgcgggatcgtggtctccgacgcgctcgagcccgacttccccatcatctacgtcaaccgcgggttcgaggacgccaccgggtaccgcgccgaggaggtgctcgggaggaactgccggtttttgcaatgcagaggaccatttgctcagaggagacatccccttgttgatgctgcagtagttactgggattcggagatgtttagaggatgggaccaaattccagggtgatctgttgaattttagaaaagatggttctccatacatggcaaagctgcgactaacaccaatatatggagacgatgacgcaataacacactatatgggcattcagtttttcaatgattccaatgttgatttggggccatcgcctggctctgtaacaaaggaacttgcgagatctacatggattgcaccagataacacacccccaccatcttcggtgggcaaggctaacttatgggratattctagtatcttcctgctgagtgatgaggtactgtgccmaaagatctttctcaacctgtc

SEQ ID NO: 18272 - protein, 219 aa, Panicum virgatum
  misc_feature: Ceres CLONE 1796375
  misc_feature: SWISSPROT Homolog: EC 2.7.11.1 Non-specific serine/threonine protein kinase
  misc_feature (199)..(199): Xaa is any aa, unknown, or other
  misc_feature (213)..(213): Xaa is any aa, unknown, or other
MEWDSDSDGGGGGGGDDEEEEEEEEVQAGPGPPGFSLAIEGVLGACGIVVSDALEPDFPIIYVNRGFEDATGYRAEEVLGRNCRFLQCRGPFAQRRHPLVDAAVVTGIRRCLEDGTKFQGDLLNFRKDGSPYMAKLRLTPIYGDDDAITHYMGIQFFNDSNVDLGPSPGSVTKELARSTWIAPDNTPPPSSVGKANLWXYSSIFLLSDEVLCXKIFLNL

SEQ ID NO: 18273 - DNA, 680 bp, Panicum virgatum
  misc_feature: Ceres CLONE 1796375-R
  misc_feature: Encodes the peptide sequence at SEQ ID NO. 18274
tgaagacaagccatgctggcggtgcatcactggctgcgggatgccaggagctggtaatcctgctggagttggcccacctcctcgccttgatcacgttgcagtgagccttcctggaggtagagttttgatatttggtgggtctgtggcgggtcttcactcagcctcacagctttacctcctagatccagctgaagagaagccgacctggaggattctgaatgttccagggcggcctccacggtttgcttggggccacagcacctgcgtcgtgggaggaacaaaggctatagttcttggaggacaaaccggagaagagtggacactaactgaaatgcatgagctttctctgctaagctcattagtttgaagatgaaaagcttccttgaagagacatctctggtgaacagctacttgttcgtgtgagtgtgactcaggctgaaacaattttttccaacagtggggctaggggtggcgaagtgattttactgtcatatcagggtaattgtggagtagcccctgaagtggatcgaatcttactactcgatctatgtctgggagtcgcctcatctagaagtaggaataagttacctctgctgttgctgttgctgttgctgttgttgtttgtatggtctacgctgcaataacatacataagctaatctcagttcttatcgtgtttcc

SEQ ID NO: 18274 - protein, 121 aa, Panicum virgatum
  misc_feature: Ceres CLONE 1796375-R
  misc_feature (28)..(76): Pfam Name: Kelch_2 Pfam Description: Kelch motif
  misc_feature: SWISSPROT Homolog: EC 3.1.3.16 Phosphoprotein phosphatase
EDKPCWRCITGCGMPGAGNPAGVGPPPRLDHVAVSLPGGRVLIFGGSVAGLHSASQLYLLDPAEEKPTWRILNVPGRPPRFAWGHSTCVVGGTKAIVLGGQTGEEWTLTEMHELSLLSSLV

SEQ ID NO: 18275 - DNA, 1438 bp, Panicum virgatum
  misc_feature: Ceres CLONE 1796377
  misc_feature: Encodes the peptide sequence at SEQ ID NO. 18276
atccccttcttaaaccctgccaccgcagcctcctcccctcacacctgccgagcgccgagtgccatccccagcagctcttccgtccatctcgatccacagtagcccaagaagctagctagctctcggccatggccaccaccgcgtcgaccctcctcaagtcctccttcgccggcgcccggctcccggccgccccgcgcgccccgtcctccgtcgccgtggcggccccgcgcggcgccgggcccatctgcgcctcggcctcctcctccagtccgccctacgacctcacgtccttccggttcagccccatcaaggagtccatcgtcgcccgcgagatgacccttcggtacatgaccgacatgatcacccacgccgacaccgacgtcgtcatcgtgggcgccggctccgcggggctctcctgcgcgtacgagctctccaaggacccctccgtcagcatcgccatcgtggagcagtccgtgtccccgggcggcggcgcctggctcggcggccagctcttctcggccatggtggtgcgcaagcccgcccaccgcttcctcgacgagctgggcgtcgcgtacgacgaggccgaggactacgtcgtcatcaagcacgccgcgctcttcacctccaccatcataagccgcctcctggcgcgccccaacgtgaagctcttcaacgccgtcgccgtcgaggacctcatcgtcaagcagggccgcgtcggcggcgtggtcaccaactgggccctcgtctccatgaaccacgacacccagtcctgcatggaccccaacgtgatggaggccaaggtcgtggtcagctcctgcggccacgacgggccgttcggggccaccggcgtcaagaggttgcaggacatcggcatgatcagcgccgtgcccgggatgaaggccctggacatgaacaccgccgaggacgagatcgtccgcctcacgcgtgaggtcgtgcccggcatgatcgtcaccggcatggaggtcgccgagatcgacggcgccccgagaatgggcccgacgttcggcgccatgatgatctccggccagaaggcggcgcacctggcgctgaaggcgctgggcaggcccaacgccatcgacgggacggccccggcggcgtcgccggcgtggcgagaggagttcgtgatggcgtccaaggacgacgaggtcgtggacgcgtgagcaggggaaggcgttggagcgggggacgcgcgctgggtggggcgatttccgtggggattttctccgtttcttctggactctgctgccttgttcaacttagctctgtctcgctagtgtcgtgttcatacttcatagcactgccatgccagtatgccgctgtgtgctctgtctcgtgggggcaccactctgtggggccctcctggcagcaggaataaagagaagatgaaataaaatgcatgttggtgacttggtgtggt

SEQ ID NO: 18276 - protein, 350 aa, Panicum virgatum
  misc_feature: Ceres CLONE 1796377
  misc_feature (57)..(299): Pfam Name: Thi4 Pfam Description: Thi4 family
  misc_feature: SWISSPROT Homolog: EC 1.3.99.1 Succinate dehydrogenase
MATTASTLLKSSFAGARLPAAPRAPSSVAVAAPRGAGPICASASSSSPPYDLTSFRFSPIKESIVAREMTLRYMTDMITHADTDVVIVGAGSAGLSCAYELSKDPSVSIAIVEQSVSPGGGAWLGGQLFSAMVVRKPAHRFLDELGVAYDEAEDYVVIKHAALFTSTIISRLLARPNVKLFNAVAVEDLIVKQGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAIDGTAPAASPAWREEFVMASKDDEVVDA

SEQ ID NO: 18277 - DNA, 1234 bp, Panicum virgatum
  misc_feature: Ceres CLONE 1796379
  misc_feature: Encodes the peptide sequence at SEQ ID NO. 18278
acccacacaggaaaccgcaagagccacacgccccgcgcacccaccaacccaaagggggaggaacagccgccgccaacgccgccgccgccgccgcgcgcggagtcacaccaccactccagtactccactaccgagcgcgcgcgagagagagagagggagaggggaggcgcctgggcggcggagatggcggcgggagcagggacgcgggaggagatggtgtacatggcgaagctggcggagcaggcggagcggtacgaggagatggtggagttcatggagaaggtcgccgcggcggcgggcgccggggagctcaccgttgaggagcgcaacctgctgtcggtcgcctacaagaacgtcatcggcgcgcgccgcgcgtcgtggcgcatcgtctcttccatcgagcagaaggaggaggcccgcggcgccgcgggccacgccgctgccgccaggggctaccgcggccgcgtcgaggccgagctctccggcatctgcgcggggatcctgcgcctcctcgacgaccgcctcgtccccgccaccgccgccgtcgacgccaaggtcttctacctcaagatgaagggcgactaccaccgctacctcgccgagttcaagaccggagccgagcgcaaggacgccgctgactccaccctagccgcctaccaggccgcccaggacatagccataaaggagctgccgcccacacaccccatcaggctcggcctcgcgctcaacttctccgtcttctactacgagatcctcaactcgccggaccgcgcgtgctcgctcgccaagcaggccttcgatgaagccatttcagaactggacactcttggggaagagtcctacaaggatagcaccctgatcatgcagcttcttcgtgacaacctcaccttgtggacttctgacatgcaggatgatggcggcgatgaaatgagggatgcgagcaagcccgaggatgagcagtagccatcgattcaagcaactgccgtctctatctcttaaccctttgggtagtcgtgatgcttgtacaaggaccattttcgtgtgtcctttatcatcggatctgcttacctttcgttttgttatattcctatattgtgttatccatgtattgttttactttcctactggaaccctgttagtgtgtgggagagaataacctaagcctgcctttaactagtacaaggattgtcaactcttttgtactatgattgaatggttatgcatgttccatatat

SEQ ID NO: 18278 - protein, 259 aa, Panicum virgatum
  misc_feature: Ceres CLONE 1796379
  misc_feature (8)..(245): Pfam Name: 14-3-3 Pfam Description: 14-3-3 protein
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 801 in the 11/479,226 US patent application
  misc_feature: The sequence is a functional homolog of SEQ ID NO 789 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 809 in the 11/479,226 US patent application
  misc_feature: The sequence is a functional homolog of SEQ ID NO 793 in the 11/479,226 US patent application
  misc_feature: The sequence is a functional homolog of SEQ ID NO 1777 in the 11/479,226 US patent application
MAAGAGTREEMVYMAKLAEQAERYEEMVEFMEKVAAAAGAGELTVEERNLLSVAYKNVIGARRASWRIVSSIEQKEEARGAAGHAAAARGYRGRVEAELSGICAGILRLLDDRLVPATAAVDAKVFYLKMKGDYHRYLAEFKTGAERKDAADSTLAAYQAAQDIAIKELPPTHPIRLGLALNFSVFYYEILNSPDRACSLAKQAFDEAISELDTLGEESYKDSTLIMQLLRDNLTLWTSDMQDDGGDEMRDASKPEDEQ

SEQ ID NO: 18279 - DNA, 757 bp, Panicum virgatum
  misc_feature: Ceres CLONE 1796388
  misc_feature: Encodes the peptide sequence at SEQ ID NO. 18280
atcctctcttccccccctcctccgcaatggccgtctccacctccacaacctccccgctcccgctcctcttgctccaccgcggcacggcgaaccctagccccgcgtctctctccttctcctcctctctccgcgcgacgtccctccgttcccgcgccgccgctgctccccccgcagagaccctttccgaagacggcatccccgacgcgccaccggaaggggaggggacggggattccgttgccatcttcgattggggatgatggagagcagttggcacccaagcagaagatcagaatcaagctgcggtcctactggattcctttgatagaggactcgtgcaagaagataattgatgctgccaaaacaaccaatgcaaagaccatgggtcctgttcctctgccaaccaagaggagagtatattgtgtgctcaactctccccatgtgcacaaggattcacggttccatttcgagatccggacacatcagcggctgattgatatcatgtatccaactgcccaaacaattgactcactgatgcagctccagctccccgctggtgtggacgttgaggttaagctatgattctgttggagctgaagtttcagagtttgatgtagtatggactcatttaccgcagcctttatttcttgatctttttgttgtctgggatgggactaaaaaaatgtagagcctgtaataggaaggaggaagatgttgagacacgagttatcttgcaatgaagcatattgaaatgcgat

SEQ ID NO: 18280 - protein, 184 aa, Panicum virgatum
  misc_feature: Ceres CLONE 1796388
  misc_feature (87)..(182): Pfam Name: Ribosomal_S10 Pfam Description: Ribosomal protein S10p/S20e
MAVSTSTTSPLPLLLLHRGTANPSPASLSFSSSLRATSLRSRAAAAPPAETLSEDGIPDAPPEGEGTGIPLPSSIGDDGEQLAPKQKIRIKLRSYWIPLIEDSCKKIIDAAKTTNAKTMGPVPLPTKRRVYCVLNSPHVHKDSRFHFEIRTHQRLIDIMYPTAQTIDSLMQLQLPAGVDVEVKL

SEQ ID NO: 18281 - DNA, 719 bp, Panicum virgatum
  misc_feature: Ceres CLONE 1796397
  misc_feature: Encodes the peptide sequence at SEQ ID NO. 18282
aaattccaatccgccaccaaaccccacctcactcaaaccacccgcgcgcccccatggccgcggccgcgtcctcggaggaggccgtcaaggcggcgaaggtgctgatggtcggggcgggaggaatcggctgcgagctgctcaagacgctcgcgctctccggattcagcgacatacacatcattgacctggacacaattgaagttagcaatctgaatagacaatttttgtttcggcagagtcatgttgggcagtcaaaagccaaagttgctagagatgctgttttgaaatttaggccaaatataaatataacaccataccatgcaaatgtgaaggattctaaattcaatgttgaattcttcaagcaatttaatgtggttctgaatggtcttgataacttgaatgctagacgccatgttaatcgcctttgccttgctgctgaagttcctttggttgaaagtgatactactggttttttgggacaggttactgttcacgtcaagggtaaaacagaatgctatgaatgccagccaaaacctgtcccaaaatcatatcctgtctgcacaattacaagcacaccatcaaagtttgtgcactgcattgtttgggcgaaggacctgctttttgcaaagctatttggtgacaaaaaccaggataatgatcttaatgtgcgctccaatgatgatagcagttcaaaaactgatgtttttgaaaggaatgta

SEQ ID NO: 18282 - protein, 221 aa, Panicum virgatum
  misc_feature: Ceres CLONE 1796397
  misc_feature (12)..(148): Pfam Name: ThiF Pfam Description: ThiF family
MAAAASSEEAVKAAKVLMVGAGGIGCELLKTLALSGFSDIHIIDLDTIEVSNLNRQFLFRQSHVGQSKAKVARDAVLKFRPNINITPYHANVKDSKFNVEFFKQFNVVLNGLDNLNARRHVNRLCLAAEVPLVESDTTGFLGQVTVHVKGKTECYECQPKPVPKSYPVCTITSTPSKFVHCIVWAKDLLFAKLFGDKNQDNDLNVRSNDDSSSKTDVFERN

SEQ ID NO: 18283 - DNA, 735 bp, Panicum virgatum
  misc_feature: Ceres CLONE 1796399
  misc_feature: Encodes the peptide sequence at SEQ ID NO. 18284
atccctctccgcctccgaccgagagccctccctccctccatcttcctccccacctggcgattgagaaaggtgtccccggctagtaggtagaatgctgctgagctcccccttggtgtccccggcgctgcgggtccctccgcggccggcgcctcctcttcctcgggcgcggccgcggccgccgaggatctggcgggggccgtggcggcgatgacgctcgaggagcggttcgcgacgctgcgggggatcggggaggagtgcatccaggaggacgagctcatgcgcctgctgcagaacaagcccgtccccatctgctacgacggcttcgagccctccgggcgcatgcacatcgctcagggcattgtcaaaaccatcaacgtcaacaagatggtcagggctggatgcaaggtgaaaatctggattgcggactggtttgcacagctcaacaacaagatgggaggtgacctgaagaaaatccagacagttgggcgctacatgatcgagatctggaaagcggctgggatgaaccttgatggcgtggagttcctttggtcttcggaagagatcaacaagcgtgcgcacgagtactggccacttgtgatggacattgctcggaaaaacaatgtcaaaagaattaccagatgctgccaaattatgggcagaagtgaccaggaagatttgactgctgcccagattttctacccttgcatgcaatgtgctgatatatttttcttgaag

SEQ ID NO: 18284 - protein, 175 aa, Panicum virgatum
  misc_feature: Ceres CLONE 1796399
  misc_feature: SWISSPROT Homolog: EC 6.1.1.1
MTLEERFATLRGIGEECIQEDELMRLLQNKPVPICYDGFEPSGRMHIAQGIVKTINVNKMVRAGCKVKIWIADWFAQLNNKMGGDLKKIQTVGRYMIEIWKAAGMNLDGVEFLWSSEEINKRAHEYWPLVMDIARKNNVKRITRCCQIMGRSDQEDLTAAQIFYPCMQCADIFFL

SEQ ID NO: 18285 - DNA, 659 bp, Panicum virgatum
  misc_feature: Ceres CLONE 1796399-R
  misc_feature: Encodes the peptide sequence at SEQ ID NO. 18286
gatgaggcccaggttaatgtgaagataaagcaagctttctgtcctcccaaaattgttgagggaaatccttgtttggagtacattaaatacattgtcttcccctggtttggaaagtttgaggtcatccgcaaggaaagcaatggtggtaataagacatttttaaccatggatgaactcatttctgattatgagagtggtgctttgcatcctgccgatgttaaacctgcactggcaaaagcaataaacgaaatattgcagcctgttcgtgatcacttcaacaacaacagcgaagccaaagttctgcttaacactgttaagaagtacagagtaaccaattgaggcgtactcttcccagggcgaattttgccctttgcaatttttgaatgctgatctatttactcaaagccaccggactctttggcgttgctcagtgtacaatctcagatacaggcactaatatggttgcggtggccttgtctttagttggctgcgacatagtagtgatatttaattttgtattgggcatatgatactgaagtttacccttcgagaactgaattttgttatcttctcacatgactcatgttgaaagtacaagcgataggtgcgcaggaaagtttgcttgttgatgacttgatgtgcatcacgaggcccaatcc

SEQ ID NO: 18286 - protein, 112 aa, Panicum virgatum
  misc_feature: Ceres CLONE 1796399-R
  misc_feature: SWISSPROT Homolog: EC 6.1.1.1
DEAQVNVKIKQAFCPPKIVEGNPCLEYIKYIVFPWFGKFEVIRKESNGGNKTFLTMDELISDYESGALHPADVKPALAKAINEILQPVRDHFNNNSEAKVLLNTVKKYRVTN

SEQ ID NO: 18287 - DNA, 731 bp, Panicum virgatum
  misc_feature: Ceres CLONE 1796421
  misc_feature: Encodes the peptide sequence at SEQ ID NO. 18288
ctccttcaattccctctcatctcgcgtctccgcacggagggccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcgaggctcacggcggagaagctgccggcgaggctggctctgggaaccgatccgcggaggagcacggatcctgtgctccgtgccgcaaagataaaagcttcgtgttgcaagaaatcgacaggtactgaaaaggtccactactctgccgatgaagctctcatactacagcaaaaggcccaggatgttctcccttacttggatggccgatgcatttatctagtcggaatgatgggttcaggcaaaactacagttgggaagatattagctgaagtactaggttattctttcttcgacagtgataagttggtagagaaggctgtcggtatatcatctgttgctgagatttttcagctccacagtgaagcattcttcagagataatgagagtgaggtcctaagggatttgtcatcaatgcatcggttagttgttgcaact

SEQ ID NO: 18288 - protein, 174 aa, Panicum virgatum
  misc_feature: Ceres CLONE 1796421
  misc_feature (107)..(174): Pfam Name: SKI Pfam Description: Shikimate kinase
  misc_feature: SWISSPROT Homolog: EC 2.7.1.71 Shikimate kinase
MEASVGIRARPGAWAGLEKPRGACSARVPAARLTAEKLPARLALGTDPRRSTDPVLRAAKIKASCCKKSTGTEKVHYSADEALILQQKAQDVLPYLDGRCIYLVGMMGSGKTTVGKILAEVLGYSFFDSDKLVEKAVGISSVAEIFQLHSEAFFRDNESEVLRDLSSMHRLVVA

SEQ ID NO: 18289 - DNA, 1596 bp, Panicum virgatum
  misc_feature: Ceres CLONE 1796422
  misc_feature: Encodes the peptide sequence at SEQ ID NO. 18290
atacatagacactgtcacactgccactcccccgctatagctgcttgctcgccagtcgccatggcggccaccaccatcctcctcctcctcgtcctcgccgccactgcggcctcggccgccgacctctccgtgtaccacaacgtgcacccgccgtccccgtccccgcccgagtccatcatcgcgctcgcgcgcgccgacgacgcgcgcctcctcttcctctcctccaaggccgccgcctcgcccggcgtcacctccgcgcccgtcgcctccggccaggccccgccctcgtacgtcgtccgagccgggctcggcaccccggtgcagcagaccctcctcgcgctcgacaccagcgccgacgccacctgggcgcactgcgccccatgcgacacgtgccccgcgggcagccgcttcatcccggccagctcttcctcgtacgcggcgctcccgtgcgcctccgactggtgccccctcttccagggccagccgtgcccggcgaaccaggccgccagcttggcgctgcccgcgtgcgccttctccaagccgttcgccgacgcctccttccaggcgtcgctgggcagcgacacgctgcggctgggcaaggacgccatcgccaacttcgccttcgggtgcgtgggcgcggtgaccgggccgaccacgaacctgccgaagcaggggctcctcggcctcggccgtggccccatgtccctgctgtcccagaccgggagcaggtacaacggcgtcttctcctactgcctcccgagctacaagtcgtactacttctccggctcgctccggctgggcgccgccggccagcccaggaacgtccggtacacgccgctgctgagcaacccgcaccggccgtcgctctactacgtgaacgtgacggggctcagcgtggggcggacgtgggtgaaggtacccgcgggggcgttcgcgttcgacgccaacaccggcgccggcacggtgatcgactccggcacggtgatcacgcggtggacggcgcccgtgtacgcggcgctgcgggaggagttccggcggcaggtgggcgcgccgagcgggtacacgtcgctgggcgcgttcgacacgtgcttcaacacggacgaggtggcggcgggcggcgcgccggccgtgaccctgcacatggacggcggcgtggacctgacgctgccgatggagaacacgctgatccacagcagcgcgacgccgctggcgtgcctggccatggccgaggcgccgcagaacgtcaactccgtcgtcaacgtggtggccaatctgcagcagcagaacgtccgggtcgtcgtcgacgtcgccggctcgcgcgtcggcttcgccagggagccctgcaactgagccccaatccgccgcccgtagccgtgaatgtttccagttccagtgttgtgtgtgtgcaataagggacgtgacgtgacacgaagaagaattggttcgtcacgggtagctagaaagaccaacgtaagaatctgccatgccagagtgtgtatcgctgtcgttttttattgttttggttgtttttgttttttgtatggatgtagctgttgcaagagaacaaaaaacgacattctacgcactcattctacgc

SEQ ID NO: 18290 - protein, 429 aa, Panicum virgatum
  misc_feature: Ceres CLONE 1796422
  misc_feature (76)..(426): Pfam Name: Asp Pfam Description: Eukaryotic aspartyl protease
  misc_feature: SWISSPROT Homolog: EC 3.4.23.12 Nepenthesin
MAATTILLLLVLAATAASAADLSVYHNVHPPSPSPPESIIALARADDARLLFLSSKAAASPGVTSAPVASGQAPPSYVVRAGLGTPVQQTLLALDTSADATWAHCAPCDTCPAGSRFIPASSSSYAALPCASDWCPLFQGQPCPANQAASLALPACAFSKPFADASFQASLGSDTLRLGKDAIANFAFGCVGAVTGPTTNLPKQGLLGLGRGPMSLLSQTGSRYNGVFSYCLPSYKSYYFSGSLRLGAAGQPRNVRYTPLLSNPHRPSLYYVNVTGLSVGRTWVKVPAGAFAFDANTGAGTVIDSGTVITRWTAPVYAALREEFRRQVGAPSGYTSLGAFDTCFNTDEVAAGGAPAVTLHMDGGVDLTLPMENTLIHSSATPLACLAMAEAPQNVNSVVNVVANLQQQNVRVVVDVAGSRVGFAREPCN

SEQ ID NO: 18291 - DNA, 1533 bp, Panicum virgatum
  misc_feature: Ceres CLONE 1796426
  misc_feature: Encodes the peptide sequence at SEQ ID NO. 18292
aaagggagaagcgaagagcgccgcagctcggagaaaactcaactcgccggccatggcgctgctgatggagccgggcgccgagcccctgaccgagagcgagcaggccgacctggccggcatcgccgcaatcaaggaggcagcggcgcgcgagtacaaggagcagggcaaccaattcgtccggatgggccggaagcactacgccgaggcggtctcctgctacaccaaggccatcgcccagatggagcccctctccgctctcgacaccggggccgccgccgccgccgacgcctccgtcctcttcgcgaaccgcgcccacgtcaacctcctcctcggcaaccaccgccgggccctcgacgacgccgagcaggccatccgcctctccccctccagtgtcaaggcgtactacagggcggtgaaggcggcgcttgcgctcgacttgttgccggacgccgcgtccttctgccggagggggctcgagcaggaccccgctaatgaggagctcaagaaattactggcgcaagtggacgcaaaactgagcgagcaagaacgtcagagagccaaagttgcaaaagcactggccgcagccaaggatcttgctgctgccatggagaagagaggggtgaagcttgggaaggcagcctatcaagaactgacaggggtaaagaagccgaagctggatgagcagggcgtgcttcactggcctgttcttctgctttacccagaggtcatgtcgagtgatttcatcgaggattttccagagacggatactttgtcaccccatcttgatgtcatgttctcagaaagttctccaccattgccatgggatgagaaccacgcttacacaagggatgccattgagttgtattatcagggtggttttggaaagcctctgtccaaaagtgagatattaagatattttctagaaggcactgtagacccgaagttgcttccagatgctctacttgatggggaggatgaagaacatgggattagcaagagtagcacaatttcatcatcaactgaaggctccagtaggtggatcaaagtaaaagaagggaaaacacttcaagaagtgctgcaggacaaagactatatcattccagcaattcctgtattctttgttgtctcaagaaagtccaccttctataaagactttaaggctggaaattggtctttgccatgaaaaaaacggtgcgccaaggttctgcttaacatatttggaagatggcagcggatattggccggacaacagaagatgcccgatcgatcatcatcttgtggttttaaaggaaaggagtgtacttctttcagtatctgcaaaacaacctttctgcttgattcatgaccaaggagtagttgtgttcatcagatagagtgatataagaaagaaaaaagaacgcgatgtaatattaatttttttcttggaccaattcagcatttggcctggaaattgtatggtactggtgtggtattcaagtttcaactgaaatgttggtattcctagttatcgaatggacttggaactgagctctc

SEQ ID NO: 18292 - protein, 376 aa, Panicum virgatum
  misc_feature: Ceres CLONE 1796426
  misc_feature (80)..(113): Pfam Name: TPR_1 Pfam Description: Tetratricopeptide repeat
  misc_feature: SWISSPROT Homolog: EC 3.1.3.16 Phosphoprotein phosphatase
MALLMEPGAEPLTESEQADLAGIAAIKEAAAREYKEQGNQFVRMGRKHYAEAVSCYTKAIAQMEPLSALDTGAAAAADASVLFANRAHVNLLLGNHRRALDDAEQAIRLSPSSVKAYYRAVKAALALDLLPDAASFCRRGLEQDPANEELKKLLAQVDAKLSEQERQRAKVAKALAAAKDLAAAMEKRGVKLGKAAYQELTGVKKPKLDEQGVLHWPVLLLYPEVMSSDFIEDFPETDTLSPHLDVMFSESSPPLPWDENHAYTRDAIELYYQGGFGKPLSKSEILRYFLEGTVDPKLLPDALLDGEDEEHGISKSSTISSSTEGSSRWIKVKEGKTLQEVLQDKDYIIPAIPVFFVVSRKSTFYKDFKAGNWSLP

SEQ ID NO: 18293 - DNA, 1525 bp, Panicum virgatum
  misc_feature: Ceres CLONE 1796427
  misc_feature: Encodes the peptide sequence at SEQ ID NO. 18294
atccaatccaagcgtcctgttcctccaccgccgggctaccgagtactgacacctcggcggcggctgcacgatcgcttagttcgcggaggaggacgcgcgcaggcaacgatgatgctcatggactcggcgcgccgcaccggctgctccccggtctgcctggacctcagcgtcggcctctcgccgtcgccgccgaagacgggcgcgaccgaccctcccgccggtggctgcgggatggtgtcgtccatgaccgacgagcaggtaactagctactgatccatcgcgccctgtcttcctcgccgccgctccggcttccttgctctcgatcgcgtcgtctctgtctgaaccggcggtcacaatgctgcgacccaggccaggaccctggaggccaagtgcacccaggtcagcgaggagaaccggcggctcgccgagaaggtcgcctacctgtacgccagccagatcgccaggccgggtccagactccccgggctcgacgcgcgcctcgcaagccgcgtcgccgccgccgccgccggctgcgagcaggaagaggagcagggacagcatggacgagccgccgaattcgggcgacgccgacggcagcggcagggccgaggccgccgagagcacccccagcgacgccttggagggctcctgcgggcggatcaaggtcagcagggtctgctcccggatcgacccctccgacaccacgctcaccgtcaaggacgggtaccaatggcggaagtacgggcagaaggtcacccgcgacaacccgtccccgcgagcctacttccgctgcgccttcgcgccctcctgccccgtcaagaagaaggtagattttgcgcatttccatcgcctgatcacggcggatcgcctcgtttgatccgtggctaatggtggctctgtttctttggcgcaggtgcagaggagcgcggaggacagctcggtgctggtggccacgtacgagggcgagcacaaccacccgtgcccgacgcgcgccggcgagctccccagctgcgcggcgcgcggcgggtccgtgccgtgctccatctccatcaactcctccggcccgaccatcacgctggacctcaccaagaacggagcggggggcggcgtgcgggtgctcgaggccgccggggcgcccgacctcaaggagctgtgccaggagatcgcgtccgcggagttccggacggcgctggtggagcagatggcgagctcgctcaccagggattccaagttcaccgacacgctcgccgccgccatcctgaagcagctgccggattactaagtctccagtgtccggtgtcgtagctcaaagagtttgcgagactgcaacagattttctttcatggtagcaatagtgtatgtctattgggattagagcataatctccccagatttacatgcatagtttcaattccaaataatattgtacattttacaagtccattgtttgatcacgaattcaaaataaggaccgtcctcccaagacagcagagagtccctctagctgttcttttgatgtttatctg

SEQ ID NO: 18294 - protein, 105 aa, Panicum virgatum
  misc_feature: Ceres CLONE 1796427
  misc_feature (52)..(98): Pfam Name: WRKY Pfam Description: WRKY DNA -binding domain
  misc_feature: The sequence is a functional homolog of SEQ ID NO 1273 in the 11/479,226 US patent application
  misc_feature: The sequence is a functional homolog of SEQ ID NO 176 in the 10/374,780 US patent application
  misc_feature: The sequence is a functional homolog of SEQ ID NO 226 in the 10/225,068 US patent application
  misc_feature: The sequence is a functional homolog of SEQ ID NO 588 in the 10/412,699 US patent application
  misc_feature: The sequence is a functional homolog of SEQ ID NO 108 in the 10/225,068 US patent application
  misc_feature: The sequence is a functional homolog of SEQ ID NO 1330 in the 11/479,226 US patent application
  misc_feature: The sequence is a functional homolog of SEQ ID NO 218 in the 10/225,066 US patent application
  misc_feature: The sequence is a functional homolog of SEQ ID NO 2458 in the 10/374,780 US patent application
  misc_feature: The sequence is a functional homolog of SEQ ID NO 620 in the 10/412,699 US patent application
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 1388 in the 11/479,226 US patent application
  misc_feature: The sequence is a functional homolog of SEQ ID NO 1824 in the 10/412,699 US patent application
  misc_feature: The sequence is a functional homolog of SEQ ID NO 2068 in the 10/374,780 US patent application
  misc_feature: The sequence is a functional homolog of SEQ ID NO 652 in the 10/412,699 US patent application
  misc_feature: The sequence is a functional homolog of SEQ ID NO 942 in the 10/225,066 US patent application
  misc_feature: The sequence is a functional homolog of SEQ ID NO 886 in the 10/666,642 US patent application
  misc_feature: The sequence is a functional homolog of SEQ ID NO 2242 in the 10/374,780 US patent application
  misc_feature: The sequence is a functional homolog of SEQ ID NO 924 in the 10/225,066 US patent application
  misc_feature: The sequence is a functional homolog of SEQ ID NO 144 in the 10/225,068 US patent application
  misc_feature: The sequence is a functional homolog of SEQ ID NO 442 in the 10/374,780 US patent application
  misc_feature: The sequence is a functional homolog of SEQ ID NO 700 in the 10/225,066 US patent application
MDEPPNSGDADGSGRAEAAESTPSDALEGSCGRIKVSRVCSRIDPSDTTLTVKDGYQWRKYGQKVTRDNPSPRAYFRCAFAPSCPVKKKVDFAHFHRLITADRLV

SEQ ID NO: 18295 - DNA, 2431 bp, Panicum virgatum
  misc_feature: Ceres CLONE 1796436
  misc_feature: Encodes the peptide sequence at SEQ ID NO. 18296
ttttctttgcttccctctcctccttgtctagctcccctcttctccctcatatgagctgagcaaggttgggagcaagactagttgtgtagaccaaacatcgtagtgagagaaaaaaaatctcttccctggcccatagattccccaagaaccagaagaaaaaacaacacttatcaggtgtttctcttgttgctcgatctagcttttcgctatttttcttcgcattttgtaggcagtttgccagtttcttcttttagtgttcttctacacacagtaaattcagaaccaagaaatccagcaaaaaaattcctcccctttttcctggttattcggtcctagtatcttccaagcagaagccaaaggacgaagaaccgccatagcaagatcttggttatgttccatttgcatcagttcagccgtgtagaatcgatcccaacttgagcagcagcaagactcccatctttaggggcccttcagccgccttcttcaggaagttgtagttccagcagcggaagaaaaagcccagtctccagctatggcggcggcgctggagtgctggtcagggcggccaagcacggacgaggagatggtggagcaggttctcatgaagccccacagccgctcagacgactccctcccgacctgcgccgactctgcctacgctggcgaacccacgtcggcgccggcgcctcccaagaagtggcagaggctgggccgcaacttcgccggtgccatcgccgcgttcaaaaacacgcttagcctggatggcggcggcctcccccgcgacccctcaccgcgcgctgagaagccaccaccgctcctcctccgtggccttgcgcagctctactctcgcggcgccaacaaccagcagctgccggagaagctcgttgcggatctccgccgccacttcgacgctctccccaacagctatgcacaggcaggatttgacatgaaagacatcctcttgcatgcccgccttgtagagcaggcgaccggtgaggatcagcctgcagtgaacattgaggaaattcatggcagaggaggtggcgatgaaggcactacttttcagctaacatttgcttgcatcgccccactttcatggcagtcaatgtcaggatcattagatagccctttgttctgttgcaagaagatccagatctttgagaagagagggttgacacttggtgttgtcatgatacttgtgcagtctgggaatgaggcggtcttcaagaaccgggttgagtctgcactgaaatcagttgtaaagaagcagaggaagaacagtggtggtgtgaagctaccatttgggctttgtggttgccaagaagaaggatcaagaaacttcgatgaggagtcaatgttcgatccagatgatggtcaggtacttgacaatgagccgattcgcagaccacagcttcccactcccctaccacagtcatcagtcttcgtctcggtggatgaatggcaaacaatccgatctggtggtgaggaacttggccgttggatgctgcgttctgaggagattgagttcactgattgggttggtgcaaattcattcaagggtgtctttagaggaaagaaggtttgggtcaacaaattgaggggttgtgacatgggaagtgcttatgatgttgagatccgtcaggacttgctgcagttgatgagctgtggccagaggaacgtcctccaattccatggcatttgcttcaacgaaaaccatgggctctgcatagtgacgaggatgatggaagggggatctgttcatgatattattatgcagagaaacaaaagactgtctctccgagatacagttaggattgcccttgatgttgctgatgggctagccttcatgaacagctatggcattgcatactgtgatctcaattctcggaaaatcctgctagacaggcaagggaacgcttaccttggggatatgggcattgttaccccttgtaataatgtcggtgaggtcacagagtatgagacatctggatatcgatggctggctccagagatcattgctggagatcctgaaaccgtctccgagacctggatgagcaacgtctacagctatggaatggtgctgtgggagatgatcactggagaggaggcatactccacctactcgccagtgcaagcagcggttggaatcgccgcctgcgggctgaggcctgagatcccaagagactgtcctcctttcctgaggtcactgatgaacaggtgctgggacaataaccctctgaagcgccctcagttctctgagatcatatccatcctacagaggcagaatgctagatagttttcttctcttccttttccttctactatatgctatatatcagtttggcttggctgtttgcctaatcatgcaggaaactgcatccgagaaaatataatatattatatatgtgcaaaggcttgttacattattgct

SEQ ID NO: 18296 - protein, 587 aa, Panicum virgatum
  misc_feature: Ceres CLONE 1796436
  misc_feature (330)..(581): Pfam Name: Pkinase_Tyr Pfam Description: Protein tyrosine kinase
  misc_feature: SWISSPROT Homolog: EC 2.7.11.1 Non-specific serine/threonine protein kinase
MAAALECWSGRPSTDEEMVEQVLMKPHSRSDDSLPTCADSAYAGEPTSAPAPPKKWQRLGRNFAGAIAAFKNTLSLDGGGLPRDPSPRAEKPPPLLLRGLAQLYSRGANNQQLPEKLVADLRRHFDALPNSYAQAGFDMKDILLHARLVEQATGEDQPAVNIEEIHGRGGGDEGTTFQLTFACIAPLSWQSMSGSLDSPLFCCKKIQIFEKRGLTLGVVMILVQSGNEAVFKNRVESALKSVVKKQRKNSGGVKLPFGLCGCQEEGSRNFDEESMFDPDDGQVLDNEPIRRPQLPTPLPQSSVFVSVDEWQTIRSGGEELGRWMLRSEEIEFTDWVGANSFKGVFRGKKVWVNKLRGCDMGSAYDVEIRQDLLQLMSCGQRNVLQFHGICFNENHGLCIVTRMMEGGSVHDIIMQRNKRLSLRDTVRIALDVADGLAFMNSYGIAYCDLNSRKILLDRQGNAYLGDMGIVTPCNNVGEVTEYETSGYRWLAPEIIAGDPETVSETWMSNVYSYGMVLWEMITGEEAYSTYSPVQAAVGIAACGLRPEIPRDCPPFLRSLMNRCWDNNPLKRPQFSEIISILQRQNAR

SEQ ID NO: 18297 - DNA, 1638 bp, Panicum virgatum
  misc_feature: Ceres CLONE 1796446
  misc_feature: Encodes the peptide sequence at SEQ ID NO. 18298
aattgcttgtgggtctgcaaacgtgaggagagcaactgagatcgatcgttgatttcgttaatagcgagcgctgcgctgccggccacatgcttgacccagccgtaaccgcgttgatgaacacgtggataataattttcccaaccagaaccgcgagccgtatggctgcgcacgcgatgcgactgggtccttggttttaccggtttccttgctccctttctatacgcgctttgcattccttggatatatattgcctgcatcaacgtggatatatattgccttctgccctccggcgccgccaactccttcatcttcctggtgtgctccagttcttggccaatccccacccgcggatcccgcgatcttgcctgacttcgtccaggtgcttaatttcaaccttgttgtcgccgttgtttcttttctggaggggtttcttgttagccgattcgttcttggatgttgctgttcttgaactatgtgtgacggtgaaattcggtgcccaaaattctccgcaggggcgacagtttccgcgacaagaggccgccttcccgtctgtcagcatgagcgggaagcgatccttcttcgcatccaagaagaaggccaccaatcctttcgattccgactccgacgacggcgacaagaagcagcagcggccggcgcgggcctcctccgtgccgcccccggcccaacagcgggtcgccctcttcggcgccggcgccggcggccaagaaaggggcgggctcttctcctcctcggaggcgccgaggaacagccactaccgaaacgacttccgcgacgctggcggcctggagagccagtcagttcaggagctggagggctacgcggcgtacaaggccgaggagaccacaagccgggttcagggatgcgtcagaatagccgaggagatgagggataccgcgtccaagaccctcgtcaccgtccaccaacaggggcagcagatccaccgcacgcacatgatggccgtcgacatcgaccaggacctctccaggagtgagaagctcttgggtgatcttgggggcctattttccaagaagtggaagccaaagaaaaacggcacaatcaagggtcctatgctatctagagatgactccttcataagaaggggcggtcatttggagcaaaggcagaaattagggctggtcgatcatcctcctcgattggatgcgcgcaaatttcattctgaaccgacatcggcacttgagaaagttgagatggagaaagcaaagcaggatgatgctctgtctgatctaagcgacatactgaccgagctgaaagggatggccattgacatgggctctgagattgagaggcaaacaaagtcaatgggagatgcagaaaaggattatgacgagctgaacttcagggttaagggagcaaacactcgagctcgccatctgcttggcagataaaaagctacgagtttttgtctctagatgttctatatgtcattgactaatcttgagggtgctctcaactcctcctttccactatatggagatcaattctgatggttttatgcatcgaattttgatcagaatggttggctgtggacatttcagcgtgtattgtacatatgccattagacactattgtattctttatattttacccttttccttt

SEQ ID NO: 18298 - protein, 422 aa, Panicum virgatum
  misc_feature: Ceres CLONE 1796446
  misc_feature (362)..(421): Pfam Name: SNARE Pfam Description: SNARE domain
MAAHAMRLGPWFYRFPCSLSIRALHSLDIYCLHQRGYILPSALRRRQLLHLPGVLQFLANPHPRIPRSCLTSSRCLISTLLSPLFLFWRGFLLADSFLDVAVLELCVTVKFGAQNSPQGRQFPRQEAAFPSVSMSGKRSFFASKKKATNPFDSDSDDGDKKQQRPARASSVPPPAQQRVALFGAGAGGQERGGLFSSSEAPRNSHYRNDFRDAGGLESQSVQELEGYAAYKAEETTSRVQGCVRIAEEMRDTASKTLVTVHQQGQQIHRTHMMAVDIDQDLSRSEKLLGDLGGLFSKKWKPKKNGTIKGPMLSRDDSFIRRGGHLEQRQKLGLVDHPPRLDARKFHSEPTSALEKVEMEKAKQDDALSDLSDILTELKGMAIDMGSEIERQTKSMGDAEKDYDELNFRVKGANTRARHLLGR

SEQ ID NO: 18299 - DNA, 3078 bp, Panicum virgatum
  misc_feature: Ceres CLONE 1796447
  misc_feature: Encodes the peptide sequence at SEQ ID NO. 18300
cggtcttcctctccccagttccactagcccccgggtagcccaacacaaattcatcccctctgctcccaaatatcctcttccccctcgtgccaagaccggactcagcctggatttctccatctctccccaattgcagaggagaggagaagacgccatggcccctggcagagggaggtgggttttgctgtcttgattagcttcttccctagtctctacctctctgtccgcaatcgccatccgagaaagggagtggaggagccagccgcgccgcgccgaatcgccggaaagatgcggcctttggggcaaaagcgcggggaccttgctctcctctgctgcgtcgcgctcctcctcccgcttctgtcccatggcgcggacatgccgctggggtcgaccctctcgccggggaactcgacgtcgtggacgtcgcccaacaacaccttctcgctctccttcacgccgtccccgacctccccgtcgctcttcgtcgccgccatcacctacgccggcggcgtccccgtctggtccgcgggcaacggcgcggccgttgactccgggggctcgctccgcctctcgtccaacggcgacctccagctcatcaacggatctggggccgtcctctggtcgtccaacaccggcggtcagggcgtcgccgccgcggccgtccaggagagcggcagcctcgtgctcaagaactcgacgaccaccctgtggcagtcgttcgaccacccaacggacacggtggtcatgtcgcagaacttcacctcggggatgaacctcacctccggccgctacgtcttcgccgtcgacaagagctccggcaacctcacgctcaggtggaccagcggcgccaacaccgtcacctacttcaacaagggctacaacacgtccttcacggggaacaggacgctgagctcgccgacgctcacgatgcagaccaacggcatcgtgtcgctgaccgacgggcagctggcgtccccggtggtggtggcgtacagcagcaactacggcgagagcggcgacatgatgcggttcgtgcggctggacgcggacggcaacttccgcgcctacagcgcggggcgcggcagcaacacagcgacggagcagtggtcagcggtggcggaccagtgccaggtgttcggctactgcggcaacatgggcgtgtgcagctacaacggcacgtcgccgatgtgcggctgcccgtcgcggaacttccagttcagcaacccgtccaacccccgcgacggctgcacgcgcacggtcgacctccagaactgccccggcaactccaccatgctccagctcgacaacacgcagttcctcacctacccgccggagatcaccaccgagcaattcttcgtcgggatcaccgcctgccgcctcaactgcctctccggcggctcctgcgtggcgtccaccgcgctctccgacgggtcgggcctctgcttcctcaaggtctccaacttcgtcagcgcctaccaatcggccgcgctgccgagcacgtccttcgtcaaggtctgcttccccggggtacccaacccgcctccagacgcctcggcctcgtcctcgcgccgcggctccggcgtccgcggctgggtcgtcgcggtcggggtcctgggcgccgtgtccgggctggtgctctgcgagtgggcgctgtggtggttcttctgccggcacagccccaagtacgggccggcgtcggcgcagtacgcgctgctggagtacgcgtcgggcgcgccggtgcagttctcctaccgcgagctgcagcggtcgaccaaggggttcaaggagaagctgggcgccggcgggttcggcgccgtgtaccgcggcgttctggcgaaccggacggtggtggcggtaaagcagctggaggggatcgagcagggcgagaagcagttccggatggaggtggcgaccatcagcagcacgcaccacctcaacctcgtccgcctcatcggcttctgctccgagggccgccaccgcctgctcgtctacgagttcatgaagaacggctcgctggacgcgtttctcttcggcgacgcgccggggggcaagatgccgtggccgacgcgcttcgccgtcgccgtgggcacggcgcgcggcatcacctacctgcacgaggagtgccgcgactgcatcgtgcactgcgacatcaagcccgagaacatcctcctcgacgagcacttcaacaccaaggtctccgacttcgggctcgccaagctcgtcaaccccaaggaccaccgccaccgcacgctcaccagcgtgcgcggcaccagggggtacctggcgccggagtggctcgccaacctgcccatcacggccaagtccgacgtctacagctacgggatggtcctgctggagatcgtcagcggccaccgcaacttcgacatctcggaggagaccggccggaagaagttctccgtgtgggcgtacgaggagtacgagaggggcaacatcttcggcatcatcgacaagaagctgcccggggaagacgtcgacatggtccaggtggagcgcgcgctgcaggtgagcttctggtgcatccaggagcagccggcgcagcggccgtccatgggcaaggtggtgcagatgctggaagggatcatggacctcgagaggccgccgccgcccaagtcgtcggacagtttcctgagcaccaccacaggcacgaccggcagcagcagcggcatcaccacgagcatggtctcgactatcgcctcgtcggccccggtcgtgccgacgacctcgcccaacttggagcaggagatggcgctgggccgctcgacgtcggccatgaaccgtgagagggtgtcgcggcagctgctgtcgccgcagccgtatatgacgatgtgaggtgcggtgaatcatccatggcggatcatctccattggaaggaagagagaaatgtacagattatacagcggttagggaattgattttctgaatttgctctaagatctggctgatcttgttttggccatactgcatatgtacgtgtaagtagcaagattgggcacaacttgatattgggcattgtaatttgtacaaataatcgagatgagacgatatattgtaggcagc

SEQ ID NO: 18300 - protein, 853 aa, Panicum virgatum
  misc_feature: Ceres CLONE 1796447
  misc_feature (498)..(768): Pfam Name: Pkinase Pfam Description: Protein kinase domain
  misc_feature (73)..(181): Pfam Name: B_lectin Pfam Description: D-mannose binding lectin
  misc_feature (329)..(395): Pfam Name: PAN_2 Pfam Description: PAN-like domain
  misc_feature: SWISSPROT Homolog: EC 2.7.11.1 Non-specific serine/threonine protein kinase
MRPLGQKRGDLALLCCVALLLPLLSHGADMPLGSTLSPGNSTSWTSPNNTFSLSFTPSPTSPSLFVAAITYAGGVPVWSAGNGAAVDSGGSLRLSSNGDLQLINGSGAVLWSSNTGGQGVAAAAVQESGSLVLKNSTTTLWQSFDHPTDTVVMSQNFTSGMNLTSGRYVFAVDKSSGNLTLRWTSGANTVTYFNKGYNTSFTGNRTLSSPTLTMQTNGIVSLTDGQLASPVVVAYSSNYGESGDMMRFVRLDADGNFRAYSAGRGSNTATEQWSAVADQCQVFGYCGNMGVCSYNGTSPMCGCPSRNFQFSNPSNPRDGCTRTVDLQNCPGNSTMLQLDNTQFLTYPPEITTEQFFVGITACRLNCLSGGSCVASTALSDGSGLCFLKVSNFVSAYQSAALPSTSFVKVCFPGVPNPPPDASASSSRRGSGVRGWVVAVGVLGAVSGLVLCEWALWWFFCRHSPKYGPASAQYALLEYASGAPVQFSYRELQRSTKGFKEKLGAGGFGAVYRGVLANRTVVAVKQLEGIEQGEKQFRMEVATISSTHHLNLVRLIGFCSEGRHRLLVYEFMKNGSLDAFLFGDAPGGKMPWPTRFAVAVGTARGITYLHEECRDCIVHCDIKPENILLDEHFNTKVSDFGLAKLVNPKDHRHRTLTSVRGTRGYLAPEWLANLPITAKSDVYSYGMVLLEIVSGHRNFDISEETGRKKFSVWAYEEYERGNIFGIIDKKLPGEDVDMVQVERALQVSFWCIQEQPAQRPSMGKVVQMLEGIMDLERPPPPKSSDSFLSTTTGTTGSSSGITTSMVSTIASSAPVVPTTSPNLEQEMALGRSTSAMNRERVSRQLLSPQPYMTM

SEQ ID NO: 18301 - DNA, 689 bp, Panicum virgatum
  misc_feature: Ceres CLONE 1796450
  misc_feature: Encodes the peptide sequence at SEQ ID NO. 18302
gtgtgtcttgtagtgcatgattcccagcaggtcgccacctctcggagtcggagacagacagacagacagacagacagagagagggggaccaagcaggagggtctaggcgtctagctagctgagccatggccaagcctcacgtcctggtgctgccgatgccgtgccagggccacgtcacgccgctcatggagctctcccaccgcctggtcgaccacggcctggaggtcaccttcgtcaacaccgaggtggaccacgcgatggtggtcgccgcgctgcgggcgtccggcggtgaggcggcgctgggcggcggcatccgcctggcgtccatcccggacgggctggccggcgacgaggaccgcaaggaccccgacaagctcatcggcgcctacacgcgccacatgccgggccacctggagcggctcatcgccgacctggaggccgccgggcggcccagggtcaagtggctcgtcggcgacgtcaacatgggctggtccttcgaggtcgccaggaagttcggcatccgggtcgtgtccttctggccggcggccacggcgtgcttcgccatcatgctcaagatccccgagctgatcgaggacggactcatcgacgacaagggcttgccacggcggcaggagacgttccagctcgccccggggatgccgccgctgcacacgtcacagctgtcgtgg

SEQ ID NO: 18302 - protein, 187 aa, Panicum virgatum
  misc_feature: Ceres CLONE 1796450
  misc_feature: SWISSPROT Homolog: EC 2.4.1.115 Anthocyanidin 3-O-glucosyltransferase
  misc_feature: Functional homolog of the protein sequence given in SEQ ID NO 50296
  misc_feature: Useful for making plants with altered carbohydrate content
MAKPHVLVLPMPCQGHVTPLMELSHRLVDHGLEVTFVNTEVDHAMVVAALRASGGEAALGGGIRLASIPDGLAGDEDRKDPDKLIGAYTRHMPGHLERLIADLEAAGRPRVKWLVGDVNMGWSFEVARKFGIRVVSFWPAATACFAIMLKIPELIEDGLIDDKGLPRRQETFQLAPGMPPLHTSQLS

SEQ ID NO: 18303 - DNA, 534 bp, Panicum virgatum
  misc_feature: Ceres CLONE 1796450-R
  misc_feature: Encodes the peptide sequence at SEQ ID NO. 18304
cgcccggccgttcctgtgggtggtgcgcccggacttcacccccggcctcagcgaggcgtggctcgccgagttccaccagcgcgtcgccggcagaggcatgatcgtcagctggtgctcccagcagcaggtcctggcgcaccgcgcggtggcgtgcttcgtgtcacactgcgggtggaactcgacgatggagggggtgcggaacggggtgcccttcctgtgctggccctacttctgcgaccagtacctgaaccggagctacatctcccgcgtgtggaggaccggcctggcggtgtcccccgacgcggacggggtcgtgaccaaggcggaggtgaggagcaaggtggagcagatcatcggcgacgccgagatcaggcagagggcgcggctgttgagggacgcggctctccggtgcgtcggcgaagggggatcctcgtacgagaacttcaaaaagctcgtggacctgctaagcgagtgagtagttggcttggggagccagcatcatctttttttttttaaagaaactttattaatttc

SEQ ID NO: 18304 - protein, 157 aa, Panicum virgatum
  misc_feature: Ceres CLONE 1796450-R
  misc_feature: SWISSPROT Homolog: EC 2.4.1.234 Kaempferol 3-O-galactosyltransferase
  misc_feature: Functional homolog of the protein sequence given in SEQ ID NO 50296
  misc_feature: Useful for making plants with altered carbohydrate content
ARPFLWVVRPDFTPGLSEAWLAEFHQRVAGRGMIVSWCSQQQVLAHRAVACFVSHCGWNSTMEGVRNGVPFLCWPYFCDQYLNRSYISRVWRTGLAVSPDADGVVTKAEVRSKVEQIIGDAEIRQRARLLRDAALRCVGEGGSSYENFKKLVDLLSE

SEQ ID NO: 18305 - DNA, 2024 bp, Panicum virgatum
  misc_feature: Ceres CLONE 1796451
  misc_feature: Encodes the peptide sequence at SEQ ID NO. 18306
ctcgctacctcccagttccaagaacccgtgaagtgaagtggaagaggtgggcggaactccggcgagatgatcgcccgcggcctcctcagatccagtgccgccacctcgcagttctggagcagcaaacagagcagaggtcagcagctttttggtctttggaggaaccatcgaagaacagcatcttgagctgagctctgttgtctgttcttttgtgaaccaataatttttcccccttttactcggttcagcttcattggaactggaaattagaactacagttgctttgttcaagatcataacttcctctcagacagttctgacactagaccttgactcgttcaggaaaccggaaatcatttttatttcagttagtgtgttttctgtacctaatgtatctaacttttcatttttgtttcactatcttccctcatacagtttagcaggctggtgaaatatgtagctagtgctggaagcttgcaaggaacacacaattttgcagagcctgccagatactacagctctgaaccatcacttcaggaaacagaggaaaatggatttaagggtcatagcatgctggctccattcacagctgggtggcagagctccgatttgcatccgcttgttatagatagatctgagggctcttacgtttatgacatcaatgggaagaagtatatagatgctcttgcaggactgtggtgtacagctttaggtggtaatgagcctcgattaatcaaagctgcaactgagcaactaaacaaattacccttctaccattccttttggaaccgtacaaccaaaccctcattggatcttgcaaatgaaattctcagcatgttcactgcaaggaaaatgggcaaggtattcttcacaaatagtggttcagaagcaaatgactcccaggttaaactagtatggtattataacaatgcactaggaaggccaaacaagaagaaatttattgctcggtcaaaatcatatcatggatcaacattaatagcagctagtctatcgggtttgcctgcacttcatcagaagtttgatctaccagcaccttttgttctgcacacagactgccctcactactggcgcttccgtctttctgatgagacagaagaagagttttcaactagacttgccaacaatttggagaatcttatcctcaaagaaggacctgacacaattgctgctttcattgcagaacccgtgatgggtgctggtggtgtgatccttcctccaaagacctattttgagaagattcaagcagttctcaagaagtatgacatcttactaatcgcagatgaggtcattactgcattcggaagactagggaccatgtttggatgtgatatgtataacattaagccagatcttgtctccattgccaaggctctttcttctgcctatatgccaatcggagcaatccttgttagcccagaaataacggatgtaatttactcacagagcaataagcttggttcttttgctcatggctttacatactcgggacatccagtttcttgtgctgttgcgatagaaacattgaagatttataaagaaaggaatatcgttgaacatgttaacaaaattgctccaaggttccaggagggaatcaaggcgttctcaggaagcccaattgttggcgagatacgtggtcagggactgatacttggaactgaatttgtcgacaacaaatcgccaaatgatccattcccagctgaatggggtgtgggttcgatctttggcgccgagtgtgagaagcgtggaatgctcattagggtggctggggatagcatcatgctgtcacccgcactgataatgactcctgaagaagttgaagaaatcattatcaaattcgaccatgccctgaaggccacagaggaaaggatcgcagagcttaaatccaagaactagctaataccgttggttgtaacgatctgggggatgatgatgacaacatctaatgtacagaataattcatacttgatctcaaattctgaataaagtgctggaacttcgtactt

SEQ ID NO: 18306 - protein, 447 aa, Panicum virgatum
  misc_feature: Ceres CLONE 1796451
  misc_feature (18)..(373): Pfam Name: Aminotran_3 Pfam Description: Aminotransferase class-III
  misc_feature: SWISSPROT Homolog: EC 2.6.1.62 Adenosylmethionine--8-amino-7-oxononanoate transaminase
MLAPFTAGWQSSDLHPLVIDRSEGSYVYDINGKKYIDALAGLWCTALGGNEPRLIKAATEQLNKLPFYHSFWNRTTKPSLDLANEILSMFTARKMGKVFFTNSGSEANDSQVKLVWYYNNALGRPNKKKFIARSKSYHGSTLIAASLSGLPALHQKFDLPAPFVLHTDCPHYWRFRLSDETEEEFSTRLANNLENLILKEGPDTIAAFIAEPVMGAGGVILPPKTYFEKIQAVLKKYDILLIADEVITAFGRLGTMFGCDMYNIKPDLVSIAKALSSAYMPIGAILVSPEITDVIYSQSNKLGSFAHGFTYSGHPVSCAVAIETLKIYKERNIVEHVNKIAPRFQEGIKAFSGSPIVGEIRGQGLILGTEFVDNKSPNDPFPAEWGVGSIFGAECEKRGMLIRVAGDSIMLSPALIMTPEEVEEIIIKFDHALKATEERIAELKSKN

SEQ ID NO: 18307 - DNA, 627 bp, Panicum virgatum
  misc_feature: Ceres CLONE 1796453
  misc_feature: Encodes the peptide sequence at SEQ ID NO. 18308
aaaaaaaaaacgactcctgattaaagctcgtaaaaacctcgcgagaagcggcgagagcacagtttctagtttgttcgctgtttccgccccaaatctgctgcgggctcaagccgaattgaagccgatcggagcggcggcggcaatggcggggctgtcgctgcggtgcggcgactgcggcgcccagctgcggagcgtggaggaggcgcaggcgcacgccgaggtcaccaaccacgccaacttcgtcgagtccaccgaggccgtcctcaacctcgtctgctccgactgcggcaagccatgccgctcccagaccgaggtgaacctgcacaccawgykyacgggccacaaggatttcgcggacaagaccgccgaggcggccaagcccatcgatctcgaggcgccgctcaagccggcctcctcctcggaggccatggacgtcgacgccccggcctcggcaagcgatgagcctcaagagatggtggtgccggaggtgaacaaggagatgctcgccgacctcgaggccatggggtttgccactgcgcgtgccactagggcacttcatttctccggtaatagcaccatcgaaggtgccatcaactggctttctgagcaccaggaagatgcagatat

SEQ ID NO: 18308 - protein, 161 aa, Panicum virgatum
  misc_feature: Ceres CLONE 1796453
  misc_feature (116)..(153): Pfam Name: UBA Pfam Description: UBA/TS-N domain
  misc_feature: SWISSPROT Homolog: EC 3.1.2.15 Ubiquitin thiolesterase
  misc_feature (63)..(63): Xaa is any aa, unknown, or other
  misc_feature (64)..(64): Xaa is any aa, unknown, or other
MAGLSLRCGDCGAQLRSVEEAQAHAEVTNHANFVESTEAVLNLVCSDCGKPCRSQTEVNLHTXXTGHKDFADKTAEAAKPIDLEAPLKPASSSEAMDVDAPASASDEPQEMVVPEVNKEMLADLEAMGFATARATRALHFSGNSTIEGAINWLSEHQEDAD

SEQ ID NO: 18309 - DNA, 615 bp, Panicum virgatum
  misc_feature: Ceres CLONE 1796453-R
  misc_feature: Encodes the peptide sequence at SEQ ID NO. 18310
agaaaaaatccgccagaaactggaagaagataaggctgaaaggagaaggaaactaggattgccaccagaagacccagcagcttccaaaccaagtgcaccacctcctgttgaagagaagaagagtgcattgcctatcaggccagccacaaaggcagaacggatgagggattgtctacgaaatcttaagcaacagaacaaggatgacgatgccaaagtgaagagggcatttcaaacactccttacttatattggaaatgttgctaaaaatcctgatgaggagaaattcagaaagattagactcacgaatgctacatttcaggagagggttggaaatctgcatgggggcatagagttccttgagctctgcggatttgagaagcttgaaggcaacgagttcttgtttctaccaagggacaaggttgacaagaccatcctgaacacggctggagccgagctgaactctgcaatcaccaatcctttcttcggagtcctttgagttgtcgagaacctcaatgtatacacaaacctcttggcttcacctttacttttgcatgcaagtaacatacatatttcacgaatgattgcagtctacatccatacatattccttccgtac

SEQ ID NO: 18310 - protein, 164 aa, Panicum virgatum
  misc_feature: Ceres CLONE 1796453-R
  misc_feature: SWISSPROT Homolog: EC 3.5.1.52 Peptide-N(4)-(N-acetyl-beta-glucosaminyl)asparagine amidase
EKIRQKLEEDKAERRRKLGLPPEDPAASKPSAPPPVEEKKSALPIRPATKAERMRDCLRNLKQQNKDDDAKVKRAFQTLLTYIGNVAKNPDEEKFRKIRLTNATFQERVGNLHGGIEFLELCGFEKLEGNEFLFLPRDKVDKTILNTAGAELNSAITNPFFGVL

SEQ ID NO: 18311 - DNA, 1871 bp, Panicum virgatum
  misc_feature: Ceres CLONE 1796454
  misc_feature: Encodes the peptide sequence at SEQ ID NO. 18312
atttattttagtcttactctattcgagtcctaccagtagcgggcgagcgagagggggtggtggtggtggagcggacggagccgccgcttgctgcgagatctaggtgaacgcggccatgggtgctcgctgctccaagctctccgtctgctggtggcctccccacttcaaatcgccgatgcttgagaatggcgccgccgacgatgacggcagcggcgtgccggtgttcgccgagtacagcctcgacgagctccgggcggccaccgacggcttcgcgccggaccgcatcgtgtcggagcacggcgagaaggcgcccaacgtcgtctaccggggcacactcttcagctccggccgcaccgtcgccatcaagcgcttcggtcgctccgcctggcctgactcccgccagttcctggaggaggcgagggcagttgggcagctgcgcagtggccggctggccaacctgattggttgctgctacgagagcggggagcggctgcttgttgccgagttcatgccgcatgagaccttggcaaagcatctcttccactgggaaacgaaccccctgagctgggcaatgaggatgagggctgcgctttatgtggcacaggcattagaatactgcagtagcaaagggagagcactctaccatgacctgcatgcatacagggtcgtttttgatgtggatggtaacccaagactatcatgttttggtctgatgaagaacagcagggatggaaagagttacagtactaatttggcgttcacacctcctgaatacctgaagacaggtagagttagtccagagagtgtggtttacagttttggcaccatcttgcttgatctcctgagtggaaagcacattccaccaagtcatgcccttgatcttataaagggaaagaacttcctggtgctcatggattcttgcttggaaagtcatgtatccaactctgatggaactgacttgatgcgattagcatcccgctgcttgcagtatgaagcacgtgaccggccaaatctgaaagcagtggtgtctggtcttgcaagtctccataaagacgcttctattccttcgcacactttgctgggcatccaacaggataaaagaagctcagacaaagtccggttatctggtattggaaaagcttttgccagagcagacctgaacgaggttcatgagatattgctggatgatggctataatgaggacgacatggcaaatgctgaggtatctctccagtcatggaccggcgaattatctgagagcttcatcgtcaagaggcatgcagacaatgccttcaagtccaaggattttgcaactgccgtcgagtgttactcaaggttccttgactcaggtgcagcggtggctccaacaatgctggcgcgacgatgcttcgcatatgtagtggctggcaagttgcaggaaggcctagaggatgcaaagagggctgaggacattgcacctgggtggccaatgggacactatctgcaggcgttggcactccatagcctgggaagggaggcggaaagcaatgaagcactaaagaaaggcactgtgttggaagctgaaagaaatagtagagctacaactgtatagccgccctgaatgtgtgatgctctctctgcttgtacttaatatcgcctgcattttgggtgcccccctccaatgctttgccgccagtagggctgtttttggtattccctaacatgtatcggtatttccaatggttttacaagtcaaaaaactcctaggttggctgttattacacctccgatatattcatgaatacggaaatgggcaactagtatcgtgatagcattctgttgatgtgagattgtaaagtgacaattttcattttatttcaaaaaattcatgt

SEQ ID NO: 18312 - protein, 491 aa, Panicum virgatum
  misc_feature: Ceres CLONE 1796454
  misc_feature (68)..(307): Pfam Name: Pkinase_Tyr Pfam Description: Protein tyrosine kinase
  misc_feature: SWISSPROT Homolog: EC 2.7.11.1 Non-specific serine/threonine protein kinase
MGARCSKLSVCWWPPHFKSPMLENGAADDDGSGVPVFAEYSLDELRAATDGFAPDRIVSEHGEKAPNVVYRGTLFSSGRTVAIKRFGRSAWPDSRQFLEEARAVGQLRSGRLANLIGCCYESGERLLVAEFMPHETLAKHLFHWETNPLSWAMRMRAALYVAQALEYCSSKGRALYHDLHAYRVVFDVDGNPRLSCFGLMKNSRDGKSYSTNLAFTPPEYLKTGRVSPESVVYSFGTILLDLLSGKHIPPSHALDLIKGKNFLVLMDSCLESHVSNSDGTDLMRLASRCLQYEARDRPNLKAVVSGLASLHKDASIPSHTLLGIQQDKRSSDKVRLSGIGKAFARADLNEVHEILLDDGYNEDDMANAEVSLQSWTGELSESFIVKRHADNAFKSKDFATAVECYSRFLDSGAAVAPTMLARRCFAYVVAGKLQEGLEDAKRAEDIAPGWPMGHYLQALALHSLGREAESNEALKKGTVLEAERNSRATTV

SEQ ID NO: 18313 - DNA, 685 bp, Panicum virgatum
  misc_feature: Ceres CLONE 1796464
  misc_feature: Encodes the peptide sequence at SEQ ID NO. 18314
actctgctgtagccgccgccgccatgtggaagcagtttcttggcaagatctcacagaagtcgcccaaatccggcagcggcggccgaggctcgccgccgcagaagtccccgccgtcgtgtggagccaatggggctgaagcggagctgagagcgtcgcctccgccgcaggcgtcggccgtcgccgtggcgcctgggtcggagaccagggaggacgtgttcctccgcaagctcaacatctgctgcgtggtgttcgacttcgccgccgagcgggggagggactcgccggagttggagaggaagcggcaggtgctcgtgtccctcgtcgactgcgtctccgtggccgaggagcccctcacggaggcaatgatctcggcctgcgtccgcatgttcgccatcaacctcttcagggtcttcccgcccaagctccactccggcggcgccactgatgaggacgagccattctttgacccctcctggtaccacctgcaggtcgtgtatgagctgctgctccggtttgtgatgtcaccggttgttgatgtgaaggtcgctaggaagtacatggacaactcattcatctctaggcttctggacctgttcgattctgatgaccctagggagagggaatgcttgaagacagtcttgcacaggatatacggaaaattcatgggcaataggccatttatccg

SEQ ID NO: 18314 - protein, 220 aa, Panicum virgatum
  misc_feature: Ceres CLONE 1796464
  misc_feature (48)..(220): Pfam Name: B56 Pfam Description: Protein phosphatase 2A regulatory B subunit (B56 family)
MWKQFLGKISQKSPKSGSGGRGSPPQKSPPSCGANGAEAELRASPPPQASAVAVAPGSETREDVFLRKLNICCVVFDFAAERGRDSPELERKRQVLVSLVDCVSVAEEPLTEAMISACVRMFAINLFRVFPPKLHSGGATDEDEPFFDPSWYHLQVVYELLLRFVMSPVVDVKVARKYMDNSFISRLLDLFDSDDPRERECLKTVLHRIYGKFMGNRPFI

SEQ ID NO: 18315 - DNA, 718 bp, Panicum virgatum
  misc_feature: Ceres CLONE 1796474
  misc_feature: Encodes the peptide sequence at SEQ ID NO. 18316
gaagccaaggagaacactcctcttcctctccctcccttcttccatagttccattccattccatcccatcccaaatccaagcagaaccgaagctccggacagtttgagattcaatcgaggatggtggcgccggtggtgatcgcgtcggcggggctcggcatgctggcgggcctggcgatggcgaaccggtcgctgggggacgggctcccggcggcgtccaggtgggacgcgcgcccgcgctgcgccacgtgcggcggctccggccgggtcgagtgcctgtgcaaccgctggtccgacggcgactccggctgccggacctgcgccggctcgggcaggatgccctgccgcagctgcggcgggtccggcacgggaaggccgctccccgcgcggctcaccgtccagcaccagaagccgccgccgccggccggctacaactgacggtcggtcgatcgattgattaggtatatgtccatatccatggatcgatgattatagctcgttctttgcgctcgaggcgcaagcgaaaaactccgctagctagtatggaaatatacgtccattcgatcgtgtggatgacttcactggtgcgccgggggctgccggcaggacgctccgcgagcggcggcgggcggcaccacgacgcgcgaccgctgcagtcggcgcccggcggcgggaagcttcagcaccatgacgcgcggcctcgcggggctgggctgagg

SEQ ID NO: 18316 - protein, 105 aa, Panicum virgatum; identical to SEQ ID NO: 12805
  misc_feature: Ceres CLONE 1796474
  misc_feature: Functional homolog of the protein sequence given in SEQ ID NO 50455
  misc_feature: Useful for making plants with modulated nitrogen use efficiency

SEQ ID NO: 18317 - DNA, 640 bp, Panicum virgatum
  misc_feature: Ceres CLONE 1796474-R
tgtcaggatttgaaaactggagtgacaggaggcatttctgaagatgatggtcctatgggcacacaagaagcttgccatatccttttgaccgcactgcgttcattcaaagaaactttgattgatgatgacaaggtgaattttatggagatggatgccttcttacttgatgatgagatgaactcccttgtgaagagaataactactttagagtcaggattagcagctgcaagagacagtatcttgagaataggtggcgaccatgataacaggaaagaaatggaaagaaggagctggtggcaaatgtggacggcagggctgggaagagcttgttcccgattcttcactagttgatggatatcgttgtcttttgttgaagcatgttgcaagggaagggaaggttgcagaccgtttatgtgctagtttagtttcatgttccatgtctgtttagtgtagtacccatcatcagtacctatatgtgtgcctagttggcaaggtgctttatctgctctatgcagcgatgtcaatcagtggcccatggtctagaaagcaagccatgctctttagcttttagcccaagggtttgttgtctttgctctgcatgatcgaatttgcttgagtagccgttggcttttgatccact

SEQ ID NO: 18318 - DNA, 1976 bp, Panicum virgatum
  misc_feature: Ceres CLONE 1796478
  misc_feature: Encodes the peptide sequence at SEQ ID NO. 18319
gcgtcggacagaaaaaaaaatcccgtcgccccctcctcccgttcttggctactcccttcttccccttccctctcctctctctagggttagaatttctccatggattcttgaattttggtactgaaattgaatgggaaaggaggccctctcctccttgtgccctccgaggtgttgattggattcaatttcgtgcatctttgtggttccttgtggctggatttttggtttcctttgttctgttcgtgcgcaggtgctctagcggcgtgcagcgcttgggggcaggcggcggcggcctctgctctctgccctgctgggcagcgcgcatgcagcacagggcccaggcggggctctacgcgtagcgggcggccaggcgcacggctcccagcggcgcccggtgacgcgctggacgagcggtgccttggtgggggcgcgcggcttcagccagactcgcagcgcttgaggagaaggcatcctcggcatcagctggcgacggcgctgagggcagacgagcccacccagcagcggccaggaagggcggccggcaaggccagcagcaggcagcgccatcagcaagctgcagcacggcgtgcggcccacgaggacaaggcacacagccccagcatcaggccgaccgcagacacctctcgtgaagttcaccggaccggaggaaactgcaagcagcagcaatggcggaggtgaggaaccggaaggtgctgctgaagcgctacgtgacgggttaccccgccgaggacgacatggaggtcgtcgacggcaccgtgcacctcgccgtgccgcaggggctccaggcgcccgccgtgcggctgaagaacctctacctctcctgcgacgcctggatgcgcggccgcatgtctaagcgcgacgaccccgtcaccgtcgtcaatgacttcgtcctaggcgaggctttgaccaactttggcgttagcatggtgattgactccacacacccggattaccatgccggcgatctcgtgtgggggatgagcgggtgggaggagtacacgctcatctctgagccggcgtcgctcgtcaggatcaaccaccccgagctgccgctttcctactacacaggcgttctcggcatgtcgggcctcactgcgttcgctgggctgttcgacgtgtgcaagcccaagaaaggcgacaccttcttcgtctcagcggcgttcggtgctgttggccagatcgtcggccagctggccaagctcgccggctgctacgtcgtcggcagcgtcggctccgacgagaaggtgagcctcctcaagggcaagctcggcttcgacgacgccatcaactacaggaaggagcccgacctgggcgccgcgctgagccggtgcttcccggagggcatcgacatctacttcgacaacgtgggcggcgcgacgctggatgcagcgctgctctgcatgcggacgcgcggccgcgtcgccgtgtgcgggatggtgtcgcagtacaaccttgacgacccggccgccggggtgcgcatgcgcaacctgccgttgctcgtcgccaagcgcatccgcatggaggggttcaacgtcgccgactacctcgccgacggcccctactaccgctggttcgaggaggagatggccggctacctccgtgacggcagagtgacatacgtggaggacgtcgtggaagggctccatggcgcgccggccgcgctcgtggggatcttccaggggcggaacgtcggcaggcagctcatcgttgttgcgcgggagtgacgatcagtgggttgcattatattggccgtcagcccaaacactgatagatgatgcttcagttcatttcgatcattgtttaatttctttctcaatcatgtatatatgcttgctttgagtgatgacaagagggtatcatatcggtatgcaactatgcatcgatgcataccatttctttcgatcttgctcaggatgatgtggaaaaaataatattgaataaaaatatatatttgt

SEQ ID NO: 18319 - protein, 352 aa, Panicum virgatum
  misc_feature: Ceres CLONE 1796478
  misc_feature (156)..(309): Pfam Name: ADH_zinc_N Pfam Description: Zinc-binding dehydrogenase
  misc_feature: SWISSPROT Homolog: EC 1.6.5.5 NADPH:quinone reductase
MAEVRNRKVLLKRYVTGYPAEDDMEVVDGTVHLAVPQGLQAPAVRLKNLYLSCDAWMRGRMSKRDDPVTVVNDFVLGEALTNFGVSMVIDSTHPDYHAGDLVWGMSGWEEYTLISEPASLVRINHPELPLSYYTGVLGMSGLTAFAGLFDVCKPKKGDTFFVSAAFGAVGQIVGQLAKLAGCYVVGSVGSDEKVSLLKGKLGFDDAINYRKEPDLGAALSRCFPEGIDIYFDNVGGATLDAALLCMRTRGRVAVCGMVSQYNLDDPAAGVRMRNLPLLVAKRIRMEGFNVADYLADGPYYRWFEEEMAGYLRDGRVTYVEDVVEGLHGAPAALVGIFQGRNVGRQLIVVARE

SEQ ID NO: 18320 - DNA, 709 bp, Panicum virgatum
  misc_feature: Ceres CLONE 1796480
  misc_feature: Encodes the peptide sequence at SEQ ID NO. 18321
aaagaacccgcggcagggaagaggagaggagggggtcgtgaaaggaagaaaccaaacccagcccaagaacagaacaccaccgttccctcgccggggcgtccatccgcaacgatctgcagccatggcgatggcttacaagatggcgacggaggggatgaacgtgaaggaggagtgccagcgctggttcatggagatgaagtggaagaaggtgcaccgcttcgtggtgttcaagatcgacgagcggtcgcgcgccgtgctggtggacaaggtgggcggccccggcgaggggtacgaggagctcgtcgccgcgctgcccggcgacgactgccgctacgccgtcttcgacttcgacttcgtcaccgtcgacaactgccagaagagcaagatcttcttcatcgcctggtcgccggcggcgtcgaggatccgagccaagatcctgtacgcgacgtcgaagcaaggcctgcggcggctgctggacggggtccactacgaggtgcaggccaccgacccctccgagatgggcttcgacgtcatcagaggccgcgcgcaatgaagccgctcccggcctcccctacgtgtgtgtgtgtgtgcgcgcgcttgtgcccgtctcctgtcaccactacgaagctgagggagtggcagcggattaatgaaacgtccatctccgcgacgtagattccactgaacattgctcctctacatacgatag

SEQ ID NO: 18321 - protein, 143 aa, Panicum virgatum
  misc_feature: Ceres CLONE 1796480
  misc_feature (16)..(143): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence
MAMAYKMATEGMNVKEECQRWFMEMKWKKVHRFVVFKIDERSRAVLVDKVGGPGEGYEELVAALPGDDCRYAVFDFDFVTVDNCQKSKIFFIAWSPAASRIRAKILYATSKQGLRRLLDGVHYEVQATDPSEMGFDVIRGRAQ

SEQ ID NO: 18322 - DNA, 617 bp, Panicum virgatum
  misc_feature: Ceres CLONE 1796482-R
  misc_feature: Encodes the peptide sequence at SEQ ID NO. 18323
ttttgcttttgctgaagtcaacagggaagctgttgtgtgggatcgggcaagtagagagatcaagctgaagaacatgctgtaccacccagctcggatcaacaccgtggcctggtcacctgacagtcgtttggttgccactggctcactggacacctgcgctattgtctatgagataggcaagccagcagccagttgcattaccatcaagggagcacatcttggtggcgttcatggtttaaccttcgtcgacaatgatactctggtgactgccggtgaagatgcttgcattcgtgtctggaaggtggtgcagcaataggttactcttcagttttcactctggtgtgcattgagcatgtcttccctattgattggaataaatgttttttttaccttgttggtatgatgcttgttactcacagaccatagcatcatgcggccttctttgcattcagagttttaagtttgctgtacaattcgttttgagttgtattcttcccatggtttttcaggaaggtgttctttgtaagtgtattcctacatctgattttgttagaaactgagaatatagggatgcttattgttgttgcttttaccccgtcattggactatttgttagt

SEQ ID NO: 18323 - protein, 104 aa, Panicum virgatum
  misc_feature: Ceres CLONE 1796482-R
  misc_feature (63)..(100): Pfam Name: WD40 Pfam Description: WD domain, G-beta repeat
  misc_feature (20)..(57): Pfam Name: WD40 Pfam Description: WD domain, G-beta repeat
FAFAEVNREAVVWDRASREIKLKNMLYHPARINTVAWSPDSRLVATGSLDTCAIVYEIGKPAASCITIKGAHLGGVHGLTFVDNDTLVTAGEDACIRVWKVVQQ

SEQ ID NO: 18324 - DNA, 152 bp, Panicum virgatum
  misc_feature: Ceres CLONE 1796482
cggaagtaatctgtcatatgcgccctgcgtctcatgtggttgctgatcccccccaaaatatggatttgctggagaggatgcgacttacatgaaaaatacttgttagccgggtgttcgacttacagaaagaatgggtatttatgcccaacaac

SEQ ID NO: 18325 - DNA, 670 bp, Panicum virgatum
  misc_feature: Ceres CLONE 1796497
  misc_feature: Encodes the peptide sequence at SEQ ID NO. 18326
gcgcgttttcctcgcattgcctccgcgacctcgtcgtcacaattcccccatttcccgattcctctaaaactttccccaatcccccctccccgattcggagcacgcgctaatggcgacgaaatgcgctgccgccgcggtcaatctggccaccggccgcccccgcaagcgcgcaaggcttggctgggacgtggctccggctgccgagacaagatatacaaaaaaataggtgaaggtacttttggtcaggtactagagtgttgggaccgagaaagaaaagagatggtggctattaaaattgttcgttctgtaaagaagtacagcgatgcagcaatgatagagattgatgtcctgcagaagcttgcaagaaatgatgcagcaggcaaacattgtgtccaaatacggaactggtttgactatcgtagccatatttgtattgtctgcgagaagcttggcccaagcctatacgattttctacggaaaactggctatcgcccattcccaatcgatctagtacgccagattggagagcaacttttggaatctgttgcatttatgcatcgcttgcagctaattcatactgatctgaaaccagagaacattctccttgtttcttcggattatgtcaagttacctgatcccaaggatggatcattctcaaggacactgccaa

SEQ ID NO: 18326 - protein, 183 aa, Panicum virgatum
  misc_feature: Ceres CLONE 1796497
  misc_feature (29)..(183): Pfam Name: Pkinase Pfam Description: Protein kinase domain
  misc_feature: SWISSPROT Homolog: EC 2.7.12.1 Dual-specificity kinase
MRCRRGQSGHRPPPQARKAWLGRGSGCRDKIYKKIGEGTFGQVLECWDRERKEMVAIKIVRSVKKYSDAAMIEIDVLQKLARNDAAGKHCVQIRNWFDYRSHICIVCEKLGPSLYDFLRKTGYRPFPIDLVRQIGEQLLESVAFMHRLQLIHTDLKPENILLVSSDYVKLPDPKDGSFSRTLP

SEQ ID NO: 18327 - DNA, 617 bp, Panicum virgatum
  misc_feature: Ceres CLONE 1796497-R
  misc_feature: Encodes the peptide sequence at SEQ ID NO. 18328
agagcattagagctgttctcaaattgcctcgcctgcagaacctggtgatgcagcatgtggatcactctgctggggatctcattgacctgctgaagcgccttctagcatatgagccctcagccaggttgactgctgaagaagcgttgagtcatggcttcttcacaagacatggcaataggcggtcgctatgacatccctgattctgaagaagcgcgagtcatgtggcttcttcaaaagatatggcagctatgccatctgcgattccactatgccatgttcatccgatcaaaaaggaagggcaatctatgaggattccaaggcaacagatacaaccgataattcagatgatatctgagctagtgctggtagaagtagaagcttgtatgttgtgattgactgagaaaacaaaattgtaaagctcccttaacaaaattgtaaagctcccttaacaaaattgtagcaaaatcatagagagatgccggattgatataccgtatacgtctactaggagcacatgttgtgtctgaatactgcagtgtggagttgcatacaaacccgagtttgttaatcagctgttacaaattgttcggcacaatgcaagttacaagtcgcaggtg

SEQ ID NO: 18328 - protein, 62 aa, Panicum virgatum
  misc_feature: Ceres CLONE 1796497-R
  misc_feature (1)..(55): SWISSPROT Homolog: EC 2.7.12.1 Dual-specificity kinase
  misc_feature (27)..(54): SWISSPROT Homolog: EC 2.7.11.22 Cyclin-dependent kinase
  misc_feature (27)..(54): SWISSPROT Homolog: EC 2.7.11.23 [RNA-polymerase]-subunit kinase
SIRAVLKLPRLQNLVMQHVDHSAGDLIDLLKRLLAYEPSARLTAEEALSHGFFTRHGNRRSL

SEQ ID NO: 18329 - DNA, 673 bp, Panicum virgatum
  misc_feature: Ceres CLONE 1796498-R
  misc_feature: Encodes the peptide sequence at SEQ ID NO. 18330
tcgccggacttctcacagctgcttcgccagtacagatcgtagcggggagcttcaacacccatggaaagaaggagccgccgaagcagcagcagcaacagctgcttgccccgtcaccgtcggacgcgtcaccgacgccgctaaaggtcgcgccggcggcgccgagcagcccgccgtccaggggcacgatgagcctgagcgagtcatccggcggggccccgagccccccgccgcacgcaggcggcggcagccacgggcagcagcaccagtcggcagggggtttctccggcgcgtcctggaaatgacctccgatcccccgcgccatcggtgaccggagcaggctccgtctctttcaccgtcgtaggactctggcagaacgaaggacgtccggtggccgtcgaggaaccagaagctcttttgtgtagggtgacgcactgatgcgttggagggacgactagaagctttgtagccttgtaggtggtgtgcgtgtcgtcagactctgcagctctcgctttaggtgtggacgtgtgtgtctcgatcgtgcagcggtagtgctggtagggcgggctgctgcttatcgtcgtccgggtgccgtgtactgaatctttaccgttatgctgtgcgattatgcggcatgttcgatgctgcgtgcgtttcgacttggcacgcgtgattt

SEQ ID NO: 18330 - protein, 99 aa, Panicum virgatum
  misc_feature: Ceres CLONE 1796498-R
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
AGLLTAASPVQIVAGSFNTHGKKEPPKQQQQQLLAPSPSDASPTPLKVAPAAPSSPPSRGTMSLSESSGGAPSPPPHAGGGSHGQQHQSAGGFSGASWK

SEQ ID NO: 18331 - DNA, 684 bp, Panicum virgatum
  misc_feature: Ceres CLONE 1796498
tttatttactctgctttaccccttcttcctgccgttttcgtttcccatttcctcctcgtttctcccccgccattccaagctgctgccacccaccaccctacgctgtaaaatctgtgctgctctgctcgtcgccgaaaattttggctttgagcagcgctgggttttgttttttttttttttttgcagctcctacctcactccgccgctcgtaagatttggcccttgcagcagagaagctgcaacctttggagcgagaaatcgtcggagggagctgttgattcgtagctctctgctgctcacttgctcagtgtggaatgatggaggtgaggccatcttcggagcaaggggtgattccggggagggagccgttcgggctgccgaaaagcccgccgacgccgccgtcctccggcggcccgcagagcctgcgcatggcgttcaccacggacggcacccccgtcttcgccccggtgagctccgcgccgccggcgacggcgacgtaccagcccttgggcggcggggccgctccgagcttggctgccgcaggaggcaatggcagagcggcggtgcacccggctcccgctggcgctggcgagccggtggccaagaagaagcgtggtcggccaaggaagtacggccccgacggctccatgtcgctggcattggtgcccgcgtcccctgggctgc

SEQ ID NO: 18332 - DNA, 1932 bp, Panicum virgatum
  misc_feature: Ceres CLONE 1796509
  misc_feature: Encodes the peptide sequence at SEQ ID NO. 18333
actcttgccaccactccctgtcagaccatctgtcagtgtgtggcctcactccccgatccttcgccaggccacaggcaccccgtgagctccgccgctcggcgcctgcctccctcgtccttcctcactgcaggagcaatggcgatggccgccatggcctccccgtcgtccatgaccatgatccccgcgcgccaccacggcgccgcgccatccccgtcaacctccggcgactcctcggtccgccgcctccgcgcgcagccgggccacgtccggcgcggccgcgggacgtccgtctcaacggccgcggcgcggcggcggccgttcgtcttcaccccgcgcgccgtgtccgactccaagagctctcagacctgcctcgaccccgacgccagcacgagtgttcttgggatcattcttggaggtggtgcggggaccagattgtaccccctgacaaagaagcgtgccaagcctgcagtgccattgggtgccaactacaggctgattgatatccctgtcagcaattgtctcaacagcaacatctcaaagatctatgtgctgacacagttcaactctgcttctctcaatcgtcacctctcaagagcctatggaagcaacattggaggttacaagaatgaaggatttgttgaagtgttggctgcccagcagagtccagataatccaaactggttccagggtacggcagatgctgtaaggcagtacttgtggctatttgaggagcataatgtgatggaatttctaattcttgctggtgatcacctgtaccggatggactatgaaaagttcattcaagctcacagagaaacagatgctgatattactgttgctgccctaccgatggatgagaaacgtgcaactgcatttggtcttatgaaaatcgacgaagaagggaggataattgaatttgctgaaaaaccaaaaggagatcagttgaaagcgatgatggttgataccactatacttggccttgatgatgtgagagcaaaggaaatgccttatattgctagcatgggtatctatgtttttagcaaagatgtaatgctccagctcctccgtgaacaattccctggagccaatgactttggaagtgaggttattccaggtgcaacaagtattggaaagagggtgcaagcttatctgtatgatggttactgggaagatattggtaccattgaggcattttataacgcaaacttgggaattaccaagaagccaataccagattttagcttctatgaccgttcggctccaatttatacacaacctcgacatctgccaccttcgaagaactgtaagatacaccattctgtagttggactccgatcttgcatatctgagggtgctatcatagaggacactttactaatgggtgctgactactatgagactgaaactaacaagaaactccttgctgaaaaaggtggcattcccattggtattgggaagaattcacacatcagaagagctattattgacaagaatgctcgaattggagacaatgtgaagataatcaatgttgacaatgttcaagaagctgcaagggagacagatgggtacttcatcaaaggtggaatagttaccgtgatcaaggatgctttgctcccaagtggaacagttatatgaagtagatgtgcaacatccgcccgagggtcatcgacgatcagcagcacccagttccttgcttgatttgctgaccatgtcttggagaccatggaaacaataaaagaactgccattcaaggcactcttcgtttttttctcattgttcttttgtcatctttaagattctaggatataatgttgtagcggcaaatgttctgcatatgttgttagaatccatattgcatgcctggatttgggatacttctttgatgttgtgtaattatcagttttaaatatcatgctttgctgccgttgatcc

SEQ ID NO: 18333 - protein, 499 aa, Panicum virgatum
  misc_feature: Ceres CLONE 1796509
  misc_feature (88)..(363): Pfam Name: NTP_transferase Pfam Description: Nucleotidyl transferase
  misc_feature: SWISSPROT Homolog: EC 2.7.7.27 Glucose-1-phosphate adenylyltransferase
MAMAAMASPSSMTMIPARHHGAAPSPSTSGDSSVRRLRAQPGHVRRGRGTSVSTAAARRRPFVFTPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDVRAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKNCKIHHSVVGLRSCISEGAIIEDTLLMGADYYETETNKKLLAEKGGIPIGIGKNSHIRRAIIDKNARIGDNVKIINVDNVQEAARETDGYFIKGGIVTVIKDALLPSGTVI

SEQ ID NO: 18334 - DNA, 686 bp, Panicum virgatum
  misc_feature: Ceres CLONE 1796514-R
  misc_feature: Encodes the peptide sequence at SEQ ID NO. 18335
gtgcgctccacgcctcctctcctcgccagggaagagaaagcttcttaaagaccaataaatcaaagcgtgatcagctcggtgccaatcaaacctcaacaaccaagtttcatgtctgatctcgacgtccagcttccatctgccttcgacccgtttgctgaggcaaatgctgaggactctggtgctggcccgggaacaaaggattatgtgcatgtgcgcatccagcaacgcaacggcagaaagagtctgactactgttcagggactgaagaaagagttcagctacaacaagatcctcaaggatctcaagaaggaattctgctgcaatggtactgttgtccaggatccagagctaggccaggtcattcagcttcaaggcgatcagcgtaagaatgttgccactttcctagttcaggctgggattgcaaagaaggagaacatcaagattcacgggttctaagggacctgtaaatgcttgtgtgcgctattgcgcgttaccgcttattcggaagcttgaagcagtgatattatagttactgctttctataacaacataagtattgtgctattatcagtgtgttttgcttgatgcaagttgtgttttctcctcattatgcgccaccagcatatgggtatggcttgtatggaatattgttgccaccttaataaaagtactccctgtttggttag

SEQ ID NO: 18335 - protein, 115 aa, Panicum virgatum; identical to SEQ ID NO: 14
  misc_feature: Ceres CLONE 1796514-R
  misc_feature (27)..(108): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time

SEQ ID NO: 18336 - DNA, 702 bp, Panicum virgatum
  misc_feature: Ceres CLONE 1796514
agtccggggagccccaagtccttacgctaccagtccggggagccccaagtccttccgctaccgacatcgaccccgagtccgggatctcccgaaatgcccgcaagcccaacacccgtggccgtcgccccgtcctgctccccgccggcctcgccgtcctggtcctcctctccgtgcacgagatagcgagtgtgccacttcgtcgggtcagaagcaaagatgactttatcagcagagtcaaggaagctacgagaggtgcttgtcatacttcatcagcagagtatcacaaagtgagaggcaactagacgtgtctaactgcttctgtttctagacgtgtctaactgcttctgtttcatgaaattaattggtcaaagataagcatcctggacagtggattttaggtgggggttagaacaatgatgtgttggggaggtgatttcccggctgctgcttggctggacggtatatcaccatccagtgtgtttttcaaactcgtctagctctcacgcatggatggtcatatgggcatagccaactcattagctatgaagattgctgggattgcaaagaaggagaacatcaagattcacgggttctaagggacctgtaaatgcttgtgtgcgctattgcgcgttaccgcttattcggaagcttgaagcagtgatattatagttactgctttctataacaacataagtattgtgc

SEQ ID NO: 18337 - DNA, 1755 bp, Panicum virgatum
  misc_feature: Ceres CLONE 1796518
  misc_feature: Encodes the peptide sequence at SEQ ID NO. 18338
gtcaccgcgtcggtgtcgctcgccatatcccctttcctccccctcccacctccctctccgagcccgactccggcgatccgccccgcctgaaccctactccaagtcgcctcgccggttgggttgggggccgagtcgagccgatccgatcggatcggggcgggttcctgcgccgccgctgcgtgacctcctcccggtcgctcgcctgctcggctcgatcggccggggacagcggcggccagatctgcgatggaaggcaacaaggacgacgcggccaagtgcctgcgcatcggcaggggcgcgctcgaagccggcgaccgcgcgcgcgccgtcaagttcctctccaaggccaagcgcctcgacccgtccctccccatcgacgacctcctcgctccgctcctcaacccccaggacgactcccccgcttcctcgtcgtcgtcgccgccgccgccgccgccgccaccgccaccgccacaaccttcagcagctgggccagccggagcagctgaggctgacgggctgagagagaggaagcagaagggcaagaagagggaggaggaggaagaggttactggcgctgcgagggagtacacggcggagcagctcgaggttgtgcgccaggtcaagaagcactccagggactactaccagatcctcggcctcgagaaggactgcaccgtcgaggacgtgcgcaaggcctaccgcaagctctcgctcaaggtgcaccctgacaagaacaaggcccctggcgcagaggatgccttcaaggccgtttccaaagctttccagtgccttagtgatgccgagagtcgtaagcgctatgaccttgttggcttggatgagccagtaacacaccacaggagggcctccactgcccgtgcgtacaatggtttctatgaggatgactttgacccagatgagatattcagaaacttctttggtggtatggcacctgccaccaccaggcagtttggacagtttgggacgttccatttcagaactagtggaatgcatgctcatgggcagcaaaactctggtggctcaactgtcaggatgcttattcagcttttgccagttctactgctgctgttgctcaacttcctgccatcctctgagcctgtttactccctctcccgctcctatccatatgagcacaagttccaaacaccacgtggagttgcgtactatgtcaagatgcctaattttgaggagcagtatccacaccaaagcactgagcggtcaacactggagcggcatgttgagagggattattattcaataatcacgcaaaattgcagggttgaactgcagcgccgccaatgggggttagcataccagacaccacactgtgatatgcttaaaaaatttgaggcggcagctcagtaattcattcaatggtccaaggttgacagggagaagagaagctggctgtgtgtaaaagtttccaatacctgtgcccttggctgtcagcttcagatcggaggggacatctagtttggactagtagtaaattttgtggaataagtgcctttgatgactatacaccaacctccccagatgctatcttagtagtgctgagtgcatcacagagctacttcgaaaggatatgtatggttgagcttcataggggttgatcacatgcagacctgtgtatgtatatgaagtatatcgatctcatttttttcttactgttttgagagaatacctgacttaacagctactataacagaaatagcttcttcatttttgaagttgctc

SEQ ID NO: 18338 - protein, 378 aa, Panicum virgatum
  misc_feature: Ceres CLONE 1796518
  misc_feature (131)..(192): Pfam Name: DnaJ Pfam Description: DnaJ domain
MEGNKDDAAKCLRIGRGALEAGDRARAVKFLSKAKRLDPSLPIDDLLAPLLNPQDDSPASSSSSPPPPPPPPPPPQPSAAGPAGAAEADGLRERKQKGKKREEEEEVTGAAREYTAEQLEVVRQVKKHSRDYYQILGLEKDCTVEDVRKAYRKLSLKVHPDKNKAPGAEDAFKAVSKAFQCLSDAESRKRYDLVGLDEPVTHHRRASTARAYNGFYEDDFDPDEIFRNFFGGMAPATTRQFGQFGTFHFRTSGMHAHGQQNSGGSTVRMLIQLLPVLLLLLLNFLPSSEPVYSLSRSYPYEHKFQTPRGVAYYVKMPNFEEQYPHQSTERSTLERHVERDYYSIITQNCRVELQRRQWGLAYQTPHCDMLKKFEAAAQ

SEQ ID NO: 18339 - DNA, 2388 bp, Panicum virgatum
  misc_feature: Ceres CLONE 1796523
  misc_feature: Encodes the peptide sequence at SEQ ID NO. 18340
actcgcgtcgcgtccctctctttccctctcctccatacccttcgcgtgcgcagaagaattcccttggtgctagagggcgcggctgctctcctccctctcctctcgccttcgtcttcgtcttccccctttcggctccccccgcggcgtagcttttcgagtctccgttcgtccgtccgtgcgcgtgagatcgcgtgcgagcgcacgcacgcgtgcgcgccgattttcgaagagttcggggggcaaggaatcccccgaataggaaagattccccgctcccacgcctcaaatcccatcccctgatccccccaccacgaccgccctcgattcgcttccggttgctgctgccgaggtcgggattggtgctggaattcggtgcgggggagctgttcggcgcccggccccctccgcgcgattcgattcgattcgattcgattggttcccaccggggcttgctgcttccgccgccggggtgctccgagctgctcgagctgggcggcggagtctccgggtgataccctccgctgctcgatctaattcggtccccagtcgccgcagctcccccgccgccgccgccgctgattccggcgccatttcgatccgcgcggccggatccttggatgattccgatcgatccgggaccaagaggaccagggcttcgtcacctcaccagggccccggcggcggtggatccatggcgggggagaaggcgtcgcgtgcgttctccatcgaggagctcccgggccacctcgtcggggaggtcctgacctccggcaggctcgcggccgccgacctagccaggctcgaggccacctgccgcgcgctcaggccgctcgcggagttcgccgcgtccaagctctgcgtcgcgcggccggcgttcgcggccatggggcccgcggcgaggggggagctgctggagcggtgcgggggcagctggaagaaggtgctcaggttcctgcagtccgtcgagcagtcgtcaggcgccgtcgcgacatcatcgggcagcatgcaagtagccacaggaagatatcacacacttttggtccatgactcttctctctattcttgtgggtccagcttgtgtggtgtgctaggtcatggcccagatactacacagtgtgcagcattcagtcgggtttcctttccatcactttcccgtgttatcaacatctctgcctcacacaatcatgctgcttttgttacagagtctggtgaggttttcacctgtggtgataattcatcattatgctgtggtcatggtgaagtggggaggacaatatttcgaccaacgcgagtagaagcacttaaaggggtttcttgcaagcaggttgctactggtctaagttttactgttattcttacaagggatggccaagtatatacatgtggaagtaacacacacggccaacttggccatggtgacaccatagacagggccattccaaagattattgaattaattgaaggccccactcaagtggtgcagatagcagctggggcaagctacacatttgctgtaacagacgatggaacagttcattcctttgggtcttgcactaatttctgccttggacacggtgatcagcatgatgaacttcgtccacgtgccatccaatcatttaagaggaggaacattcatgtagttcgtgtttctgctggagatgagcatgctgtggctctcgatgctctgggacacgtttatacatggggcagaggatactgtggagccttgggccatggtgatgagaacgataaaactagcccagaattgatcagcagtctgaagaaccaagttgctgtgcaggtatgcgcaaggaagagaaagacctttgttctcacagatgagggctcagtttatgcgtttggatggatgggctttgggagtttaggatttcctgaccgaggatcgtctgacaaagtaatgaagccccgcgttctcgagagcctgcgggatcactacgtctcccaaataagtactggactgtatcacactgttgctgtgacaaataaaggcattgtatttgggtttggggacaatgaacgagcgcaacttgggcatgagtacattcgtgtgtgcttgaaacctactgagatagtgttccagaagagtatagaagatatagcgatcgcggcacctagtggttgaattaaagaccaaaaactgccattttggacactgttgcctgcatatgttgtatttataagctattcttctcagcaactgtattttatactgtgatttgtgagtaattgggtgaacagtagaagatcaaggttggacgacaatgtagtgtagctaaagaagcatatagtctagtaatgtgtgatgtattgaataatttaacccaccatttttcctctgtataaaaaatattggtgtgtttttttttt

SEQ ID NO: 18340 - protein, 483 aa, Panicum virgatum
  misc_feature: Ceres CLONE 1796523
  misc_feature (225)..(275): Pfam Name: RCC1 Pfam Description: Regulator of chromosome condensation (RCC1)
  misc_feature (278)..(329): Pfam Name: RCC1 Pfam Description: Regulator of chromosome condensation (RCC1)
  misc_feature: SWISSPROT Homolog: EC 2.7.11.1 Non-specific serine/threonine protein kinase
MAGEKASRAFSIEELPGHLVGEVLTSGRLAAADLARLEATCRALRPLAEFAASKLCVARPAFAAMGPAARGELLERCGGSWKKVLRFLQSVEQSSGAVATSSGSMQVATGRYHTLLVHDSSLYSCGSSLCGVLGHGPDTTQCAAFSRVSFPSLSRVINISASHNHAAFVTESGEVFTCGDNSSLCCGHGEVGRTIFRPTRVEALKGVSCKQVATGLSFTVILTRDGQVYTCGSNTHGQLGHGDTIDRAIPKIIELIEGPTQVVQIAAGASYTFAVTDDGTVHSFGSCTNFCLGHGDQHDELRPRAIQSFKRRNIHVVRVSAGDEHAVALDALGHVYTWGRGYCGALGHGDENDKTSPELISSLKNQVAVQVCARKRKTFVLTDEGSVYAFGWMGFGSLGFPDRGSSDKVMKPRVLESLRDHYVSQISTGLYHTVAVTNKGIVFGFGDNERAQLGHEYIRVCLKPTEIVFQKSIEDIAIAAPSG

SEQ ID NO: 18341 - DNA, 1846 bp, Panicum virgatum
  misc_feature: Ceres CLONE 1796534
  misc_feature: Encodes the peptide sequence at SEQ ID NO. 18342
gacgggcgtgtgcgcgggtgacggtgacgtgggctcctctccttccccctcgcctcccgctttccagagaccgggcaagcaggacggaccattctatactccccctagtcctccagtccccgctgacgtgtggacccatgcgccgtggggcccacgtgtcagcggcacaactgcacgtgcagttactgcaccggatctctctccctcgagtcccctctctatatattgcggctcgtgccccggccattgccctccacgctgctcaggcattcctcctactccagctcctcttctctcttcgttctctcgtctcctcttctcaatcgagcgctcgattgttgacctgctcagctgcacgccggcctgagacatcggaggggggcgtggtgaccggcagatggatccgtggatcagcagccagccttctctgagccttgacctgcacgtcggcctgccgccgctcagccgccaccaggcgccgctcgccttggccaagcccaaggtgctcgtcgaggagaacttcctgcagcctctcaagaaagaaccagaggtcgcggctctcgagacggagctccagcggatgagcgaggagaacaggtgcctggccgaggcgctcacggcggtggccgccaagtacgaggcgctgcggagccagtacacgcagatggtcgccgcgggcgccaccaccaccggcccgtcctccacgtcggagggcgggtcggtgtcgccgtcgaggaagcgcaagacgagcgagagcctggacaccgtggcggcggcgccgggcgcgcagcacccgcagtacggcctgcacggcgggccgcacccgggcgccgcggcggcggcggaccagacggagtgcacctccggcgagccgtgcaagcgcatccgggaggagtgcaagcccaaggtgtccaagctgtacgtgcacgccgacccgtcggacctgagcctggtggtgaaggacggctaccagtggcgcaagtacgggcagaaggtgaccaaggacaacccctgcccgcgggcctacttccggtgctccttcgcgccggcctgccccgtcaagaagaaggtgcagcgcagcgccgacgacaacaccatcctggtggccacgtacgagggcgagcacaaccacggccagcccccgccggcgccggcgcagcaggcgcacgacggcccgggcgccagcaagaacgccgccgccaagccgccgtcgccgcccaggcccgccgccccgccggcgcctcaccacccgcagctccaccaccaccaccaccagcagcagcagcagcagcagcagcaagacgtcgctgcggcgatgagcggcgagcccgtgggcgcggcggccgcggcgacgtcggagctgatccggcgcaacctggcggagcacatggcgatgacgctgacgagggaccccagcttcaaggcggccctcgtcagcgcgctgtccggccggatcctcgagctctcgcccaccaaggaataacaaccggggaaaagggaaacgtatcccaataccatcacacgagcttcttcttggttgctcagatttcctcgcagccatggccaaccgggcttggccttcctctgctcactgttctagcaaaacagcaagatcactggtggacgtgaggatctgcagttcggcatcagtatcaaaacgactgaagagtctgcgccgcgcatccggacatggcgcggaccgaagatcaccacggcgggtgatctgacctgaacctgattgaccggcgatggtcgagtttattagcagatcgaaaatagcacaggaaacaacatcaaactgtacaatccttgtaggcaaattattgttcgcccatttttccttgat

SEQ ID NO: 18342 - protein, 361 aa, Panicum virgatum
  misc_feature: Ceres CLONE 1796534
  misc_feature (187)..(247): Pfam Name: WRKY Pfam Description: WRKY DNA -binding domain
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MDPWISSQPSLSLDLHVGLPPLSRHQAPLALAKPKVLVEENFLQPLKKEPEVAALETELQRMSEENRCLAEALTAVAAKYEALRSQYTQMVAAGATTTGPSSTSEGGSVSPSRKRKTSESLDTVAAAPGAQHPQYGLHGGPHPGAAAAADQTECTSGEPCKRIREECKPKVSKLYVHADPSDLSLVVKDGYQWRKYGQKVTKDNPCPRAYFRCSFAPACPVKKKVQRSADDNTILVATYEGEHNHGQPPPAPAQQAHDGPGASKNAAAKPPSPPRPAAPPAPHHPQLHHHHHQQQQQQQQQDVAAAMSGEPVGAAAAATSELIRRNLAEHMAMTLTRDPSFKAALVSALSGRILELSPTKE

SEQ ID NO: 18343 - DNA, 1524 bp, Panicum virgatum
  misc_feature: Ceres CLONE 1796536
  misc_feature: Encodes the peptide sequence at SEQ ID NO. 18344
acacgcgacgcgacgccaggccagacaagcttctgctggtacaacactgtggagaaggaacagcctcagcaatggcgtcgttgatctctgttcactgctgccctctactgcgaccttcttcgatctccgcaaggacaccggtgcccaggcgagtaatcagaagaggaacgaggaggccgctgcggagatgcctctgctctcaatacgccgacgaacggcagccgccggactcgccgccgcagctggagcgcctcttctccaacctcaaccaggcgaccatggagcacgagcctggaagcctcaccagtgccatcttcctagtggctggcacaacggttggggcaggtatcctcgcaatccctgcagtcacacaagaagctgggttcttgacctctgcagttacatgcatttcctgctggttatacatggttgtgacagggttgctagttgctgaagtaaacgtcaatacaatgtgtgagctaggatctggaggtgtctccctggtctcaatggctatgcgcactctagggacatttggagtaagaacagcctgcttatcctatttatttatacattatgcgcttcttgtcgcatacgtggcacgctcttcagatatcataacagacacattgggtattccattatgggagagtgctaccctgttttcactggcttttgggggaatttgttactttggaagccagcgactgatcggtgcagtaaatggatttctggtagttggcatcctaacgtccttcacttctcttgttgtggttgcaagtggaaacctacagtggagttctcttcttgaagcgaattttgctgctgctccacaaagtataccaataattgctctttcatttgtataccagaatgtagttcctgttctctgtacaaatttggagggagacctgtcaaaagtacgaacagctatcatagcgggtactgccataccactggctctgttcctagtgtgggatggtgtaatcctgggaacacttcctggaattgcagggagcagcactgtttctgatccattagaactacttagatcaagtaatgggatagtggggcctattgttgaggcgttctcatttctcgcaataggcacatcatacattggatttgttctaggactctcagacttcctagcagacttgcttaaactaccaagtggccagaacaaaccgctgccatatttattaactctgctccctccacttcttctgtccctgcttgatccggagatatttttcaaagcactggactttgcaggaacttatggagttctagtactctttggagtttttcctgcagctatgtcttggtcagagagatattcagatgagtcggaagcccccgtaccccctatcgtcccaggaggaaaacttactctctcggttgttatgggaggtgcattgcttgttattgtttcagaggtaatcaaggatgtaatgcaactacaagggctacactgacaatcagtgcaggtgaaaggatatataaacaatgtcccttcagatc

SEQ ID NO: 18344 - protein, 468 aa, Panicum virgatum
  misc_feature: Ceres CLONE 1796536
  misc_feature (70)..(455): Pfam Name: Trp_Tyr_perm Pfam Description: Tryptophan/tyrosine permease family
MASLISVHCCPLLRPSSISARTPVPRRVIRRGTRRPLRRCLCSQYADERQPPDSPPQLERLFSNLNQATMEHEPGSLTSAIFLVAGTTVGAGILAIPAVTQEAGFLTSAVTCISCWLYMVVTGLLVAEVNVNTMCELGSGGVSLVSMAMRTLGTFGVRTACLSYLFIHYALLVAYVARSSDIITDTLGIPLWESATLFSLAFGGICYFGSQRLIGAVNGFLVVGILTSFTSLVVVASGNLQWSSLLEANFAAAPQSIPIIALSFVYQNVVPVLCTNLEGDLSKVRTAIIAGTAIPLALFLVWDGVILGTLPGIAGSSTVSDPLELLRSSNGIVGPIVEAFSFLAIGTSYIGFVLGLSDFLADLLKLPSGQNKPLPYLLTLLPPLLLSLLDPEIFFKALDFAGTYGVLVLFGVFPAAMSWSERYSDESEAPVPPIVPGGKLTLSVVMGGALLVIVSEVIKDVMQLQGLH

SEQ ID NO: 18345 - DNA, 1727 bp, Panicum virgatum
  misc_feature: Ceres CLONE 1796539
  misc_feature: Encodes the peptide sequence at SEQ ID NO. 18346
gacccgccctcgtttctctcgatctctccagctctctctctctctcaacttgactctcccaagccgccagccgccggccgccggccgccaccgccgccccgctcgcggcacgcctcgcttccgccgccgctcctgccgccccgcgggacggcccgaccgcctcggccgctcccggtgcccccgccgcttcgaggagcttgggggccagaatttggcgcgccgtgtccgtaccgtatatctctccgatagcgagccgttccgcgctacgggaaggcgccgatcccgcgcccggcggacgcgaggcgcgatgtgcggatcggagcatggacgtgatcgtgcccgcgcccagtaggagctgctgcggggccggccggcgtgggagcggggggctgcgccggagttgacgatgtacatagcgcgggaggcgtccaaggtatggcggaaggtgactgcggagatattggtggagctgcagctcctgcgcgagaagtgggggctcctactcgccgggctgatttttcagtacattcatggattggctgctcgaggagtacattatttgcatcgacctggaccactgctccaggacttgggatttatggcccttccagagcttgggcaagacaaaggttatcttagtgagagcatattttcttccatcttcctctccttcgtgttgtggacattccatccttttatttatcacagcaaacgtttctataccgtgttaatctggcgcagggtgctcgcttttttagttgcttcacagtttttaaggattattacattctattcgacccagctcccaggtccaaattatcactgtcgtgagggctcagaattggcaactcttccaccaccaaacagtgtacttgaagttctcctgattaactttcctcgtggagtgctttttggttgcggtgatttgatattttcatctcacatgattttcactcttgtcttcgtccgaacataccataaatatggctcaaaaagattcatcaagttccttgcttggttcatggctatagttcagagtcttcttataattgcttctcgcaagcactactccgttgacgttgttgttgcatggtatactgtaaacttagtggtattctttgtggacaacaagctgccagaaatgccggatcggactaatggtgtacctttgcttccgttgagcaccaaagaaaaggagatcaggttgaaggaagagagagacagtaaattgaaggacgagttccacaagttactgaacgggaaccatggggatcctactgatcggcgacagcgggcgcagatgaacgggaggcagcacgacgaagacaccaatcacgcgctcaccgaggcacccactgccaacggcacataaggggccggcggcatctgcttttcaccgggagctttgtccttggcgcccggaggagaatcctccgggggccaagaaaaaaaaaactgcccgggagaggccccgcccgttccgcctgtagctctgaagccgtccaagattccagccgcagcgttccatatgcatctccccgaactgcctcgtcgcgtcgtgcaggaatccgagtcctctggcgtttctcggctcagccttattacttgcagtaacatttctcaggagggcacagggaaaaaaatagaaagaaattgatcttgatgtacatactgatctgataacacatgcgggctatatatatcctatagcgtcggtcttgccactc

SEQ ID NO: 18346 - protein, 321 aa, Panicum virgatum
  misc_feature: Ceres CLONE 1796539
  misc_feature: SWISSPROT Homolog: EC 2.7.8.27 Sphingomyelin synthase
MYIAREASKVWRKVTAEILVELQLLREKWGLLLAGLIFQYIHGLAARGVHYLHRPGPLLQDLGFMALPELGQDKGYLSESIFSSIFLSFVLWTFHPFIYHSKRFYTVLIWRRVLAFLVASQFLRIITFYSTQLPGPNYHCREGSELATLPPPNSVLEVLLINFPRGVLFGCGDLIFSSHMIFTLVFVRTYHKYGSKRFIKFLAWFMAIVQSLLIIASRKHYSVDVVVAWYTVNLVVFFVDNKLPEMPDRTNGVPLLPLSTKEKEIRLKEERDSKLKDEFHKLLNGNHGDPTDRRQRAQMNGRQHDEDTNHALTEAPTANGT

SEQ ID NO: 18347 - DNA, 1924 bp, Panicum virgatum
  misc_feature: Ceres CLONE 1796548
  misc_feature: Encodes the peptide sequence at SEQ ID NO. 18348
acaacccgcatcgcgtacccctgcactgaccaccgcctcgccgccctccactgctcgaatccgactcaccgccgcctggctcccgggcccattcgccgacccgtcgccggcgaaaggcgcgccgcctcctcccgctgaaagcgaagcgcgccacctcggaggaattgtagccgccgtcctcctcctgtagacgactcggggcggagatcccgccggagttggggctgattccccccttctctccattcaaggcgctggtagtttattggagaagctcctggggggagggacatggacatggcattgccagttgtgaatgccactgcggcggtgctcgctcgtgtctctgctgcgttcaatgccccttttgcccgtgccgtcgtcttcggggtacatattgatgggcacttggtcgtggaagggcttcttattgcagtcatagtgttccagctcaccaggaagagctacaaacccccaaagaagccactcactgaaaaggagattgatgagctatgtgatgaatgggagccagagctgctatgtcctccgatcaaggacggggccaggattgacactccaatgttggaaagtgctgccggaccgcatacaatcgttgatggtaaagaagttgtcaactttgcgtcggcaaactacctcggtttaattggcaatgagaagattattgattcttgcgttggttcacttgagaaatatggtgttgggtcttgtggtccacgtggcttttatggaacaattgatgtccaccttgactgtgaggcaaaaatagctaaattcctcggaactccagactccattctgtattcttatgggatttctacaatatttagtgtgataccagccttttgtaagaaaggagatatcatagtcgccgacgagggtgttcactgggcagtgcaaaatggtctccatctatcaagaagtactgtggtgtacttcaagcacaatgatatggcttcacttgcaagcactttggaaaaacttactcgtggaaataaacgtgctgaaaagatcagacgctacattgttgtagaatccatttaccagaattctggccaaattgcccccttggatgagattgtcaggttgaaggaaaaatatcggttccgtgttattctggaggagagtcattcttttggggtgcttggcaagtctgggcgtggccttgccgaacattatggagttcccgttgaaaaaatcgatatcatcactgctgggatgggaaatgctttggccactgatggtggcttctgtacaggaagtgtcagagttgttgatcatcagcgtctaagtagctctgggtatgttttctctgcctcgctgccaccttatcttgccagtgccgctgtttctgccgtcaactacctggaggaaaacccgtcagttcttgcaaacctaaggagcaatattgctcttttgcataaaggactatcggatactccggggcttgaaatttccagccatgttctgtcacctattgtcttccttaaactgaaaaaatcgacaggttctcctaccaccgacctagatcttcttgaaactattgctgagagggtcttgaaggaagattcagttttcattgtgacatcgaagaagtcaaatcttgataggtgtaaacttcccattggaatccgcctgtttgtatcagctggccacacagaatcagacatctccacactttcctcatccttgaagagggtttctgcgtcagttctttcagaccacttttgatccacgccagattcccttgaagacgaaatggaaccctttcgacgtgatgtgtactctaggccgtgtgcgtttggtaaatgtacataacctgtacatttctacatctgatgaattgatcttgttgttgctcatacctacagtacttgccaaataaaattttgtagtaactgttgtc

SEQ ID NO: 18348 - protein, 485 aa, Panicum virgatum
  misc_feature: Ceres CLONE 1796548
  misc_feature (111)..(473): Pfam Name: Aminotran_1_2 Pfam Description: Aminotransferase class I and II
  misc_feature: SWISSPROT Homolog: EC 2.3.1.50 Serine C-palmitoyltransferase
  misc_feature: Functional homolog of the protein sequence given in SEQ ID NO 50804
  misc_feature: Useful for making plants with modulated nitrogen use efficiency
MDMALPVVNATAAVLARVSAAFNAPFARAVVFGVHIDGHLVVEGLLIAVIVFQLTRKSYKPPKKPLTEKEIDELCDEWEPELLCPPIKDGARIDTPMLESAAGPHTIVDGKEVVNFASANYLGLIGNEKIIDSCVGSLEKYGVGSCGPRGFYGTIDVHLDCEAKIAKFLGTPDSILYSYGISTIFSVIPAFCKKGDIIVADEGVHWAVQNGLHLSRSTVVYFKHNDMASLASTLEKLTRGNKRAEKIRRYIVVESIYQNSGQIAPLDEIVRLKEKYRFRVILEESHSFGVLGKSGRGLAEHYGVPVEKIDIITAGMGNALATDGGFCTGSVRVVDHQRLSSSGYVFSASLPPYLASAAVSAVNYLEENPSVLANLRSNIALLHKGLSDTPGLEISSHVLSPIVFLKLKKSTGSPTTDLDLLETIAERVLKEDSVFIVTSKKSNLDRCKLPIGIRLFVSAGHTESDISTLSSSLKRVSASVLSDHF

SEQ ID NO: 18349 - DNA, 2254 bp, Panicum virgatum
  misc_feature: Ceres CLONE 1796549
  misc_feature: Encodes the peptide sequence at SEQ ID NO. 18350
ctcgcacaccatcagagctagattaacctcgcacccccgaaatgttccgctcgccgcgccccacattgcccgcaaatccaaacttttcgggcccaatcaccccccaaatccacctttttcgtcactccatcctgtcctaaatcccctcctcagtcctccccactgccccaaagtcctacctttcccactgcaccccctgcggaaatcgcagagattcttggccactttgattgcccgcctgcgcaaatccgctctagctcaccaaattccctgcaaaaccccagtcttttggcggtatttttttcttggaaattttcgttctttaccgcccaattctgctcgggctccggggagatccaccgtttctgcttgagccaggagcgagctgggcagcgcggcgcccatgtcggactccgagctgtcccagggcacgctggtgttcgggctccacctctgggagctcgtcggcatcggtgtcggcgccgccttcgtgctcctcctcgtcctcctctcgctgctgtgcctgctcgcgtcccgccgccgcaggcgccgccgcgccgtcccggccacccccgtcctccacctccccgtcgtcgtgcccaatgcccagcccaagcacgccgccaagccccccaaggacatccaggaggtgccttcacgcggcgccgcggcccccgccgccccgcccaaggcgccgctcgcgcaggtgctccaggcgccgccgccggactccatccagatcgagaccgggaaggagcaccgcatcacgttcccagagcagcagcagccgccgcaccaccagcggagtggggggccgtcgtcgcggggcggcagcggcgagagccgcggcgggggcggggagccgggggtcccggaggtgtcccacctggggtggggccactggtacacgctcaaagagctggaggacgccacgtgcatgttcgccgacgagaaggtgatcggcgagggcggctacggcatcgtctaccacggcgtgcttgaaggcggcgtgcaggtcgccgtcaagaaccttctcaacaacagggggcaggctgagagggaattcaaggttgaggtggaagcgattgggcgggtgcggcacaagaatctggtgcggctgttaggatactgtgctgaagggaaccaaaggatgcttgtgtatgagtatgtcaataatggaaacttggagcaatggctccatggtgatgttggtcctgtgagccctcttacatgggatatcagaatgaagattattttgggaacagcaaaagggttaatgtatttgcatgagggacttgaaccaaaggtggttcaccgtgatgtcaagtcaagcaatattctccttgacaagcactggaatgctaagctttctgatttcgggctagcaaagcttttgggttcagagaggagttacgtcacaaccagggtcatggggacatttgggtatgtcgcgccagaatatgcgggcactggcatgctgaatgaaactagtgatgtctatagctttggaatccttatcatggaaataatatctggacgggttcctgttgattacaacaggccaccaggggaggttaaccttgttgaatggctgaagacaatggtcagcaaccgaaattctgaaggggttttggatccgaagatgactgagaagcctacttctagggcattgaagaaggctttgctagtggctctacggtgcgtagatcctgaggctcgcaagaggccaaagatcgggcatgtcattcacatgcttgaagttgatgattttccctacagagatgaacgtcgtggtggcaaggctccaactcaagagagatcggtcgaaacacctacaagtgaaccgggcgatagcagtggaaacaacacgccaaaagacgcaccgaaaggaggagagcctttcaaatggagaactcaagagacctagctatcaggaaaaccggtgattgatcagagtcctcatgcccgtccgaaagtctgtacgctgcgtggccacaaaaggctcatttgctgtctcctcggttggtcagttgggcacacaagctctgcaaccaatggtgatcgtcgtgacagtatctgtacattgttggattaatatgttaggcatagtgattttttggttattttgttccgggtgttatttatgcgggagatgatttgtatggtaaaggcgtgtctactcttggggtgggcaaagattattgagcattgctatagctgaaaactgttccagtgggattggccaatggcatcc

SEQ ID NO: 18350 - protein, 507 aa, Panicum virgatum
  misc_feature: Ceres CLONE 1796549
  misc_feature (180)..(429): Pfam Name: Pkinase Pfam Description: Protein kinase domain
  misc_feature: SWISSPROT Homolog: EC 2.7.11.1 Non-specific serine/threonine protein kinase
MSDSELSQGTLVFGLHLWELVGIGVGAAFVLLLVLLSLLCLLASRRRRRRRAVPATPVLHLPVVVPNAQPKHAAKPPKDIQEVPSRGAAAPAAPPKAPLAQVLQAPPPDSIQIETGKEHRITFPEQQQPPHHQRSGGPSSRGGSGESRGGGGEPGVPEVSHLGWGHWYTLKELEDATCMFADEKVIGEGGYGIVYHGVLEGGVQVAVKNLLNNRGQAEREFKVEVEAIGRVRHKNLVRLLGYCAEGNQRMLVYEYVNNGNLEQWLHGDVGPVSPLTWDIRMKIILGTAKGLMYLHEGLEPKVVHRDVKSSNILLDKHWNAKLSDFGLAKLLGSERSYVTTRVMGTFGYVAPEYAGTGMLNETSDVYSFGILIMEIISGRVPVDYNRPPGEVNLVEWLKTMVSNRNSEGVLDPKMTEKPTSRALKKALLVALRCVDPEARKRPKIGHVIHMLEVDDFPYRDERRGGKAPTQERSVETPTSEPGDSSGNNTPKDAPKGGEPFKWRTQET

SEQ ID NO: 18351 - DNA, 328 bp, Panicum virgatum
  misc_feature: Ceres CLONE 1796551
  misc_feature: Encodes the peptide sequence at SEQ ID NO. 18352
gtctggcgatacacagcacccccacatctagagagagagagagagcgatcgagatggccttttcttttttgagatattgaggagatagcttcgtcgcggcgggaggagatggcggttaccatcccctccgtgaaggctaggcgcatcttctacaggctcggccaccccaccggccaggtgcacctgtgccgcctctgctgctgcctcgcgaggggggtcctgcccaacgacgcaccccctggcagccgccacgccctgcacttcaggcatggactctccgactgtcttggacagggtgttcttcacggtgtggatactgtgaatacca

SEQ ID NO: 18352 - protein, 73 aa, Panicum virgatum
  misc_feature: Ceres CLONE 1796551
  misc_feature: SWISSPROT Homolog: EC 4.2.1.11 Phosphopyruvate hydratase
MAVTIPSVKARRIFYRLGHPTGQVHLCRLCCCLARGVLPNDAPPGSRHALHFRHGLSDCLGQGVLHGVDTVNT

SEQ ID NO: 18353 - DNA, 1860 bp, Panicum virgatum
  misc_feature: Ceres CLONE 1796557
  misc_feature: Encodes the peptide sequence at SEQ ID NO. 18354
ctgtttccacactacagtgtccggtgtccggcgtcctccccctccctccctccctctcgccccctctgtcctctccacttgagaagaacacaatagaaaaaaaggcaaaaaaacatttaccttttttatatctactatctgaataaaatcaagaggaggaagagggagagagggcagggagggggagaagagtagcaatccagattcagagagatagcaatcagctcgagctgcgttggtgaattgattgctcgctgttccagtcctgcattcctgcggcggcagtttttggcaagtaggtggcgtggcaagcatggtgccgggctatgactgcgccgcctccgtgctgctctgcgcggaggacaacgccgctatcctcggccttgatgaggagggggaatcctcttgggcgggcgctacgccgccacgcgacaccgtcgccggcgccggcgccggcggcgggatcgccgtcgagggattcttgacggagctccccctgctgtcggatgagtacgttgcggcgctcgtggagagggagacggggcacatgcccgccgaggggtacccccagaagctgcaacggcggcatgggggcctggatttggccgccgtcaggaagggcgccgtcgattggatttggaaggtcactgagcattacaatttcgcaccgttgactgcagttctatctgtgaactacctcgatagattcctctccacgtatgagtttcctgaaggcaaaccttggatgccgcagctcttgacagtggcatgcttgtcattggctatgaaaatagaggagacttttgcgccactccccttggacttgcaggttgttgagtcaaagtttgcttttgagggaaggaccataaaaaggatggagcttctgatgtttagcaccttaaactggaggattcatgctgttactgcttgctcattcatcgaatactttcttcacaaattgagtgatcttggtgcaccttccttgctcgcacgctctcgctctgctgaccttatcttgagcactgcgaaagatgctgagttcgtgatgttcagaccctcagagattgctgccagtgttgctcttgctgcgattggtgaatgcagaagttctgtaattgaaagagctgctactagttgcaagtacttggacaaggagcgagttttaagatgccatgaaatgattcaagagaagattactatgggaagcattatcctaaaatctgctggatcatcaatttcctctgtgccacaaagtcccattggtgtattggatgctgctgcctgtctgagtcaacaaagcgatgatgctactgctggatctcctgcaacatgttaccatagttcttccacaagcaagaggagaaggattactagaagactactctgattgcttcaggtgtgctcctcaccgcttaggagtttttggttgttcaatcatcttaatttagtttggccaaaggattatggtatagtcgagtagttgctgcaaggaacaacaaagcaggcacactacttgatccatatagaacaaataacaagctgcgtgccgtgagccagttcatgcaattggcatccgcaagggggatactaaacccttgggggtcctgggatgctggtgtaggtatagagggaacaaggaatttgcatatgttgtagagatgagagctctctcttaccattttgtacttttgctccttcaatttgcattgaactttaggcaagggttgccttgggcattgaacttgtgatgagcgagaagaatacaaaaagggatcagcagcggaatagaacaatttgatatatttcatgaaactacagatatgctttcttttgttaatcatgagctatcattttgttgac

SEQ ID NO: 18354 - protein, 357 aa, Panicum virgatum
  misc_feature: Ceres CLONE 1796557
  misc_feature (66)..(201): Pfam Name: Cyclin_N Pfam Description: Cyclin, N-terminal domain
  misc_feature (203)..(332): Pfam Name: Cyclin_C Pfam Description: Cyclin, C-terminal domain
MVPGYDCAASVLLCAEDNAAILGLDEEGESSWAGATPPRDTVAGAGAGGGIAVEGFLTELPLLSDEYVAALVERETGHMPAEGYPQKLQRRHGGLDLAAVRKGAVDWIWKVTEHYNFAPLTAVLSVNYLDRFLSTYEFPEGKPWMPQLLTVACLSLAMKIEETFAPLPLDLQVVESKFAFEGRTIKRMELLMFSTLNWRIHAVTACSFIEYFLHKLSDLGAPSLLARSRSADLILSTAKDAEFVMFRPSEIAASVALAAIGECRSSVIERAATSCKYLDKERVLRCHEMIQEKITMGSIILKSAGSSISSVPQSPIGVLDAAACLSQQSDDATAGSPATCYHSSSTSKRRRITRRLL

SEQ ID NO: 18355 - DNA, 1869 bp, Panicum virgatum
  misc_feature: Ceres CLONE 1796564
  misc_feature: Encodes the peptide sequence at SEQ ID NO. 18356
atccatccatccatccattattccagcatccaacctccatccatcctcttcacacacacacacacactgactgtacacagagcgaggtataggcagtgagatcggctgccgacgccgacggcatggccataggcgccttcgcggaaggccccgccggcgccggctacagcggccgggtcacgtccttcgtggtgctctcctgcatcgtggccggcagcggcggcatcctcttcggctatgacctcggaatctcaggtggggttacctccatggagtccttcctcagcaagttcttccagatgaaaggggacaagaacgtcagcaactactgccgtttcgacagcgagctcctcaccgtcttcacctcctccctctacgtcgccggcctcgtctccacgctcttcgcctcctccgtcacgaggaagttcggccgccgagcctccattctcatcggcggctccgtcttcatcgtcggctccgtcttcggcggggcagccgtcaacgtctacatgctcctcctcaacaggatactgctcggcataggactaggcttcaccaaccagtctattccactgtacctatcagaaatggcgccaccccagtaccgtggggccatcaacaatggctttgagctctgcataagcattggcatcctcatcgcaaacctcatcaacttcggagtcgagaaaattgtagatggatggggctggagaatctctctctccctggcagctgtgccagctgcattcctaaccatgggcgcaatattcctgcctgagacacccagcttcataatccaacgtgatggcaacattgatgaggcaaagatcctgctccagaggctacgtggcacaactagaatccagaaagagcttgatgatttggtctctgctagcaatgtctcgaggacaatacaacatccactccggaacatattcaagaggaagtacaggccacagcttgtcatagcactcttggttccattcttcaaccaggtcacaggaatcaacgtcatcaacttctatgcgccagtcatgttccgaaccatcgggctcaaggagagtgcatccctcatgtcagcggttgtcacacgcatctgtgcaacagttgccaacattgtagcaatggttgtcgttgacaggtttgggcgtaggaagctcttcctagtaggtggcattcagatgatcttgtcacagatcatggtaggggcagtcctagctgcaaagttcaaggaccatggaggaatggaaaaggagtatgcatacctagtcttgatcatcatgtgcgtgttcgttgcaggctttgcatggtcttggggacctctgacctacttggtcccgacggagatttgcccactggagatcaggtcagccgggcagagtattgtcgttgctgtgatcttcttggtgacgtttgtgattggccagaccttcctcgcaatgttatgccatctcaagtttggaacattcttcctctttggtggatgggtgtgtgtgatgacactcttcgtatacttcttcctgccagagacgaagcaactgccaatggagcaaatggagcaggtctggaggaggcactggttttggagaaggattattgtaggggaggaagaggaagaggaagagagagaggcaagaagcatagctttgtccaacacatagtgattttcttttaggatcaagttaatttggtgaaacctgcagaaacgatacaccgtaccattttgattagtaaatatgcatgcatcaaggtatattattgtatagctgcgcaaattgtatcctaactagtaactgcattagttagtctcctaatttgacgcttctggcattgtgtaacctataaagggcttccagaattatagcaagt

SEQ ID NO: 18356 - protein, 512 aa, Panicum virgatum
  misc_feature: Ceres CLONE 1796564
  misc_feature (26)..(482): Pfam Name: Sugar_tr Pfam Description: Sugar (and other) transporter
MAIGAFAEGPAGAGYSGRVTSFVVLSCIVAGSGGILFGYDLGISGGVTSMESFLSKFFQMKGDKNVSNYCRFDSELLTVFTSSLYVAGLVSTLFASSVTRKFGRRASILIGGSVFIVGSVFGGAAVNVYMLLLNRILLGIGLGFTNQSIPLYLSEMAPPQYRGAINNGFELCISIGILIANLINFGVEKIVDGWGWRISLSLAAVPAAFLTMGAIFLPETPSFIIQRDGNIDEAKILLQRLRGTTRIQKELDDLVSASNVSRTIQHPLRNIFKRKYRPQLVIALLVPFFNQVTGINVINFYAPVMFRTIGLKESASLMSAVVTRICATVANIVAMVVVDRFGRRKLFLVGGIQMILSQIMVGAVLAAKFKDHGGMEKEYAYLVLIIMCVFVAGFAWSWGPLTYLVPTEICPLEIRSAGQSIVVAVIFLVTFVIGQTFLAMLCHLKFGTFFLFGGWVCVMTLFVYFFLPETKQLPMEQMEQVWRRHWFWRRIIVGEEEEEEEREARSIALSNT

SEQ ID NO: 18357 - DNA, 1803 bp, Panicum virgatum
  misc_feature: Ceres CLONE 1796615
  misc_feature: Encodes the peptide sequence at SEQ ID NO. 18358
gaagccaaaagctaaaacctctccgtgtcacacgagccggagaaaatgcgcgcgacgatcccgaccccctcgctcctcgtcgccccgaggccgccacggctccgctccctccacgctgccgcggctcccatctcccgccaccacgcccgcggagcaggacgtcctcgcacccgcctgctcgtggcggcgccgccgtccgcccccggtgaggcggcggagcagcaggcggagccgagcacgtgggcgcccgagtccggcgagaagttctcgtggagggatcactggtaccccgtgtccctcgtcgaggacctcgatcccagccgccccacgccgttccagctcctcaaccgcgacctcgtcatctggaaggaccccaagtccggcaagtgggccgcgctcgacgaccgctgcccccaccgcctcgctccgctctcggaggggaggatcgatgagacggggtgcttgcagtgctcgtaccacggctggtcattcgacggctccggtgcctgcaccaggatccctcaggccatgcccgagggtcccgaggcccgggcggtgcggtcgccgaaggcgtgcgcgaccaagttccccaccctcgtctcccaggggctgctcttcgtgtggcctgacgagaatgggtgggagaaggccactgccaccaagcctccaatgttgccgaaagagtttgatgacccggccttctccacggtgacgatccagagggacttgtactatggttatgatacgttgatggagaacgtctctgacccgtcccatatagaatttgctcaccacaaggttactggacgaagagatagagccaggcctttgacatttaagatggaatcaagtggtgcctggggttactcaggggcaaatactggtaatcctcgcatcactgcaacttttgaggccccatgctatgcattaaacaaaatagagatagacacaaagttgcccatttttggagaccagaaatgggtcatatggatatgctcgtttaacattccaatggcaccagggaagactcgttctattgtctgcagtgctcgaaattttttccagtttacgatgccaggaaaagcttggtggcagcttgtccctcgatggtatgaacattggacttcaaatttggtctatgatggtgatatgatcgttcttcaaggccaggagaagattttcctagctgcatccaaggagtcttctgcagatgttaaccatcaatacacaaagatcacattcacacccacacaggctgaccgttttgttttagcattccgcacatggctaaggaaatttggcaatagccaacctaagtggtttggaaatcctagccaagaagcattgccttctaccgtcctttcaaagcgtgagatgctagacagatacgagcagcacacattgaaatgctcatcttgcaaaagagcatataattcattccagactctgcagaaggtcttcatgggggcgacggtagtgtgctgtgctaccgctgggattcctgctgatgttcatctcagaatattgatcggtgcagctgctttggtcagtgctgccctggcatacgcattccatgatctccagaagaattttgtattcgtagattacgtgcatgctgacattgattagattttttgagggggtctggtgtagcgacgccgtcatgctcatgtctcatatagtcgtatctgtaacctaggcgcatagctagggaatgtaaccttcttttccccccggacattgtccaatgtctttttagcgaccatgtcaaattgtcaatgtaagtttcaaaaaatatagctc

SEQ ID NO: 18358 - protein, 527 aa, Panicum virgatum
  misc_feature: Ceres CLONE 1796615
  misc_feature (288)..(396): Pfam Name: PaO Pfam Description: Pheophorbide a oxygenase
  misc_feature (79)..(188): Pfam Name: Rieske Pfam Description: Rieske [2Fe-2S] domain
  misc_feature: SWISSPROT Homolog: EC 1.13.12.14 Chlorophyllide-a oxygenase
MRATIPTPSLLVAPRPPRLRSLHAAAAPISRHHARGAGRPRTRLLVAAPPSAPGEAAEQQAEPSTWAPESGEKFSWRDHWYPVSLVEDLDPSRPTPFQLLNRDLVIWKDPKSGKWAALDDRCPHRLAPLSEGRIDETGCLQCSYHGWSFDGSGACTRIPQAMPEGPEARAVRSPKACATKFPTLVSQGLLFVWPDENGWEKATATKPPMLPKEFDDPAFSTVTIQRDLYYGYDTLMENVSDPSHIEFAHHKVTGRRDRARPLTFKMESSGAWGYSGANTGNPRITATFEAPCYALNKIEIDTKLPIFGDQKWVIWICSFNIPMAPGKTRSIVCSARNFFQFTMPGKAWWQLVPRWYEHWTSNLVYDGDMIVLQGQEKIFLAASKESSADVNHQYTKITFTPTQADRFVLAFRTWLRKFGNSQPKWFGNPSQEALPSTVLSKREMLDRYEQHTLKCSSCKRAYNSFQTLQKVFMGATVVCCATAGIPADVHLRILIGAAALVSAALAYAFHDLQKNFVFVDYVHADID

SEQ ID NO: 18359 - DNA, 2185 bp, Panicum virgatum
  misc_feature: Ceres CLONE 1796639
  misc_feature: Encodes the peptide sequence at SEQ ID NO. 18360
acgcctctacattcttgacttcccctattctctctctctctctctctctctctctctctctctccggcggccggaaatctcctcaaattccgctgatcttatcctggctgaccagtaggcgaggggggaaggacggctcttgagttcaatttcttggaggatcagctagcatttgtaagatagtgctcagaaacggggagatgagctgcttgccgtgctccggatcgtcggggaaggatgccaagagcttggaagcgctctcgccgtccccacgacctgcggcgaagtcggcaccagttcgatcaaattcacgtgctccaggctccaggaaggaaaattctgtacctgttcgcagaggaggaaacacttcacatggcccagcacagattttcactttccgggagttggccattgctaccaagaatttcaggaaagattgcctgttgggagaaggtggctttggtcgtgtgtataaaggacgcatggaaaatggacaggtcattgctgtgaagcaacttgatagaaatggctttcaaggaaatcgtgaatttcttgtggaggttctcatgctaagtctcttacaccaccctaatctggtcagattaattggctattgcgcagatggtgatcagcgcctcctagtttatgaatacatggtgttgggatcactagaaaatcacctgtatgattgtccgccagacaaggaacctcttgactggaatacaaggatgaaaattgctgccggtgcagcgaaaggtctggagtatcttcatgataaggcaaatccacctgtcatatacagagatttcaaatcatcaaatattcttctgggtgaagactactaccctaagctgtctgattttgggcttgcaaaacttggtccagttggtgacaaaactcacgtatcaacacgagttatgggaacatatggatattgtgctcctgaatatgccatgacaggacagttgacagtaaaatctgacgtttacagctttggtgttgtgttccttgaacttattacaggccgcaaagcaattgaccacacccagccttcaggggagcaaaatcttgtcgtatgggcacgtccacttttcagagaccgaagaaagttctgccaacttgctgatccattgctgcaaggccgctatcccaaaaggggtttgtaccaggcattagctgttgcagcaatgtgtttgcaggagcaagcagcatctaggccgctcattggagatgttgtcactgcactatcttatctagcttcgcatccttacgatccaaatgcaccctccacaaaggattctaggacctgcccatctaccccaagggcaaaaactcaccgacgaacaaccagtgttcctgatgctcaacatgctgctgagacacttatgttgaacttcccagacttgaggaaggacactatcagaggaggggaattcgagcaggatcgtactgaaggttctggcagcagtagtagctccggaaggaacgatggcctggatgtcctacaacttctggccgctgttaaggtcgatgcccgtgagaaatagaatgcagagccgggcaaattctgcaggcagctttgatagtacatgcaattgatggattataccattctttccttgctatcaatttgccaggaatcttcaatgcttggcacgagtcttttttgaccggacattgttgagagttgaacactattactgccacatcctccatgtctggtttttagttgctccatggaccacttctacagttcttccaggttttacctgaagactcagggtgatgacaaaatgaagcattccgtcactgagatttagacttcagagcacgcattctgatgagaatcggctacattccagactgtcaaccaccccactgtgatggacgctgcactatgcatcattgaagagtggggttgagtttccttgttttacttctgtagaaatcacgcttcgtgtgacaacgtgctgcggagttgctgcctggattgtgtgtctgtacatgtaaatgggttgtatttgtaagtagagctgttcatagaggattttttatcttttgccggtgatgatgtgatggagtgatttgcagacgacttatcatacatagttctgtacagaaaaggatgtttaatttttggcttgctacgaaacattgacaaatcatatatagtattatacttatg

SEQ ID NO: 18360 - protein, 448 aa, Panicum virgatum
  misc_feature: Ceres CLONE 1796639
  misc_feature (76)..(349): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
MSCLPCSGSSGKDAKSLEALSPSPRPAAKSAPVRSNSRAPGSRKENSVPVRRGGNTSHGPAQIFTFRELAIATKNFRKDCLLGEGGFGRVYKGRMENGQVIAVKQLDRNGFQGNREFLVEVLMLSLLHHPNLVRLIGYCADGDQRLLVYEYMVLGSLENHLYDCPPDKEPLDWNTRMKIAAGAAKGLEYLHDKANPPVIYRDFKSSNILLGEDYYPKLSDFGLAKLGPVGDKTHVSTRVMGTYGYCAPEYAMTGQLTVKSDVYSFGVVFLELITGRKAIDHTQPSGEQNLVVWARPLFRDRRKFCQLADPLLQGRYPKRGLYQALAVAAMCLQEQAASRPLIGDVVTALSYLASHPYDPNAPSTKDSRTCPSTPRAKTHRRTTSVPDAQHAAETLMLNFPDLRKDTIRGGEFEQDRTEGSGSSSSSGRNDGLDVLQLLAAVKVDAREK

SEQ ID NO: 18361 - DNA, 2036 bp, Panicum virgatum
  misc_feature: Ceres CLONE 1796640
  misc_feature: Encodes the peptide sequence at SEQ ID NO. 18362
gccccctgcatgctcacctcagagcttgcccacacctttgcattgcctctaggttcagtgtgcgagctctgtagctcatgctgtgacctgctctctctctctgatccttgtatacaacaacaacaacaacaacaacaacaacaacaacaaggctgcagcatctctgcttccgccatggacagagtcacccagtgggtttcgtcccaggatgtccctgccgaccttaccatccggatcgccgactccatcttccctctccacaaggcggtcatggtgcccaggtgcggctacatccgccgggccgtcgccaaggacccctccgccgccgtcgagctcgacctctccgcgctgccgggcggcgccgacgcgttcgagaaggcggcgcgctactgctacggcgccaacttcgagatcaccgcgcgcaacgccgccgcgctccgctgcgccgcggcgttcctcgacatgcagcacccggcggacctggcgcgccgcgtcgaggagttcctcgcgcaggccggcctccgcgcgctgcccagcgcggtcaccgtgctgcgctcctgcgaggcgctcctcccggccgccgaggagctcggcgtcgtgcggcgggccgcggacgccgtcgcgctcaggatctgcaacgaggcgctgttcccgaccaggacgccgccggggtggtggacggctgagctcgcggcgctctcgccggcgtcgttccagaaggtcgccacggcgctgcgctgccgccgcgcggaccccaaggtgcttgccaacgcggcgagcgcctacgcggagctcgcgctggccgaggtcctcgccgacccccgggacagggaggaccagcgcgcgcttctcgagtccgtcgtggacgtgctcccttcggccgccgacgcgcccatctctgcggcgttcctctgccgcctcctccacgccgcggtcaccaccgaggcctccgccaagacatgccgcgacctggagctccgcgtcgccgcggtgctggaccaggccaccgcgggggacctgctcggcgtcgcgctggacggcgccggagagcgcgtcaggaacacggacaccgtgcggcgcgtcatcgccgccttcgtcgagcggcatgcggggcggagtcggcgggcgtcgctgtcgtccggcggagcagagctcgatccgggcgcgatggagaaggtggccaggacggtggacgagctggcggcagagctcgcgacggaggagtcgctggcgatctccaagttcgttggcgtggcgggggcggtgcccaaggaggcgcgggcgtcgcacgactgcgtgtaccgggcggtggacatctacctgaagacgcacccggcgctggacgagatcgagcgggagaaggtgtgcagcgtcatggacccgctcaagctgtcgtaccaggcgcgcctccacgcgtcgcagaacaagcggctgccgctgcaggccgtgctcagcgcgctctactacgaccagctcaagctccgcagcgccgccgccggcgtggacgaagggtgggacacgcagacggccgccgggaaggcccgcgcgcaggcgagggcggacgcgtcgctggcgcgggagaacgaggcgctgcggtcggagctggcgcggatgcgggcgttcgtgtcggggatgcagcccagcaaggggagcgggtcgtcgagggcggcgccggcggggaagaaggcgagcttgctggggtcggtgtcgcggacgctgagccggctgaacccgttcaagggcgggtgggccaaggacacggcaagcatcgctgacagcagggacgccatgccgcatgtggtgaagcccaagaggaggaggttctccataagctaatcattagccatctcatgatcatgcatgttcgtttaggagtgtggcttgtagtttcgctattactactgtgtttgttttttatttaatttaatcttgtgatatatactatgtatagtatataattgtataacatgtcatgtgtgcttgcttcaagaaaagaaacacaatagtactacttttgagccagctggcatttattt

SEQ ID NO: 18362 - protein, 553 aa, Panicum virgatum
  misc_feature: Ceres CLONE 1796640
  misc_feature (165)..(411): Pfam Name: NPH3 Pfam Description: NPH3 family
MDRVTQWVSSQDVPADLTIRIADSIFPLHKAVMVPRCGYIRRAVAKDPSAAVELDLSALPGGADAFEKAARYCYGANFEITARNAAALRCAAAFLDMQHPADLARRVEEFLAQAGLRALPSAVTVLRSCEALLPAAEELGVVRRAADAVALRICNEALFPTRTPPGWWTAELAALSPASFQKVATALRCRRADPKVLANAASAYAELALAEVLADPRDREDQRALLESVVDVLPSAADAPISAAFLCRLLHAAVTTEASAKTCRDLELRVAAVLDQATAGDLLGVALDGAGERVRNTDTVRRVIAAFVERHAGRSRRASLSSGGAELDPGAMEKVARTVDELAAELATEESLAISKFVGVAGAVPKEARASHDCVYRAVDIYLKTHPALDEIEREKVCSVMDPLKLSYQARLHASQNKRLPLQAVLSALYYDQLKLRSAAAGVDEGWDTQTAAGKARAQARADASLARENEALRSELARMRAFVSGMQPSKGSGSSRAAPAGKKASLLGSVSRTLSRLNPFKGGWAKDTASIADSRDAMPHVVKPKRRRFSIS

SEQ ID NO: 18363 - DNA, 1373 bp, Panicum virgatum
  misc_feature: Ceres CLONE 1796653
  misc_feature: Encodes the peptide sequence at SEQ ID NO. 18364
atccgaaagccaaagcgagtctcaccagtcaaagaacgagttctagtagctttgctgatctgttctgctgtttttagtttggaaagcctttagttccggcgatcatggaggacgagaggaacacccagcaccaccaggtcggcgaggcccaggagaaggccgccgatcaggtggaggtgaaggacaggggcctcctggacactcttctcggcaggaagaagcccgaggaacaccaggaggaagagctggtgaccggcatggagaaggtcacggtggccgagcctcagaagcacggcgagcacaaggaggagcacgagaccggggagaagaaggagagcctcctcgccaagttgcaccgcaccagctccagctccagctcgtcgagcgacgaggaagaggaggtgatcgacgagaacggagagattgtcaagaggaagaagaagaagggcctcaaggagaagatcaaggagaagctacccggccacaaggaccacgccgagggcgaccaccacacggccgtgccggccccggcgcccgcgcccgtgggaacgcacgcttacaaggaggacgagcacaagccgtacgtgccggccccggctcccccgcccgcggtggagacgcacgtccaccaccacgaccacgccgtcgtcgtccagaaggtcgaggacgactccccaccggcgccggaggaggagaagaagggcctccttgacaagatcaaggagaagctccccggcggccacaagaagccggaggacgccgccgccgccgcgcccgctgtccacgcgccagcgccggcgccgcacgcagaggacgtgagcagcccggacggcaaggagaagaagggcctgctgggcaagatcatggacaagatacccggctacaagggctccggcgaggaggaccacaaggccgccgccggcgagcacaagaccagctcttcttaagatggcccgcgcgtcgtgaccttgatcggaagcgtttgtttgccgtgcgtttggttctgctttgctttattttgtttcaagatgggattgcgcggtcaaggtccggtgtgttgaggcccggccagtactggtagcgagagtattgctggcttgctgcttgtgttcgctctagttcgggctttagtttggttccgagtcggggactggaagttgttgggtttgttgaattattatcagcagttgcgtcggtattgtaattcggctgggctacctggggattatgccttaacatttatatctttggtttctgcctagcatatatattgttgtcccattgtgatccttatgtattatatctagaaacatgatgcctagttaccccattatcttatttcagtctagctcatgcgttggcatgctcactac

SEQ ID NO: 18364 - protein, 280 aa, Panicum virgatum
  misc_feature: Ceres CLONE 1796653
  misc_feature (37)..(275): Pfam Name: Dehydrin Pfam Description: Dehydrin
MEDERNTQHHQVGEAQEKAADQVEVKDRGLLDTLLGRKKPEEHQEEELVTGMEKVTVAEPQKHGEHKEEHETGEKKESLLAKLHRTSSSSSSSSDEEEEVIDENGEIVKRKKKKGLKEKIKEKLPGHKDHAEGDHHTAVPAPAPAPVGTHAYKEDEHKPYVPAPAPPPAVETHVHHHDHAVVVQKVEDDSPPAPEEEKKGLLDKIKEKLPGGHKKPEDAAAAAPAVHAPAPAPHAEDVSSPDGKEKKGLLGKIMDKIPGYKGSGEEDHKAAAGEHKTSSS

SEQ ID NO: 18365 - DNA, 727 bp, Panicum virgatum
  misc_feature: Ceres CLONE 1796661
  misc_feature: Encodes the peptide sequence at SEQ ID NO. 18366
atccttcgccaggccacaggcaccccgtgagctccgccgctcggcgcctgcctccctcgtccttcctcactgcaggagcaatggcgatggccgccatggcctccccgtcgtccatgaccatgatccccgcgcgccaccacggcgccgcgccatccccgtcaacctccggcgactcctcggtccgccgcctccgcgcgcagccgggccacgtccggcgcggccgcgggacgtccgtctcaacggccgcggcgcggcggcggccgttcgtcttcaccccgcgcgccgtgtccgactccaagagctctcagacctgcctcgaccccgacgccagcacgagtgttcttgggatcattcttggaggtggtgcggggaccagattgtaccccctgacaaagaagcgtgccaagcctgcagtgccattgggtgccaactacaggctgattgatatccctgtcagcaattgtctcaacagcaacatctcaaagatctatgtgctgacacagttcaactctgcttctctcaatcgtcacctctcaagagcctatggaagcaacattggaggttacaagaatgaaggatttgttgaagtgttggctgcccagcagagtccagataatccaaactggttccagggtacggcagatgctgtaaggcagtacttgtggctatatgaggagcataatgtgatggaatttctaattcttgctggtgatcacctgtaccggat

SEQ ID NO: 18366 - protein, 215 aa, Panicum virgatum
  misc_feature: Ceres CLONE 1796661
  misc_feature (88)..(215): Pfam Name: NTP_transferase Pfam Description: Nucleotidyl transferase
  misc_feature: SWISSPROT Homolog: EC 2.7.7.27 Glucose-1-phosphate adenylyltransferase
MAMAAMASPSSMTMIPARHHGAAPSPSTSGDSSVRRLRAQPGHVRRGRGTSVSTAAARRRPFVFTPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLYEEHNVMEFLILAGDHLYR

SEQ ID NO: 18367 - DNA, 1810 bp, Panicum virgatum
  misc_feature: Ceres CLONE 1796681
  misc_feature: Encodes the peptide sequence at SEQ ID NO. 18368
aagccaccatgcttccatccatcctggaaactgcagtgcccagggcgattagagcagagctacgcttcccactgcaaattgcagggcaaaagagcatctgaatccaatcaggccgtattcactttgctgaagaaagcatgattatactgggcggaaagcgtgttagcaaactgcctcccttgaggcttgagctataagtgtagcccaggagggagtgctcggattcccccttcttctccgctccaccagtctccatccctcgtcctaatcctgatagtttatgggtggtggctcttccgtctcgcccagccctgtcttgcagtcatctaccttcctcgcctatcccactccgctctaaccactgtactaaactagcagtaccggagctggactgcctctacttgtactgattgctttgtagctgcactgtgctgacattatatacctcttcttgctcgagccaattgccattgccacccaccacgccgagctgcattgcttcgaggacatgggaattgcaagaagtttcgtcgccgttcttgttctgatttgcatcttcctcagagaggggagggctgcgaccttcacgttcgtgaaccggtgcacggggacggtgtggccgggcatccagtcgaacgccgggagctcgaggctggacccgacgggcttcgtgctgccgccgggcacgtcccgcgcggtgccggcgccatcgggctggtccggccgcgtctgggcgcgcaccggctgcgcgcaggacggcaccgggaagatggtctgcgccacgggcgactgcggctcgggctccctggagtgcaacgggcagaacgcggcgacccccgcgacgctggccgagttcacgctcgccggcggcaacggcgacgacttctacgacgtgagcctcgtggacgggtacaacctgccgatcctgatcgagcccgcgggcggcgcgacgggcgcgacgacgtgcgcggcggccgggtgcacggcggacctgaacgcgcggtgccccgcggagctccgcaccgaaggcggcgccgggtgccgcagcgcctgcgacgccttcggcaagcccgagtactgctgcagcgacgcgtacgccaaccccaacacctgccgccccaccgcctactcgcaggtgttcaagtcggcgtgccccaagtcgtacagctacgcctacgacgaccccaccagcaccttcacctgcggcggcggccgcgactacaccgtcaccttctgccccgtcgccaccccgagcgtgaaatcgtcgggcgggcctggagcgacgacggcgccaccgacgctgccgggggcgggggcgacgccgcagatgccgaggcaaggcggcacggacgggcagggcgtgatgctgggcgacaattcctggctcgccagcctcgccacgggcgacgtgtcgtccgcgccgccgaggccggggctcgccctccggggctcgccgctcgcgccgctcctgctcctcggcctcctgctatagcagcagcggcacccaaccaaccgaacccaagcgaaacttttggtcaaaagaagcgggcgtcgcgcgcacgggcccccggagcaaagcgaggtggcgcggggggcgctcggctgccggccgccgccgtgccgatgccgacggcgagccgctcgacggaagaaggatggttggtctgtgcgtgcatgggggatgatatgatttgatttgaccaggatcgcgtcacgccatttgtaaaatccgccatccttttcttcttctttttgggtttgtgccgttgtgttgtgttcagggaaaaagaaagaaagaaaggaaatgtac

SEQ ID NO: 18368 - protein, 327 aa, Panicum virgatum
  misc_feature: Ceres CLONE 1796681
  misc_feature (30)..(244): Pfam Name: Thaumatin Pfam Description: Thaumatin family
MGIARSFVAVLVLICIFLREGRAATFTFVNRCTGTVWPGIQSNAGSSRLDPTGFVLPPGTSRAVPAPSGWSGRVWARTGCAQDGTGKMVCATGDCGSGSLECNGQNAATPATLAEFTLAGGNGDDFYDVSLVDGYNLPILIEPAGGATGATTCAAAGCTADLNARCPAELRTEGGAGCRSACDAFGKPEYCCSDAYANPNTCRPTAYSQVFKSACPKSYSYAYDDPTSTFTCGGGRDYTVTFCPVATPSVKSSGGPGATTAPPTLPGAGATPQMPRQGGTDGQGVMLGDNSWLASLATGDVSSAPPRPGLALRGSPLAPLLLLGLLL

SEQ ID NO: 18369 - DNA, 707 bp, Panicum virgatum
  misc_feature: Ceres CLONE 1796718
  misc_feature: Encodes the peptide sequence at SEQ ID NO. 18370
acaccctcactctccgtcgcaccctccctctcgcgcacgcgcccggcgcacaccgtaccatggccgcggcggcttcagcttcgctgctccgcctcgccaccccgatccgctccccgcgccccggcctccctcgccgccccgccgccgccctgccgcggggcgcgcgcctgggcctggcgccgccgcgggcgtacaaggtgacgatcgagcacggcggcgagtcccgcgtggtggaggtggaggcggacgagaccatcctgtcccgcgcgctggacgagggcctcgacgtgccgcacgactgcaagctcggcgtgtgcatgacgtgcccggcgcggctggtcgccggggaggtggaccagagcgacggcatgctcagcgacgacgtcgtcgcgcagggctacgcgctgctctgcgccgcgtacccgcgctccgactgcaccatccgcgtcatccccgaggacgagctgctccgggtgcagctcgccaccgccgacgactgatgacgccccgccgccggcgaccgggcaacaacctcacctccggctgtgtaataatgatgatctgagacttgtacacctctgtcgattagctctagtgacacaaactttttctgagaatggctattgtggtatgcctctttgccaaatttcttgtcagttctgtgtgagaagaattttgatgcaagtaggaaaatcgaccatttccct

SEQ ID NO: 18370 - protein, 146 aa, Panicum virgatum
  misc_feature: Ceres CLONE 1796718
  misc_feature (49)..(124): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MAAAASASLLRLATPIRSPRPGLPRRPAAALPRGARLGLAPPRAYKVTIEHGGESRVVEVEADETILSRALDEGLDVPHDCKLGVCMTCPARLVAGEVDQSDGMLSDDVVAQGYALLCAAYPRSDCTIRVIPEDELLRVQLATADD

SEQ ID NO: 18371 - DNA, 669 bp, Panicum virgatum
  misc_feature: Ceres CLONE 1796730-R
  misc_feature: Encodes the peptide sequence at SEQ ID NO. 18372
ggaccagtacaccacggcgcagacggtgcccggcgtcctggtgctgcgcatcgacgcgcccatctacttcaccaacgccagctacctgcgagagaggatcttgcggtggatcgacgaggaggaagagcgcacccagggcaagggcgagatgggcgtgcagtacgttgtccttgacatgggtgccgtcggtagcatcgacacgagcgggacaagcatgctggatgagctcaagaagaccttggaacgaaggggcatgcagatcgtgctggcgaaccctggcagcgagatgatgaagaagctggacagctccaaggtcctggagctgatcggccacgagtggatcttcccgacggtgggggaggccgtgtcgtcgtgcgactacgtgctgcactcgcacaagcccggcgtggtcatggacagtgcggcagcccacgagaacatggtctgaatctgaatggggaaggacgacggtgacacggtgtgtgcagatgtaatagttgagagtgagtctgacgacacgagttgtcaacaagcaagccgagatatgaatatggataccaacatcatatctcgagtattgtactggtgcattgccaaggaaaccacagaaatccaatcaaatccggcctctgcagatgcaaatatgcaacgcaggaggaattcgaacgc

SEQ ID NO: 18372 - protein, 148 aa, Panicum virgatum
  misc_feature: Ceres CLONE 1796730-R
  misc_feature (3)..(121): Pfam Name: STAS Pfam Description: STAS domain
DQYTTAQTVPGVLVLRIDAPIYFTNASYLRERILRWIDEEEERTQGKGEMGVQYVVLDMGAVGSIDTSGTSMLDELKKTLERRGMQIVLANPGSEMMKKLDSSKVLELIGHEWIFPTVGEAVSSCDYVLHSHKPGVVMDSAAAHENMV

SEQ ID NO: 18373 - DNA, 130 bp, Panicum virgatum
  misc_feature: Ceres CLONE 1796730
cccacccgcgcggcccccccgaccccgaccaccagccgccgcgccggagaccggagcagggccgacggggggggcgccggggcccgcgccccccgcccggccgcgacaggccgcgccccgggagcgcccc

SEQ ID NO: 18374 - DNA, 2659 bp, Panicum virgatum
  misc_feature: Ceres CLONE 1796741
  misc_feature: Encodes the peptide sequence at SEQ ID NO. 18375
atcaaaatccaggaacaatgtagctgctccactagaatccctgcgcggctgtgcgcatgtgcccaagctaaataaaagggagaaaaaaatatagtgaccgcgtcaactcttctccactgtcgccattattactgtgataaaagcaacaatactccgtctaaccgccgttcctctgctctcaaatccacacactcgtctccggtggagagaaacaggagcaaggcgcggctgaaaaaacccacgggaatttctctcgatttgttcgtgcaaatttcagcgtgctctaaaggaaaaatctcatctgctccaaaggcaaaggaaaaagcgagagagagagagagagagagagagagagagagagaagaggagaggggacggaggcgcaatgcggcagagatctcctgctgtgctgcagctgcggctgtggctgctggccgtctccgtgtggccggcttttcttggtgttcttgcggctgatcttagcaaagaaccatttaccatccgtataagctgtggaagttttgatgatgtccgaacgtcgcctacaaacacattgtggtacagagattttggttataccggaggcaggtttgcaaatgccactcgcccaagctttatcatccctccgctgaaaacgcttcgttatttcccactatctgatggccctgagaattgctacaacatcaacaacgttcccaatgggcactatcaagtcaggcttttctttagcttactggataatcctagtcttgacagcgagccaattttcaatgtttctgttgagggcaccctattcagttctttgcttttgggctggagcagtgatgatgaaaagacatttgcagaagctttggtttttgttcaggattctagattatcagtttgcttccacagcacaggtcatggtgatccatctattctttctattgaagttctccaaattgatgataattcctataacttcagcccttcatggggaaaggggacagtacttagaacagccaaaaggttgaaatgtggctctgggaagcctgcttttgatgaagatctgcatggtatcagctggggtggggacagattctggttaggattacaaactttatcatccagttctgatgatcagtctatatcaactgagaatgttatagcagagacattgcttgctccgaatttttaccctcaaagcctataccaatcagctattgtgggcactgataggcaaccgagcttgtcctttgaaatggatgttacaccaaacaagaactattctgtatggcttcactttgcagagattgataatggggtaactgcagaagagcaaagagtatttgatgtactcatcaatggagacactgcatttaaggatgttgatataatccggatgacaggagagcgttttactgcacttgttctgaataaaactgtcgctgtcagtgggacaacactaaaaatcatcttgcaacctgtgaaaggaacccgtgccattattagtgccattgaggtgtttgaggtaataccagctgaaaagaagaccttgcctcaagaagtgagtgcattgcgcacattgaagggttcacttggtcttcctcttcgatttggctggaatggtgacccctgtgttccacagcagcatccatggagtggagttgactgccagtttgacaacaccaaagggaattggattattgatggattaggtcttgacaaccaaggtttaagaggggttatacctggtgacatatctaagctgcaacatctgcaaagcataaacttgagcggcaatagcataaaggggaacattccaacctctattggtactatctctgcactgcaagtactggatctgtcatacaatgagcttaatggatctattccagatagccttggccatctgacatcgctgctgatactgaatctgaatggcaatcgtctgtcaggaagggttccagccaatttaggaggaaggcctctgcacagagctagatttaacttcaccgacaatgctggactgtgtggaattcctgggttaggagaatgtggccctcatctatccgtggctgcaaaaatcggcatggcttttggggtgcttttagctattctgtttctagttgtgtttgcagcgtgctggtggaaaagacggcagaacattctccgcgcccaaaaattagctgcagcaagggaagctccttacgcaaaatcaaggacccagttcacccgggatgtgcaaatgacaaagcatcagcgcctgtctgaaagctctcgaaacagcaacaatgaaagctcaccacatttgctttcctagctaggtgacagacagaaacactgcaccggtgacttggtttgggtccattcttctgttcttatgcttcctcgcaagtttgaaagacaattgtacatactagctaggtcatggatggtgtatatactagtatcttttttgcactccaaaacttagtccaggagaggtatcagatgagagaaattatccacttcatgttatttgctgttgcgacgactacaaatgttgaattctcctctattgttcaaccatgcttattgtcagttatgtactgatttgttggtccgaagttctgcagaaactgcttttataaagagaaaggcctctggtgggccaaacctgaattttcagtttttgtag

SEQ ID NO: 18375 - protein, 638 aa, Panicum virgatum
  misc_feature: Ceres CLONE 1796741
  misc_feature: SWISSPROT Homolog: EC 2.7.11.1 Non-specific serine/threonine protein kinase
MRQRSPAVLQLRLWLLAVSVWPAFLGVLAADLSKEPFTIRISCGSFDDVRTSPTNTLWYRDFGYTGGRFANATRPSFIIPPLKTLRYFPLSDGPENCYNINNVPNGHYQVRLFFSLLDNPSLDSEPIFNVSVEGTLFSSLLLGWSSDDEKTFAEALVFVQDSRLSVCFHSTGHGDPSILSIEVLQIDDNSYNFSPSWGKGTVLRTAKRLKCGSGKPAFDEDLHGISWGGDRFWLGLQTLSSSSDDQSISTENVIAETLLAPNFYPQSLYQSAIVGTDRQPSLSFEMDVTPNKNYSVWLHFAEIDNGVTAEEQRVFDVLINGDTAFKDVDIIRMTGERFTALVLNKTVAVSGTTLKIILQPVKGTRAIISAIEVFEVIPAEKKTLPQEVSALRTLKGSLGLPLRFGWNGDPCVPQQHPWSGVDCQFDNTKGNWIIDGLGLDNQGLRGVIPGDISKLQHLQSINLSGNSIKGNIPTSIGTISALQVLDLSYNELNGSIPDSLGHLTSLLILNLNGNRLSGRVPANLGGRPLHRARFNFTDNAGLCGIPGLGECGPHLSVAAKIGMAFGVLLAILFLVVFAACWWKRRQNILRAQKLAAAREAPYAKSRTQFTRDVQMTKHQRLSESSRNSNNESSPHLLS

SEQ ID NO: 18376 - DNA, 1841 bp, Panicum virgatum
  misc_feature: Ceres CLONE 1796748
  misc_feature: Encodes the peptide sequence at SEQ ID NO. 18377
acgcgcaccaccatcccccggcggattccctccttccgcggtggtggtggcctccggtggaggctggcgcgggcgagcgagcgagcgatggacgcggcggcgaagaagatgacgcggggcatctcgcggcagctctcgtcgggggcggcgcggctatggcgccagctgtcgctggacccgcacaccccgcggcgcggcgagccgggcgcgggggccgggccgacgcggttcgcgatcgcgaggcagtcgtcgctcgacccgacgccgcggggcgggccggaccggtcgtcggcgcaccagcagctcgcggtgccggagaacctggacgccacgatgcgcctgctcttcgcggcgtgccagggggacgccgccggggtggaggagctgctcaggggcggggtggacgtcgacagcatcgacctcgacggccgcacggcgctgcacatcgccgcctgcgagggccagggggaggtcgtgcggctgttgctcgactggaaggccaacatcaacgcccgcgaccgatggggaagcacgccagcagcagatgcgaaacattatggccactttgaagtatataaccttctgagagcaagaggagcaaaagttccgaaaaccaaaaagactccaatggccgtgtcaaatcctaaagaggttccagagtatgaactgaacccacttgaacttgagttccgaagaggggaggaggtcacaaagggtacctatctggcgaaatggtatggctcaaaagtgtttgttaagatacttgacaaagacagcttctcggatgcagatagcataaatgcattcaaacacgagcttaccttacttgaaaaagcacgacacccaaatttggtccaatttgtgggagctgtcacacaaaatgtaccaatgatgattgtttccgagtatcatcaaaagggtgatttagcaagttatcttgagatcaaaggtcgcctgaagtctcacaaagctataagatttgctcttgacattgcgaggggactgaattatctccacgagtacaaacctgagccaatcattcatggaaatttgtcaccaaaaaacattgtgcgggacgatgaaggacaacttaagttggccggttatggatcactgaatttgattaaagtctccgaagataaactacaaatggctcagccagtgacacaattagacaatatctacactgctccagagatctacaggcacgaaccatttgacagaagtgtagatgtatttgcattcggtctcattctttatgagatgatcgaaggaaatcatgctttccacccgaagtcacaagaggaagcagctaagatgatttgtttggagggactgagaccaccattcaagaataaacccaaaaactatcccagtgatgtgaaagagctgattcaagaatgctgggatctggtgccttccgtgaggccaaccttcgcggagataattgtgcggctgaataagatacacgcgagctgcgctaagcaggctcgttggagagacaccttcaaacttccatggaaacatgctggagatagatagctgtaaagacataaagttctgcgaggccgtccgccgtcgtcaaagatttcctcccttccgtttagcaaaagcaaatgtgagtaaactcgagtgagaaatcgcaccgagttacgaagtagaagtagttccttctcaggttctttacgctcccaaaaggagaatacagtttgtgtagcctgtatgactgtctaggcttatgcctccggcccaatttctcttgagctgtcttcatccaaactggaacaccccgaaaagtgtattatttttctgaacgttcaatacgtataccactttctttt

SEQ ID NO: 18377 - protein, 484 aa, Panicum virgatum
  misc_feature: Ceres CLONE 1796748
  misc_feature (201)..(457): Pfam Name: Pkinase Pfam Description: Protein kinase domain
  misc_feature (113)..(145): Pfam Name: Ank Pfam Description: Ankyrin repeat
  misc_feature: SWISSPROT Homolog: EC 2.7.10.2 Non-specific protein-tyrosine kinase
MDAAAKKMTRGISRQLSSGAARLWRQLSLDPHTPRRGEPGAGAGPTRFAIARQSSLDPTPRGGPDRSSAHQQLAVPENLDATMRLLFAACQGDAAGVEELLRGGVDVDSIDLDGRTALHIAACEGQGEVVRLLLDWKANINARDRWGSTPAADAKHYGHFEVYNLLRARGAKVPKTKKTPMAVSNPKEVPEYELNPLELEFRRGEEVTKGTYLAKWYGSKVFVKILDKDSFSDADSINAFKHELTLLEKARHPNLVQFVGAVTQNVPMMIVSEYHQKGDLASYLEIKGRLKSHKAIRFALDIARGLNYLHEYKPEPIIHGNLSPKNIVRDDEGQLKLAGYGSLNLIKVSEDKLQMAQPVTQLDNIYTAPEIYRHEPFDRSVDVFAFGLILYEMIEGNHAFHPKSQEEAAKMICLEGLRPPFKNKPKNYPSDVKELIQECWDLVPSVRPTFAEIIVRLNKIHASCAKQARWRDTFKLPWKHAGDR

SEQ ID NO: 18378 - DNA, 2052 bp, Panicum virgatum
  misc_feature: Ceres CLONE 1796749
  misc_feature: Encodes the peptide sequence at SEQ ID NO. 18379
gacatagggaaaaaaaatccggcggctctttcttttctccctcacgccttatctccctctccctctccctctctgtgtcttctttcctagctagcggcgacggcagacagggcgagtggcgccgcccttgcccagctcttcgtcgggcgcttggccggccgacaagggttgtgactggcacaatagattgtgattcacgggaggcgcattggcctcaatggctctaaccctcctccgagggatgaggacgccgatctcatttagatcaaatacaggcttattctttaccgttcgacatcggttggcccgcttcacgaccagggcggagagtgcgcaggcaaccgaggccaaagcagcagccaaatcaattcagctggcgaccaaggaggcggcagagcagaagacacaagggtttgaagcgatcattggaattgagacccatgtccaactctcgaccgtcacaaaagcattttgttcttgcccgtacaactacgggtcccagcccaataccactatctgccccacctgcatgggccacccagggacactgccagttctgaatgagaaggtcgttgagtgtgctgtgaagttgggccttgctctcaactgtgagatctcgatgacatccaagtttgatcggaagcagtatttctacccggacctccccaaggggtaccagatttcccagtttgacattcccattgccaagaagggctatgttgatttggatcttccagtggaatttggtggtgggcacaggaagtttgggatcacaagggttcacatggaagaagatgctggcaaactgcttcattccgaatccggcagttactcacaggttgacctaaacagggctggtgtacctttgcttgaaattgtctcggagccagacatgagaacagggatagaggctgctgaatatggtgctgaactgcaaaggatcgttaggtatctgggagtgagtaatggtaacatgcaggaaggttcccttcgttgtgatgtgaatgtttctgtccgacctgttggacaatcagaatttggtacaaaggtaaaaataaagaatatgaactcattttctgagatcaatagggcaatcgattatgagatatcccgacaaattctgctccataaagaaggtcaggctgatcaaattgtgcaagaaacccgtctatgggatgaatcttctcagaaaacttttacaatgcgaaaaaaggagggacttgctgactacagatattttcctgagcctgatcttcctgaagttgttctcactactgactatattgatgaaatcagcaagtccttgccagagcttccagaagcaaaacgtaggcggtatgagaatatgggacttagcatgcaagatgttttgttccttgctaatgacgacaatgttgctcatttctttgattctactcttgagcatggtgctgatgcaaagttggcttgtaactggatcatgggtgacattgctgcttatctaaaaaatgaaaagctgtccattgatgaaactaaattaacacctctggagctttctgaacttatcgcatccatcaagaacggaactatcagtgggaagattggcaaggagatactggttgaactcatttccaaaggtggcaccgttaagggtgtgatagaggagaaagatttggttcagatagcagatccagcagaaatcgaggcaatggtagataaagtaattgctgagaatccaaagcaacttgagcagtaccgtgctgggaaaactaagttgcaaggattttttgcaggccaggtgatgaaagcatcgaagggtaaggccaaccctgttttgttgaataaaatccttggagagaagttaaatgccaattagttcttactgtccctcacattgattaatgagcacaacattgggtgaaatctcagaattatttgccggttaggctaggaaatcccttggttggtctggaaattgttctctctattaaattcagagtgtgattagctgtttcgtttccttgtggatattgtagaagtccagttcgcaatacgcatatttgtacttgactc

SEQ ID NO: 18379 - protein, 537 aa, Panicum virgatum
  misc_feature: Ceres CLONE 1796749
  misc_feature (56)..(299): Pfam Name: GatB_N Pfam Description: PET112 family, N terminal region
  misc_feature (387)..(534): Pfam Name: GatB_Yqey Pfam Description: GatB/Yqey domain
  misc_feature (318)..(385): Pfam Name: GatB Pfam Description: PET112 family, C terminal region
  misc_feature: SWISSPROT Homolog: EC 6.1.1.18 Glutamine--tRNA ligase
MRTPISFRSNTGLFFTVRHRLARFTTRAESAQATEAKAAAKSIQLATKEAAEQKTQGFEAIIGIETHVQLSTVTKAFCSCPYNYGSQPNTTICPTCMGHPGTLPVLNEKVVECAVKLGLALNCEISMTSKFDRKQYFYPDLPKGYQISQFDIPIAKKGYVDLDLPVEFGGGHRKFGITRVHMEEDAGKLLHSESGSYSQVDLNRAGVPLLEIVSEPDMRTGIEAAEYGAELQRIVRYLGVSNGNMQEGSLRCDVNVSVRPVGQSEFGTKVKIKNMNSFSEINRAIDYEISRQILLHKEGQADQIVQETRLWDESSQKTFTMRKKEGLADYRYFPEPDLPEVVLTTDYIDEISKSLPELPEAKRRRYENMGLSMQDVLFLANDDNVAHFFDSTLEHGADAKLACNWIMGDIAAYLKNEKLSIDETKLTPLELSELIASIKNGTISGKIGKEILVELISKGGTVKGVIEEKDLVQIADPAEIEAMVDKVIAENPKQLEQYRAGKTKLQGFFAGQVMKASKGKANPVLLNKILGEKLNAN

SEQ ID NO: 18380 - DNA, 1883 bp, Panicum virgatum
  misc_feature: Ceres CLONE 1796752
  misc_feature: Encodes the peptide sequence at SEQ ID NO. 18381
gtgctgctccaaagccaaagccgtcctcgctccaccagtctcaagcggcgcctccgcctcccccgtcgcagccccccatgtcgcaggcggcgcagtgcccctactgccgcgcgtcggggccggcgcggtgcgcgacgacgcagccgccgctctcgcgcgccgtctccgagtgctccgcctgcgcccgcatcgtcctcgagcgccacctccacacgcaccccttcttccccctcctcccctccctccacccgctccccctcgtcacccccgacctcgccaccgccgtcgagcccgccccctccccttctcccggcggcgaagatgacgaggaccccttcctccccgcgggcttcgtctccgccttctcggccttctccctcgagcgccaccccgtcctcgcccgctccgcctccgccttctctggccaactcgccgagctcgagcgcgcgctcgccggcgactccgccgccgcggcctccaacccggaccccgccggtcccatggtctccgtcgacagtctccgcgcctatctccagatcgtcgacgtcgcctccatactcaggctcgagcgggacatagccgaccacgccttcgacctctacaaggattgttcctccgcgacctgcctcaggaaccggagcatcgaggcgctcgcgaccgcggcgctcgtgcaggccatccgcgaggcgcagcagccccggacgctgcaggaaatctctactgctagcaatcttcctcagaaagagataggaaaatacatcaaaatactcggcgaatctctgaaactgagccaacctcttaacagcaactcaattgctgttcatatgcctcggttttgcagcttgctccagctcaataagtctgctcaggaacttgcagctcatatcggtgaggtggttgttaataaatgcttctgcacaaggcgcaatccaataagcatatctgctgctgcgatataccttgcatgtcagctcgaagacaagcgcaaaacccaggctgaaatctgtaaagtaacgggccttacagaggtcactctacgcaaagtgtacaaagaactcctggagaactgggatgatttgctcccccctgactatacaccagccacaccaccagagaaagcttttccaatgaccactatttactcagtgcgctcgtcaagtggcaaggatctgtatcaggataagatatttgatagtagtaagcagaaaggtcctgaacctgcagagcctgatcacatggtcattgtgaaagaagaggaagaaaagaaaatcagtgctcttggtcgaccgcctgcaaaacttgagcctcatgagttgagcaaggcattctgtccatcgaatgccccattctcaacatctccaaaatctgatcgtgacaagacagaaactagtgtccgtgggttcaaccttaatgaggtatcatgtgcaatggattctgatagagcagataccacagtgaaaccaaattttggcgatcgatcattgaatgaatcaaatatgcttccatccccgaataggcagcctttaccatggcagcttaagcagggcgtgcctgcagctggtccatcatattataggcttcgtgagcagcacattggccttgaccttgtagctgctttgaaggggattggaaaaaggagtgctggggatggtggtgatggccgagataaggaagggaagtgaataactattcagttaatcgaaaatgaaattaatggtaatggtccattgtaaatatagatgttatttgtagtagagttaagttcgacttcccttgtcattctaatgtctgtggagaaatgttactccagactttgtagcttcggtgctgaaaatttccaccagtacttacaaattatttatagcctgatctgacttaatccg

SEQ ID NO: 18381 - protein, 534 aa, Panicum virgatum
  misc_feature: Ceres CLONE 1796752
  misc_feature (250)..(320): Pfam Name: TFIIB Pfam Description: Transcription factor TFIIB repeat
  misc_feature (154)..(224): Pfam Name: TFIIB Pfam Description: Transcription factor TFIIB repeat
MSQAAQCPYCRASGPARCATTQPPLSRAVSECSACARIVLERHLHTHPFFPLLPSLHPLPLVTPDLATAVEPAPSPSPGGEDDEDPFLPAGFVSAFSAFSLERHPVLARSASAFSGQLAELERALAGDSAAAASNPDPAGPMVSVDSLRAYLQIVDVASILRLERDIADHAFDLYKDCSSATCLRNRSIEALATAALVQAIREAQQPRTLQEISTASNLPQKEIGKYIKILGESLKLSQPLNSNSIAVHMPRFCSLLQLNKSAQELAAHIGEVVVNKCFCTRRNPISISAAAIYLACQLEDKRKTQAEICKVTGLTEVTLRKVYKELLENWDDLLPPDYTPATPPEKAFPMTTIYSVRSSSGKDLYQDKIFDSSKQKGPEPAEPDHMVIVKEEEEKKISALGRPPAKLEPHELSKAFCPSNAPFSTSPKSDRDKTETSVRGFNLNEVSCAMDSDRADTTVKPNFGDRSLNESNMLPSPNRQPLPWQLKQGVPAAGPSYYRLREQHIGLDLVAALKGIGKRSAGDGGDGRDKEGK

SEQ ID NO: 18382 - DNA, 683 bp, Panicum virgatum
  misc_feature: Ceres CLONE 1796765
  misc_feature: Encodes the peptide sequence at SEQ ID NO. 18383
acgaagagcagcggcagcagcagacacctccgccaccctcgaatcgtccccaaccatggcgtcgcaggtcgcctccatcttcgctggcatcgcgcaggccccggaggaccccatcctgggggtgacggttgcgttcaacaaggatcccagccccctgaaggtcaacctcggcgtcggcgcctaccggaccgaggaagggaagcccctcgtgctgaatgtggtccggcgcgccgagcagatgctgatcaatgacccgtctcgatttaaggagtacctaccaatcactggtttggctgaatacaataagttgagcgctaagcttatctttggtgctgacaggtattgttctgtgggacttatctatccatttcctcccgttgatgattttttatgggtcaactgctcccatttgtgatatttatgtgtcgtactagcaactgtcaattcttagtgttgaagtctaactacataaaatatctacctacttggctacctgttgtgtttatctctgttttaggacacttcagaaaactgatgttttttccccccgcaaaaatgggacagccctgctattcaggagaatagggttgttacagtgcagtgcctatcaggaactggttctttaagagtgggaggtgaatttctttgcaggcactaccatgagcgcactatctacattccag

SEQ ID NO: 18383 - protein, 119 aa, Panicum virgatum
  misc_feature: Ceres CLONE 1796765
  misc_feature: SWISSPROT Homolog: EC 2.6.1.1 Aspartate transaminase
  misc_feature: Functional homolog of the protein sequence given in SEQ ID NO 50448
  misc_feature: Useful for making plants with modulated nitrogen use efficiency
MASQVASIFAGIAQAPEDPILGVTVAFNKDPSPLKVNLGVGAYRTEEGKPLVLNVVRRAEQMLINDPSRFKEYLPITGLAEYNKLSAKLIFGADRYCSVGLIYPFPPVDDFLWVNCSHL

SEQ ID NO: 18384 - DNA, 2402 bp, Panicum virgatum
  misc_feature: Ceres CLONE 1796767
  misc_feature: Encodes the peptide sequence at SEQ ID NO. 18385
atacagccactgcacagcgcataatcccccaccttttttttcttcttctttttctcccggaagcctcccagcccgggccgtccctccaaaaggctgcggcaccgagcaccaacccgagcagcgccagcgccagcgcgagcgagcggcctaacgaatggcggcgcgccccaccaccgcggcgggaggcgggggcgggggggacgaggaggtgtcggaggcgggcgcgtccccggagctgcggcaccgccacgcgggcaagggcgcgggcgaggccgggggcggcgaggggccggcgggcggcaatggcgccgacgcggcgtcggtggagcgggtgttcgcggacaagggggtaccgtcgtggcgggagcagctcacgctgcgggcgttcgtcgtctccgcgctgctcgccgtcatgttctgcgtcatcgtcatgaagctcaacctcaccacggggatcatcccctcgctcaacgtctccgcggggctgctcggcttcttcttcgtccgcatgtggaccgccgccgccggccggatgggcttcctccgccagcccttcacgcgccaggagaacaccgtcatccagacctgcgtcgtttccgcctacggcatcgcgttcagcggtggcttcggtagttatctatttgggatgagtgataaaatagccagacaagcaacagaggctaaagatgctaataatataaaggatccacaccttggctggatgatagggttcttattcctcgtcagtttcattgggctattggcacttgtgcccctaagaaaaattatgattgttgactacaagctgacctatccaagcggcacagccactgcatatctcatcaatggttttcatacacctgagggtgccaaacttgcaaagaagcaagtaaagacactgggcaagtacttcgtgtttagctttttctggggcttttttcagtggttctacaccgcaggggatgactgtggattcaaaaatttcccaacattgggtcttgaagcttataaacacaggttcttctttgacttctctcctacatatgttggagttggcatgatctgcccatacattgtgaatgtgtctgttctgctaggcggtatcctctcatggggtgtaatgtggcctctcattgccaagaagaaggggagttggtacccagctgacgccggagactcaagtctacatggactgcaggcttacagggtttttatttccattgctttgattcttggggatggtttatacaacttcattaaggtgctgctccgcactattgcgagcttcataacaatggttcagcaaaattcaaaaagcatgcttcccgtttcagacattggcagctcaatgtccactactgaagatgtatccttcgacgaagaacggcgcactgagctttttctgaaagatcaaattcccaagtcagttgcatatggaggctatatcgcagttgctgctatatcgattggcactcttcctcagatcttcccgcagctcaagtggtactacattttggttgcctatgtggtggcgcctgtgctggccttctgcaacgcctacggaagtggcctcactgactggtctctcgcctccacctacggcaagctcgccatcttcgtgttcggcgcttgggccggcctcgctcacggtggtgtactcgtcgggctcgccgcgtgtggcgtcatgatgagcatcgtgtccacggcctcagacctgatgcaggacttcaagaccgggtacctgacgctcgcgtcgccgaggtctatgttcatcagccagatgatcggaaccgggatggggtgcgtcatcgcgccctgtgtcttctggctgttctacaaggctttcggcgacatcggcgagagcggcaccgagtacccggcgccctacgccatagtgtaccgcaacatggccatcctcggtgtggatggcttcggctcgctgccgaagaactgcctcaccctctgctacatcttcttcgcggtggcgatcgccatcaacctggtgagggacctggccccgcacagggtgtcgaggttcatcccgctgccgatggcgatggctatccccttctacatcgggccctacttcgccatcgacatgttcctgggcagcacgatcctcttcgtgtgatcgcggctgaacaaggcaaaggcggacgcattcgggcccgcggtagcctcgggactgatctgcggggacgggatctggaccctgccgcagtccattctggctctggctaaggtgaatcccccaatttgcatgaagtttttgtcgagagcaaccaatgccaaggtggacagcttcctcgggttgtcgtgattttagggagagcaacggcaagcagcacgcctcgtcctgtaattatcggcacaaaatgtattcccgcactgcttttttgtag

SEQ ID NO: 18385 - protein, 658 aa, Panicum virgatum
  misc_feature: Ceres CLONE 1796767
  misc_feature (72)..(658): Pfam Name: OPT Pfam Description: OPT oligopeptide transporter protein
  misc_feature: The sequence is a functional homolog of SEQ ID NO 214 in the 10/412,699 US patent application
  misc_feature: The sequence is a functional homolog of SEQ ID NO 774 in the 10/412,699 US patent application
MAARPTTAAGGGGGGDEEVSEAGASPELRHRHAGKGAGEAGGGEGPAGGNGADAASVERVFADKGVPSWREQLTLRAFVVSALLAVMFCVIVMKLNLTTGIIPSLNVSAGLLGFFFVRMWTAAAGRMGFLRQPFTRQENTVIQTCVVSAYGIAFSGGFGSYLFGMSDKIARQATEAKDANNIKDPHLGWMIGFLFLVSFIGLLALVPLRKIMIVDYKLTYPSGTATAYLINGFHTPEGAKLAKKQVKTLGKYFVFSFFWGFFQWFYTAGDDCGFKNFPTLGLEAYKHRFFFDFSPTYVGVGMICPYIVNVSVLLGGILSWGVMWPLIAKKKGSWYPADAGDSSLHGLQAYRVFISIALILGDGLYNFIKVLLRTIASFITMVQQNSKSMLPVSDIGSSMSTTEDVSFDEERRTELFLKDQIPKSVAYGGYIAVAAISIGTLPQIFPQLKWYYILVAYVVAPVLAFCNAYGSGLTDWSLASTYGKLAIFVFGAWAGLAHGGVLVGLAACGVMMSIVSTASDLMQDFKTGYLTLASPRSMFISQMIGTGMGCVIAPCVFWLFYKAFGDIGESGTEYPAPYAIVYRNMAILGVDGFGSLPKNCLTLCYIFFAVAIAINLVRDLAPHRVSRFIPLPMAMAIPFYIGPYFAIDMFLGSTILFV

SEQ ID NO: 18386 - DNA, 2403 bp, Panicum virgatum
  misc_feature: Ceres CLONE 1796776
  misc_feature: Encodes the peptide sequence at SEQ ID NO. 18387
ctgagttctgtcgcctccatgcggtcccctgagccgagcctcccggcgccggcgcggctcgtcgtgatcgcgctcctcctcgcggctctcaccgggggcgccgtcggcgtcgatgggtacgggcgcgcgaggaggctgcacatgaagaacaaggtcctggagatgttttatcatgcttatgacaactacatgacttatgcattccctcatgatgaattgaagcctcttactaaaagtttcacggactcactcagtgagcttggcaacctaaatcttgagcacttgccacaggattataacggatcagcattgacacttgtcgagtctttatcaagtcttgttgtcttaggtaacttcacagagtttgagagaggaattctctggctttcagaaaacctgacatttgatgttgatgctcggattaatctttttgagtgtaacataagacttcttggggggcttatttctgctcatcttcttgcaaaagacttcagcagacagctgaaagatggactatatcacgatcaattacttcatcttgctgaaagtttaggcaatcgtttcttaccagcatttgagactcctactggattgccatatgcatagattaatcttaagtatggagtaatggagaatgagacaactgaaacaagcacatcagggtgtggctcacttatacttgaaatgggtgtattgtcacggttgaccggcgattccagatatgaagctgcagctcttcgtgctctccgcaagttatggagcatgagaagctcactgaatctagtaggcacaacacttgatgttttaactggcaagtggattgaatattcatcgggaattggtgccggtgttgactcattttatgagtatcttgttaaagcgtacattcttttcggaagtgatgagtactgggatatgtttcattcagcttaccttgcggtgcagaagtacttccgacatggtccatggtaccatgaggctgatatgaggacaggagaagcaacgcattggcaactaactagccttcaggccttctggcctggtcttcagacacttctgggagacgttgctgctgcaaatctgtcgcaccgcgaattttacaatatatggcaaaggtttggtatgttacctgaaagatatcttttggactatggaatattgcatcctacagagaagtactatcccttgcgtcctgagtttgctgagtctacattttatctttatcaagctactaaagatccttggtacctagaagtgggtgaaactattattggatctcttaattactataccaaagtggatggaggttttgctagcgtcagagatgtttcaacaatgaaacttgaagatcatcaacacagcttctttctttcagaaacatgcaaatatcttttccttctgtatgatgattcattcttgaggaatcaaaattatatatttacaacagagggacaccccctcccgataagaagcacatggcatgagaaatttccggcaacacattttcccaggaactggacatttgttaaggatgagacacaaccaattcgcgtgagtgccctatcgtcccaagtttgtccagagacagttttccaaaaaagcgttggatccccatgggagagtgcgtgccatgtaccagatgtgcacgctagccacatatgcaggactgatgacgactgtggcatagaagcagtaacatgcaagaagagaacctgtagtatggctggctactgcggcttatggctggtgataaattagcatcttcagagctggaggatatacctgttggtgtatatgtgagcccatatataagatctatatatcccacccttctaggatttggaggaatacaaggcaattattctctccaatatgatatcattagcctagcctctctcttcctctccctctcccctgccggctccatggctggccggccgccggcgccgccgcctccacctctctcctccttcccacccccttcctctgctccaggcgcaccatggcgccgggtcctctgctcccggcggcgcgtcctcctctgcgcagggtgtctggccgccggcgccatggcccgccgccccttgggcgcccgccgccgctgcggccgccctcgccgtcgtggagcctctgcacggtgcgccccatagggtttggaggaatacaagacaattattctctccaataataccgttttgccattacgggaggatgaagatatggcaggaagatttgaaatataacgttaattaacaaatggcctgtgcatagcgtagtgggataccatgctagcaaatttgctgcgtctgaattgttgatcaattttgattttagtgtttttgaccactaaatgcaagctgatgaaagactgaaagtgtctttgatacaattccaatttgattc

SEQ ID NO: 18387 - protein, 195 aa, Panicum virgatum
  misc_feature: Ceres CLONE 1796776
  misc_feature: SWISSPROT Homolog: EC 3.2.1.113 Mannosyl-oligosaccharide 1,2-alpha-mannosidase
MRSPEPSLPAPARLVVIALLLAALTGGAVGVDGYGRARRLHMKNKVLEMFYHAYDNYMTYAFPHDELKPLTKSFTDSLSELGNLNLEHLPQDYNGSALTLVESLSSLVVLGNFTEFERGILWLSENLTFDVDARINLFECNIRLLGGLISAHLLAKDFSRQLKDGLYHDQLLHLAESLGNRFLPAFETPTGLPYA

SEQ ID NO: 18388 - DNA, 1403 bp, Panicum virgatum
  misc_feature: Ceres CLONE 1796777
  misc_feature: Encodes the peptide sequence at SEQ ID NO. 18389
accacaacccaactccctctccctccccccgccggtcacgcccactcgctccttcctcgtcgagcgacgcattctagctaccagcgtctaacgggctgcgcacggcgaggtccatggagagcgctgacggcagcaatggggccggcggcggcggcctggtggtgacggagctgagccacatcaaggagctggtgcggcagctggaggtgcacctcggcggcggctcgtcgcacgagctctgcaggcacctcaccacgcagatcttctccatcaccgagcgctccatcggcatcatcaccgcctcctccggcctcgacgccgccggcgcccggaagcgggccgccgggctcgcctcgcccctcccggccacgcccaccagcgacgttgccgacgggcctttcaggagcaccaagaagaggaaggtgatggagaagaggaagcaccaggtgcgggtgagctcgcccggcggaggcgccggcgagaacccggtggacgacggccacagctggaggaagtacggccagaaggagattcttggagccaagcacccaaggggctactaccgctgcacgcaccgccactcccagggatgcttggcgacgaagcaggtgcagcgcaccgacgaggacccggcgctcgccgacgtcatctaccacggcggccacacctgcgtccagaggccggcggcggcaggccagggccagccgccggagcacaacccggatgcgagcagcttcctgcagagtctcaccgcgggcctctcggtgaagaccgaggggctgccggccctggccgcggaccagcagggctggagcgccaccgcgccgttctacttctcctcctcgacgccggcgagcgtgcgcccggcgacggcagagcgcagcccgttctccgcgccgtcgacgtcggagaactggggcgtgtcgccggcgacctcggactcgaaccacgtcgcgccctacctgccgttcgaggacgccgagtggcggggccggaacgagctccaggaggtggtgtccgcgctcgtggccgccagcgcgccgccggcgcccgccgtggacggcctcgacgagctcctcgacattgacatcgcaagcttcttcgcgtgatccgcgcgcgcagaggatcgtagctgatgaagaatagggagggaatcgaagcagctgatgtgatgtgaccgcccctctgggctctgggcgttcgtccaggaacagaggagggaagagcacgagagctctgcttcctgggtccatgccggcgtcaaccgtaggagatgagagtaatggttgctttttttttaaccaacttttttgttggttttttccttcttctgagagtgctgtgttgcattgtattattattttttgtgtcaaggaaaaaaataaagatccttcgatgtttcg

SEQ ID NO: 18389 - protein, 331 aa, Panicum virgatum
  misc_feature: Ceres CLONE 1796777
  misc_feature (126)..(188): Pfam Name: WRKY Pfam Description: WRKY DNA -binding domain
MESADGSNGAGGGGLVVTELSHIKELVRQLEVHLGGGSSHELCRHLTTQIFSITERSIGIITASSGLDAAGARKRAAGLASPLPATPTSDVADGPFRSTKKRKVMEKRKHQVRVSSPGGGAGENPVDDGHSWRKYGQKEILGAKHPRGYYRCTHRHSQGCLATKQVQRTDEDPALADVIYHGGHTCVQRPAAAGQGQPPEHNPDASSFLQSLTAGLSVKTEGLPALAADQQGWSATAPFYFSSSTPASVRPATAERSPFSAPSTSENWGVSPATSDSNHVAPYLPFEDAEWRGRNELQEVVSALVAASAPPAPAVDGLDELLDIDIASFFA

SEQ ID NO: 18390 - DNA, 2413 bp, Panicum virgatum
  misc_feature: Ceres CLONE 1796779
  misc_feature: Encodes the peptide sequence at SEQ ID NO. 18391
cctcgttgagagagtcgtcccccccgcgtgctcccgcctgcggcctctgtatcccgcaaccaaaaactaccaaaaaaaatttagaaatccccaaatccgcgagatctatcagtatcgagcgacttaccaatccgattgctagagtttagatccgattttttttcgaaaaaaaactgaaaaaaatttggtcgaggggaggaggaggaggcgatggcggcgcaagtggcggcggcggcggcggcggcgaacgggagcgcgggcgctatccccgcggtggtgtcgccgggagcggtcggcgtggcgcagccgctcccgaccacgtcgctctacgtcggcgacctggaggggtccgtctcggactcgcagctgtacgagctcttcagccaggcggggcaggtggtgtcggtgcgcgtctgcaaggacgtcacctcgcgccgctcgctcggatacgcctacgtcaacttcagcaaccccgtagatgctgcaagagcattggaagtgttgaactttgctctgcttaacaacaagcctatccgggtgatgtattcaaaccgtgacccaagcagccgcaggagtggatctgctaacattttcatcaagaatcttgacaaggcaatagacaataaaactcttcatgagaccttttccacatttggtaccattctctcatgtaaggtagccatggatgaagtgagccaatccaaaggctttggttttgttcagtatgaaaaagaagaaaaagctcaggcagctataaaaagtcttaacggaatgcttatcaatgacaagcctgtttttgttggaccttttcttcgcaagcaagagagagatcattcgtttgacaagacaaaatttaacaatgtctttgtgaaaaatttgtctgagtctaccacaaaggaggatctagtcaaaatttttggtgaatatgggaatattacaagtgctgttgtgatgattggtatggatggcaaatcaaggtgctttggtttcatcaattttgagaatccagatgctgctgcctgtgctgttcaggaacttaatggaaagaagattaatgacaaagagtggtatgttggaagagctcagaagaagtcagaaagagagatggaactaaaaaggagatttgaacaaagcttgaaagatgctgctgacaaatatcaaggactgaacttgtacctcaagaacttggatgatagcatcggagatgaccaactttgtgaattgttctctaactttggcaaaattacctcgtgcaaggtgatgcgtgaccaaaatggtcttagcaaaggctctggctttgttgcgttctcaactcgtgaggaagcatctcaggctttgactgaaatgaatggcaaaatgatatctggaaagccactgtatgttgcatttgcacagcgcaaagaagatagaaaagcaatgttacaggcacagttttctcagatgcgccctcctgtaccaatgacacccactatggctccacgccttccaatgtaccctcctatgcctcctcagcaactcttctatggacaagctcctccagctatgataccccctcagccaggatttggtttccagcagcagcttgttccagggatgagacctgggggtccccatatgccaaattattttgttccggttgtccaacagggtcaacagggcccacacccaggtattagacgtggagctggggcccagggccagcaacctgtgcagtcatttcagcaacagatgcttcctcgaggacggatgtaccgttacccaaccggccgcaacatgcctgaagctccagcaattccaggagttgctggtggtatgattcagccatatgatatgggaggcttccctgtgagagatacagccttatcacctgctgcccaaattggtactctgacatctgcccttgcaaatgctactcctgagcagcaaagaacgatacttggtgaaaacctatacccactggtttagcaactggaaccaaaccaagcggccaaggtcaccggaatgcttttggagatggatcagacagaggttctccacctgctcgagtcccctgaggctctcaagtccaaggttgctgaggcgatggacgttctccgcaatgtagcccatcagcagaatccaaacaccccgaccagtcagcttgctgcgttatcactgaccgaaggcattatctcctaacttgaaagtcataacaaacgatcttcagtttgcaattgcgtgtgatttttccagaggttatccggcacatgacagtattgctccttttttttcttcctatgggtggacttgtgtgagcagtgagtcttttccatactggatgttaggtattattttgtgctgtctggtgtcctgaccgttaaggcaaagtacttgtttccaagtttgagtgctatttgggggccgtggttacatt

SEQ ID NO: 18391 - protein, 584 aa, Panicum virgatum
  misc_feature: Ceres CLONE 1796779
  misc_feature (218)..(288): Pfam Name: RRM_1 Pfam Description: RNA recognition motif. (a.k.a. RRM, RBD, or RNP domain)
  misc_feature (321)..(391): Pfam Name: RRM_1 Pfam Description: RNA recognition motif. (a.k.a. RRM, RBD, or RNP domain)
  misc_feature (127)..(197): Pfam Name: RRM_1 Pfam Description: RNA recognition motif. (a.k.a. RRM, RBD, or RNP domain)
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQVAAAAAAANGSAGAIPAVVSPGAVGVAQPLPTTSLYVGDLEGSVSDSQLYELFSQAGQVVSVRVCKDVTSRRSLGYAYVNFSNPVDAARALEVLNFALLNNKPIRVMYSNRDPSSRRSGSANIFIKNLDKAIDNKTLHETFSTFGTILSCKVAMDEVSQSKGFGFVQYEKEEKAQAAIKSLNGMLINDKPVFVGPFLRKQERDHSFDKTKFNNVFVKNLSESTTKEDLVKIFGEYGNITSAVVMIGMDGKSRCFGFINFENPDAAACAVQELNGKKINDKEWYVGRAQKKSEREMELKRRFEQSLKDAADKYQGLNLYLKNLDDSIGDDQLCELFSNFGKITSCKVMRDQNGLSKGSGFVAFSTREEASQALTEMNGKMISGKPLYVAFAQRKEDRKAMLQAQFSQMRPPVPMTPTMAPRLPMYPPMPPQQLFYGQAPPAMIPPQPGFGFQQQLVPGMRPGGPHMPNYFVPVVQQGQQGPHPGIRRGAGAQGQQPVQSFQQQMLPRGRMYRYPTGRNMPEAPAIPGVAGGMIQPYDMGGFPVRDTALSPAAQIGTLTSALANATPEQQRTILGENLYPLV

SEQ ID NO: 18392 - DNA, 1586 bp, Panicum virgatum
  misc_feature: Ceres CLONE 1796800
  misc_feature: Encodes the peptide sequence at SEQ ID NO. 18393
cctgcatcgtctccgtctccgtccattgttcatctcgatgctagctagatctctaatcctgaactcctaataaacaaatgtatacctgcagatttctacaactggaaccgagtgaagattcgctactgcgacggtggatctttcgcaggcgatgcatacaacaaggaggctgggatttatttccggggtcagcgcatctggaacgctgtcatcaagcacctcctctccattgggatggcctctgcagatcaggtgctgctcaccggctgctcctccggtgggctggcggtgatactgcactgcgaccagctccgcgccttcttcccgcccgccgccggcggccggcaaaccaccgtcaagtgcctctccgacggcggcctctacctcgacgccgtggacatctccggaggccgcagcttgaggtcctacttcggcgacatcgtggccttgcaggggatacctcagagcctgccgggggcttgcaccgcccgtctagatgccacctcgtgcttcttcccccaaaatataatcaacgacatgaagactccgatgttcatcctaaatgcagcatacgacgtcattcagatatcgctgagcctatccccggacagagctgatcccagcggctcttggcgagcctgcaagtccaaccgttcagcttgcgacgcatcccagatgaacttcctgcaaggtttcagggaccagatggtgtcatctgtgcagggcttctcccaatccaggagcaacgggttgttcataagctcctgctttgcccactgccagtcagagcagctgggcacctggaacaatgttccaggtcgctcccccaccattcaaaacaaggggattgcgaaatcagtcggcgactggtactacaatcgagctgaagttaaggcgatcgattgccgctatccatgtgacaaaacttgccaccacatcatgtgagaaagattcacctttcagttttgcagtcagcataggggttctcgatagggtatccacattgatttgagaagcaaaggaaatgaagacattggaattctaaagcagagtccaggtttccttcagttgattcaaaaacagacacatgcagatccattcagtggaatacatggaatcatgtgcccccgtggttgctatctgtaatttttgccagatgccatactaccagcaaatgttatctagattagaattctttctggctgctcatgttaaccctgcaaaagatgtgatttctgccagcaagaatggattactacattatacaaaaccgtgggtacaggaacaaaactcttcctatggcaaattctatttatgtacaactactaaattgtgattctattcatactatgaacagtgtgttcagttgccctgcaaaatttgcccgcaggacccacaattcaagtaaaaagctacatattgaagctgtgtcccagtagaagctgccacattgaattgctcatcacatttctcctgcactgaaatgtcatcacatagggtgatacagtgtaagagagggtatacacatggagattgccaccaccaagtgcaactttgcacaacgcaacatttctcacaggtcgatc

SEQ ID NO: 18393 - protein, 236 aa, Panicum virgatum
  misc_feature: Ceres CLONE 1796800
  misc_feature (1)..(222): Pfam Name: PAE Pfam Description: Pectinacetylesterase
  misc_feature: Functional homolog of the protein sequence given in SEQ ID NO 50693
  misc_feature: Useful for making plants with altered cell wall content and/or composition
  misc_feature: Functional homolog of the protein sequence given in SEQ ID NO 50805
  misc_feature: Useful for making plants with altered carbohydrate content
MASADQVLLTGCSSGGLAVILHCDQLRAFFPPAAGGRQTTVKCLSDGGLYLDAVDISGGRSLRSYFGDIVALQGIPQSLPGACTARLDATSCFFPQNIINDMKTPMFILNAAYDVIQISLSLSPDRADPSGSWRACKSNRSACDASQMNFLQGFRDQMVSSVQGFSQSRSNGLFISSCFAHCQSEQLGTWNNVPGRSPTIQNKGIAKSVGDWYYNRAEVKAIDCRYPCDKTCHHIM

SEQ ID NO: 18394 - DNA, 174 bp, Panicum virgatum
  misc_feature: Ceres CLONE 1796812
  misc_feature: Encodes the peptide sequence at SEQ ID NO. 18395
gttcggtccgggttcctgaggttcttggcggtgataggaacagatggccgcgtcggatgttgagtccccgtgcttcgtcggcggccttgcctgggccaccgactacaactcgctccatggcggcttctgccccttcggccacgtcctcgcgtcccagatcgtcgtccatggtga

SEQ ID NO: 18395 - protein, 43 aa, Panicum virgatum
  misc_feature: Ceres CLONE 1796812
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
MAASDVESPCFVGGLAWATDYNSLHGGFCPFGHVLASQIVVHG

SEQ ID NO: 18396 - DNA, 2014 bp, Panicum virgatum
  misc_feature: Ceres CLONE 1796825
  misc_feature: Encodes the peptide sequence at SEQ ID NO. 18397
ctcccttctctactcacactcccctccccacaccctctactaccaccccaccggaaaacccaaaccaggcggaaggagcggagacctcgccgccgaccccccccgccgccgccgtgcagatcgcggccggatctacggcgctgaggcacgggggtccccggatcaacgcctccgccgcgctgcacgcgagcggttcggatggctgcacggaaggaaaactctgtgcttagtgcttgtcaagcacccaaaggacgaatcacgcgagctcaagctgctgctaatcgcggaagatttggatcttttccttccgttccactgcctgcgaaagctgaacggaaacaggctgcacaagggaagacaaaaaggggatcttcatatgagaacactagttcaagtgcggcaatttcaggcccccagcctaaaaggcgcacagtactcagggatgtaaccaatgtgagccgtgctaactccaacaaaaacactgctgcaactaagcttcagacaaggccctcccaaagggttggaagaaccacgagcaaaaacaagcagtgtgcaaaaaaggtccctaagatacccccaccagctgttaatagaagttcagttgctaatgattcaaacattgctgaagaaacacaagagggcacatttttgccacagattgaggagcctactcttttacttgagaacatggggccactatcattacagaatgttgaaagaaacagggacagtgcttgtcatgaggcattctttgaagaaagaaatgccagggatagacctgaagcttcgatgtcaaaaactggggactctcctgccttagacattgtagacattgacaaagacaatggcaatcctcagatgtgtgcttcatatgttgtagagatatactcaaacctaacggcttcagagcttatgagaagacccagtccaaattacatggagggtttgcaacgggacatcacaaagggcatgaggggaatactcattgattggcttgtggaggtttctgaagaatacaaacttgtgccagacacactgtacctcactgtatatcttattgaccgcttcctttctcggaactacattgaaagacagagattacaacttctgggaataacgaacatgcttgttgcctcgaaatatgaagagatatgtgctcctagggttgaagagttctgtttcataaccgacaatacatatacaaaggcagaggtattgaaaatggaaggccaagtgctgaatgacctggaatttcatctttctgttccaacaacaaaaacatttctcaggagattccttagagcggcacaatcatcccgtaaaactccttctatcagtttgggatttctggccaattatcttgcggagttgactttggctgattatggattcttgaaatttcttccttcagttgtagcagcatcggctgttttccttgctagatggatgcttgaccaatctgacctcccatggaatcgaactcttgagcactacacctcttacaaaagctctgatattcaattatgtgtctctgctctatgggaactgcagcataacaccagtaactgccctcttaatgccgtccgtgaaaagtatagacatcaaaagtttgagtgcgtagcaaacctgacttcaccggagcttcaccagtcgctcttcagctgacacgccaatgacatcaattacctgttgatcagcaacgttagctgcagtcgtagctgagactgcgttaacattatgtagcattccttccccttgtctgatttggttctgttgtctcaagctgttgttgtttcccgacctttttcgagtcgtgcaataagaagacagatggctcgtcgtttttgcttgacatgaggtttacccgattgtaaacacactttgtgtaggcttggcttgagttgataaccgtagctgcccagcttgtataacaaacaacagaatgctgtttgttgtgacataattcctttattgttagcatggaaatggaaattagtttgttgtttgctctctc

SEQ ID NO: 18397 - protein, 488 aa, Panicum virgatum
  misc_feature: Ceres CLONE 1796825
  misc_feature (228)..(355): Pfam Name: Cyclin_N Pfam Description: Cyclin, N-terminal domain
  misc_feature (357)..(484): Pfam Name: Cyclin_C Pfam Description: Cyclin, C-terminal domain
  misc_feature: Functional homolog of the protein sequence given in SEQ ID NO 50735
  misc_feature: Useful for making plants with modulated oxidative stress sensitivity
  misc_feature: Functional homolog of the protein sequence given in SEQ ID NO 50284
  misc_feature: Useful for making plants with modulated nitrogen use efficiency
MAARKENSVLSACQAPKGRITRAQAAANRGRFGSFPSVPLPAKAERKQAAQGKTKRGSSYENTSSSAAISGPQPKRRTVLRDVTNVSRANSNKNTAATKLQTRPSQRVGRTTSKNKQCAKKVPKIPPPAVNRSSVANDSNIAEETQEGTFLPQIEEPTLLLENMGPLSLQNVERNRDSACHEAFFEERNARDRPEASMSKTGDSPALDIVDIDKDNGNPQMCASYVVEIYSNLTASELMRRPSPNYMEGLQRDITKGMRGILIDWLVEVSEEYKLVPDTLYLTVYLIDRFLSRNYIERQRLQLLGITNMLVASKYEEICAPRVEEFCFITDNTYTKAEVLKMEGQVLNDLEFHLSVPTTKTFLRRFLRAAQSSRKTPSISLGFLANYLAELTLADYGFLKFLPSVVAASAVFLARWMLDQSDLPWNRTLEHYTSYKSSDIQLCVSALWELQHNTSNCPLNAVREKYRHQKFECVANLTSPELHQSLFS

SEQ ID NO: 18398 - DNA, 689 bp, Panicum virgatum
  misc_feature: Ceres CLONE 1796833
  misc_feature: Encodes the peptide sequence at SEQ ID NO. 18399
gctgcgctatttagccaatgccgacagcgacgtgctcccaggaagcgctagcccggagcagcctgcaggatctacaggaagccgaggactccaagaaaggcgggggtcagaggaggaggaggaagaggagcgctggtcgttcttggcgctgctgtttgagctgctgcggaagtcgctgctcgggtgcaggacggagggcggcggcggcggcggcggcggcggcgagggcgagcgcggcggctgtgggatggagattgggttgcccacggacgtgcagcacgtggcgcacgtcacgttcgataggttccatggattcctggggctccctgtcgagttcgagcccgaggtgccccgccgcgctccgagtgccagtgcaagtgtctttggagtttcaacagaatcaatgcagtgttcctatgattcgagaggaaatagtgtcccaacgatcctcttgatgatgcaaagacgcctttatgaacagggtggtcttcaggcagaaggtatcttccgtattaacgcggagaatagccaggaggagtttgtgagagaccagttaaatagtggaattgttccggatggcattgatgtccactgtttggcaggtctaataaaagcctggtttagagagatgccgagtgggggtgttggattctatcccgcctgaacaggtgatgcaatgtcaatctgaa

SEQ ID NO: 18399 - protein, 220 aa, Panicum virgatum
  misc_feature: Ceres CLONE 1796833
  misc_feature (84)..(130): Pfam Name: PBD Pfam Description: P21-Rho-binding domain
LRYLANADSDVLPGSASPEQPAGSTGSRGLQERRGSEEEEEEERWSFLALLFELLRKSLLGCRTEGGGGGGGGGEGERGGCGMEIGLPTDVQHVAHVTFDRFHGFLGLPVEFEPEVPRRAPSASASVFGVSTESMQCSYDSRGNSVPTILLMMQRRLYEQGGLQAEGIFRINAENSQEEFVRDQLNSGIVPDGIDVHCLAGLIKAWFREMPSGGVGFYPA

SEQ ID NO: 18400 - DNA, 518 bp, Panicum virgatum
  misc_feature: Ceres CLONE 1796840
  misc_feature: Encodes the peptide sequence at SEQ ID NO. 18401
agccgagcacgagcaaggcagggaaggccgtcccaatcccctcaaaaccctagcgagcgagcagcaagggaagcggaggaggaaggcgatggatgcctccaaggcccgcgagctccgggagttcgtggaggcgtgcaagaaggacccttctctcctcgccgaccccaacctcgccttcttcagggactacctcgaaagtttgggagccaaaatccccgccgcctccgccgccaaggccgcctccttcgacaagcccaagagatcttccatggacgacattgctgatgatgatgacgatgaggacgacgagtgaagtgtagtcccttcgtagtagtgctatcgtatggggcgatcagaacttctgccatggcacttatcgttacctgtagtcctgcaacaggcatttttgtttaagtttgtcgttgtgaacaaagctgttctattagttttgagctggagttatagatatttactcttatctaaaattaagatgctgccgtttgaacgtggttcttctg

SEQ ID NO: 18401 - protein, 74 aa, Panicum virgatum
  misc_feature: Ceres CLONE 1796840
  misc_feature: Functional homolog of the protein sequence given in SEQ ID NO 50198
  misc_feature: Useful for making plants with altered terpenoid content
MDASKARELREFVEACKKDPSLLADPNLAFFRDYLESLGAKIPAASAAKAASFDKPKRSSMDDIADDDDDEDDE

SEQ ID NO: 18402 - DNA, 1814 bp, Panicum virgatum
  misc_feature: Ceres CLONE 1796842
  misc_feature: Encodes the peptide sequence at SEQ ID NO. 18403
ggaagaaagcactcgcactggcctcaccgatccgccaccacaccacatcctccgcgtcggctcctcctactcctcgccgccgccgccgccgccgccgccgcgatgccggaagacgtgcagatgaacgaatcggagccccagccggcggcccctcctcccgccgcggcgccggcgctctccaccctccaccatctgaaggagatcgcgtccgtgatcgaggccggctccctgtccaaggaggtccgccggatctcccgcgccttccgcctcaccgtcgcgctccgccgccgcctcgccgcgcgggacgtctccgccttcctcggcttcgcgctccccgcgtcctctgaggcctacgctcgcctcaccgccctggtgcccaaggaagatgatactgagatggatgttgatgctgcggctccaacaacacagatttcaatcaagcatggtctccctgaaattgaaatatattgctacttgcttgtcctgattttccttattgatcaaaataagtatgatgaagctaaagcatgcgctactgcgagcattgctcgtctgaagaacttgaaccggagaactgttgatgttttggcttctcgtctgtacttttattactccaatgtgtatgagcttaccaacagccttgctgaaatccgtgggaatcttctcgcattgcacaggatggcaactttgcaccgtgatgagcttggccaggaaactctgctcaatctcctcctccgcaattacctccactacaacttgtatgaccaggcagaaaagcttagatcaaaggcgcctcgttttgaagcgcattccaaccaacaattctgccgatatctgttctacttgggtaaaattaggacaattcagttggagtacactgatgctaaagaaagccttctgcaagctgctcggaaggcacccacaacagctcgtggttttcgtattcagtgcaacaaatgggctatcattgtgaggctacttcttggagagattccagagagaactgttttcatgcagaaaggaatgaagaaagctttgacaccttattttgagctcacaaatgctgttagggtgggggacctggagctgttcagggccgttgcagacaaattcgcaagcacattcagtgcagacaggacccgaaacctgattgtgaggctgcgccacaatgtcattcgaactggacttcgcaacatcagcatttcatactcaaggatctcccttgctgatattgccaagaagctcagactagactccgagaatcctgttgctgatgccgagagcattgtagccaaggccataagagatggtgcaattgacgccaccatagatcatgcgaatggctggatggtgtcaaaggaaactggcgatgtctactcgacgaatgagccgcagatcgcattcaactcaaggattgctttctgcctgaacatgcacaatgaggcggtcaaggcgatgaggttcccccctaattctcacaaggaaaaggagagcgcggagaagcgtcgtgagaggcttcagcaggaggaagaattggcaaaacacatggccgaggaggatgatgacgatttctaagttagctgcctttgagcagacaatgtgtggctgctcgattagggatggccaaggttgaaagcatttcctccgactccagtcatgcagacattaaagtttcaattcatctgctgtaacttttatggtgaccagattttgtattaactccatgaatgcctctgctaggccatttacgtttcgccctcccagaactgttggaatggagaatttgcctacaatgcaaggatttttattcttgc

SEQ ID NO: 18403 - protein, 490 aa, Panicum virgatum
  misc_feature: Ceres CLONE 1796842
  misc_feature (423)..(489): Pfam Name: Rpn3_C Pfam Description: Proteasome regulatory subunit C-terminal
  misc_feature (313)..(420): Pfam Name: PCI Pfam Description: PCI domain
MPEDVQMNESEPQPAAPPPAAAPALSTLHHLKEIASVIEAGSLSKEVRRISRAFRLTVALRRRLAARDVSAFLGFALPASSEAYARLTALVPKEDDTEMDVDAAAPTTQISIKHGLPEIEIYCYLLVLIFLIDQNKYDEAKACATASIARLKNLNRRTVDVLASRLYFYYSNVYELTNSLAEIRGNLLALHRMATLHRDELGQETLLNLLLRNYLHYNLYDQAEKLRSKAPRFEAHSNQQFCRYLFYLGKIRTIQLEYTDAKESLLQAARKAPTTARGFRIQCNKWAIIVRLLLGEIPERTVFMQKGMKKALTPYFELTNAVRVGDLELFRAVADKFASTFSADRTRNLIVRLRHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 18404 - DNA, 1471 bp, Panicum virgatum
  misc_feature: Ceres CLONE 1796845
  misc_feature: Encodes the peptide sequence at SEQ ID NO. 18405
ataccagctgcacatgtgtaaactattgacgaaccttttcataactagctgcatgcagagagttttttatatatctaaacaaaaggtattgaattgccagcattgcccttgtgtaattattgtcttccaaaacacacactttgcagtataaagatcatccgcaagaactcgcgaagcaagcaagccggccagagctctcagcaatcctctgttcctgtctccgttcctctgatcgaccttggctggtgggcttttgtcagagaagtagcaaaatgagcgacgaagttcagcaactcaccagggccttctcagatctgggcgggctcggcgtggacgagccggcgatggtgtcggcgctggcgcggtggcgcgggcagccggagaagcggtcgggcttccggaggggcttcccgggcttcttcaggagccacggcgagatggaccggtgcgaggaggagtacatgctccacctggccgccgagttcgcccggttcaagaatctgatggtgctgtgggcgatgcacccgtgggagcgcgacgcgcggctggcgcaccacgtcctccaccagggccaccccgccgccgtcgccgtggaggtcgcctgcacgcgctccgccgacgagctcctcggcgcgcgccgcgcgtaccaggccctttaccaccactccctcgaggaggacgtcgcctaccgcgccagggacaagccctactgcaacctgctggtggggctcgtgagcgcgtaccggtacgaggggccccgggtgaacgaggaggtggcgcgggcggaggccaaggcgctgggcgcggcggtgaggagcgccggcggtgggaagccgctggcggtggagaacgacgaggtggtccggatcctgagcaccaggagcaagccccacctggtggagaccttgaggcactacaaggagatccacggcaggggcctcgaggaggatcttggcggccacggcagggaggaggagacgacggccctgctgctggaggcggtgctgtgcctcgccgcgccggccaagtacttcagccaggtgatggaggcggcgctgagggacggggcggaccagcacgagaaggacgccctgacgcgggtggcggtgacgcggtcggaccgcgacatggacgagatcagggcggcctaccaggagcagttcggggccaagctggaggacgccatcgctgccaaggcgcacggccactacagggacgcgctgctctcgctggtgggcgcgcaccaccaccagtgaacgcgagcgcgtccaccagctgccgctgtcttcatcttctcggtcgtctgcccgtgtccgtccgttcgcctttcgtggcgtctgtgcgtgtcgcctttctacgtgccattgttggtctgttgctctgttttcgagcgagaccgtaacattttctgctgagcctgtagtgtgtcgctgaagatgccaaataagatctgcatgcaatcgtttcttcg

SEQ ID NO: 18405 - protein, 327 aa, Panicum virgatum
  misc_feature: Ceres CLONE 1796845
  misc_feature (253)..(320): Pfam Name: Annexin Pfam Description: Annexin
  misc_feature (171)..(247): Pfam Name: Annexin Pfam Description: Annexin
MSDEVQQLTRAFSDLGGLGVDEPAMVSALARWRGQPEKRSGFRRGFPGFFRSHGEMDRCEEEYMLHLAAEFARFKNLMVLWAMHPWERDARLAHHVLHQGHPAAVAVEVACTRSADELLGARRAYQALYHHSLEEDVAYRARDKPYCNLLVGLVSAYRYEGPRVNEEVARAEAKALGAAVRSAGGGKPLAVENDEVVRILSTRSKPHLVETLRHYKEIHGRGLEEDLGGHGREEETTALLLEAVLCLAAPAKYFSQVMEAALRDGADQHEKDALTRVAVTRSDRDMDEIRAAYQEQFGAKLEDAIAAKAHGHYRDALLSLVGAHHHQ

SEQ ID NO: 18406 - DNA, 1690 bp, Panicum virgatum
  misc_feature: Ceres CLONE 1796862
  misc_feature: Encodes the peptide sequence at SEQ ID NO. 18407
ctctcctttgcacccctagtactgatcctcctccccgcgctcttcgcgcagcaagacatagaagaatcccctactactactactactactactactactactactactactactactactactcatgcatgggcaccgcctcctcgcgccgcatatgaatcagacatgaataggggccacagcagcagctcctcgaagctcatcaacgagaagcttgaggaacaccggatctccaccgccaagcactgcccccactgcggcgagaaaatcgacagcaagccggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgaccagggatggcctgagcaagcacttcttccaccggccatcaaaggcctatacgacgggcacgaggaagaggaggaagatacagacggagtgcgacgtccacaagggcgagacgaggtggcacaagaccggaaagacgcggccggtaatggtgaacggccggcagaaggggtgcaagaagattctggtgctgtacaccaacttcggcaagcaccgcaagccggagaagacgaactgggtgatgcaccagtaccacctcggcgacctcgaagaggagaaggagggggagctggtggtttgcaagatcttctaccagacccaacccaggcagtgcagctggtcttccgaacggggcgccgccgccgccgccatggcagcaacgacagtacaggagcagcgtaggagggatagcggcagcggaagctgctcttcaagggaccacgaggtatcgttcccggccggatacacggtcaccgcggccgtcgagatgcagcagcatatgaagcagcactccgcggaccatttcagcttcgcgcctttcaggaagactttcgatcaggaggttggtataggtggtgatcaggtgccatctaatcagcttggacgatcagaacagcatcatgccgtccaggagcagcagccacaccgtccggtgatcgcgaccatggccgtcccagccacggctttcctgatcagtaggccatcgaaccctgtttcgactattgtgccacctgcaatgcagcacacgtcagttgttctcgatcatgatcagttccatgtgccagcaatccttctacatcaccacgacaaatttcagcatcagcaccaacagcaacaaccacagcaaaagcttgaccgcaggtctgccggcttggaagaattgataatgggttgcacgtcatccacaagcacaaaaggggaaacttcaatccctcagtcccaagagacagaatggccttacccttactggccgcctgacaaccaagatcatcatggatagtatcaacaaggctgttaaatagtggcaatcaataccaaaactaaccacaccactttcaatgggttggtatttgtccccttgaatatactgggcgttgctttaatttcttggagaatgtactgccgaagataaagaaaacagatctatgcagatctctccctcaatgaaaagaagatgataaaattaattgttgtgaactcttcaaggcagaagatcagaaagcgtg

SEQ ID NO: 18407 - protein, 432 aa, Panicum virgatum
  misc_feature: Ceres CLONE 1796862
  misc_feature (44)..(187): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 1713 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: Functional homolog of the protein sequence given in SEQ ID NO 50710
  misc_feature: Useful for making plants with altered carbohydrate content
  misc_feature: The sequence is a functional homolog of SEQ ID NO 210 in the 10/666,642 US patent application
  misc_feature: The sequence is a functional homolog of SEQ ID NO 562 in the 11/435,388 US patent application
MNRGHSSSSSKLINEKLEEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLEEEKEGELVVCKIFYQTQPRQCSWSSERGAAAAAMAATTVQEQRRRDSGSGSCSSRDHEVSFPAGYTVTAAVEMQQHMKQHSADHFSFAPFRKTFDQEVGIGGDQVPSNQLGRSEQHHAVQEQQPHRPVIATMAVPATAFLISRPSNPVSTIVPPAMQHTSVVLDHDQFHVPAILLHHHDKFQHQHQQQQPQQKLDRRSAGLEELIMGCTSSTSTKGETSIPQSQETEWPYPYWPPDNQDHHG

SEQ ID NO: 18408 - DNA, 848 bp, Panicum virgatum
  misc_feature: Ceres CLONE 1796865
  misc_feature: Encodes the peptide sequence at SEQ ID NO. 18409
actcggctcgctagctcttcgccgcctccgcttctcgccgagagaaagctagggttttgctcccggaatctcctctccgccgccgccgaccggccgcgcgccggaggtatcaccgcatccctcatccgatccggcctttttttatcgccggatcccggccaagatgcttcccctctcgctcctcaagactgcccaggggcatcccatgctcgtggagctgaagaatggagagacgtacaacgggcatctggtcaactgcgacacgtggatgaacatccaccttagggaggtcatttgcacctcaaaggatggtgacaggttttggaggatgccggagtgttacatccgagggaacaccattaagtatcttcgagttccggatgaggttattgacaaggtccaggaggaaacttccaaaagccgatcagataggaagccaccaggtgttggccgcggcggaagaggaaggggagacatcggtgctaaacctggaggcagaggcattggacgtggccaagatgatggaggtagaggcagtggtggccgaggaaggggtggagttggtgggaaaggcggtaacaaaggtggaggccgtggccgtggctgaagctagtcatcacattggagaatgccgctttttaaggcctgtagctgtgttgcatagattgcttaggacgtgaaccatggagctggaattggttggttgttttccgtgacaaaaaccaaaatggttcgtgtgatctaaacaccgaggaagaggcgtcagccaggcttgtctctcttcctcaaaatagtttacttgatcgtgagtaagccaatctgttcatttgctgagaggtatcctgatt

SEQ ID NO: 18409 - protein, 147 aa, Panicum virgatum
  misc_feature: Ceres CLONE 1796865
  misc_feature (5)..(71): Pfam Name: LSM Pfam Description: LSM domain
MLPLSLLKTAQGHPMLVELKNGETYNGHLVNCDTWMNIHLREVICTSKDGDRFWRMPECYIRGNTIKYLRVPDEVIDKVQEETSKSRSDRKPPGVGRGGRGRGDIGAKPGGRGIGRGQDDGGRGSGGRGRGGVGGKGGNKGGGRGRG

SEQ ID NO: 18410 - DNA, 945 bp, Panicum virgatum
  misc_feature: Ceres CLONE 1796870
  misc_feature: Encodes the peptide sequence at SEQ ID NO. 18411
aaaagactcatcggcatagcatactccgcgtctccctcggtcgtgctcgccgcaacatcggagtcgattccatcgacggtgctcgatactaacgaggcaaccgcccgaccccccgcaataaagcacccgcgcccccgctcccactcagtcggtcctctctcttgccacgcgcatcggccgcatagcatcgctgctgttcccgcttatctccgtgtcggcccttcttgcagctgcagccatggctgctcccgtcgccgcagccgccggaagatcggccgtcctcgcctactcccctgcgctacggttacagggaatggatgcagtgtcgtttcgagcatcagcatctttccccaggcaaagagcaagctttccatcaattcaggtgcagcggattccaaagcgctttcaagtgtcatgctcggctaaacaagaaactattgagaaggtttgtgaaatagtgaagggtcagttagctctacccgaagacagcacagtaacaggagagacaaagtttgtggacattggagctgattcacttgatactgtcgagattgtgatggggcttgaggaggcattccaaatcagcgtggatgaatcaagcgctcaggagatccagacggtgggtgatgctgcggctctcatcgacaagcttatcgcagagaaggatgcttgaaaggactggagtcatggagtttcctcaatcaatagttttgcaggcacctccgctgctctctgtatggtggcggccatgcttccttgcattgcaattagttagaactctcaggggtgcgtgccttttgggattaataaaagaggggatcgtcttatttccctgagagacggagttttttttttcatcttaatattgtgagagacagtattccattcatgtagctgaaaaagatgtcgcaatttgttgcaatgaatttgaatcttttcacccac

SEQ ID NO: 18411 - protein, 144 aa, Panicum virgatum
  misc_feature: Ceres CLONE 1796870
  misc_feature (68)..(135): Pfam Name: PP-binding Pfam Description: Phosphopantetheine attachment site
MAAPVAAAAGRSAVLAYSPALRLQGMDAVSFRASASFPRQRASFPSIQVQRIPKRFQVSCSAKQETIEKVCEIVKGQLALPEDSTVTGETKFVDIGADSLDTVEIVMGLEEAFQISVDESSAQEIQTVGDAAALIDKLIAEKDA

SEQ ID NO: 18412 - DNA, 1787 bp, Panicum virgatum
  misc_feature: Ceres CLONE 1796875
  misc_feature: Encodes the peptide sequence at SEQ ID NO. 18413
acttcctttccccccctccgtccgtgaacgaatcaatccccccgcccccgcgaatccttcttccgccgcaagccggaggcaaaatcgggttcctcggccgccgcccggcgcggagcggcggcggcggcggcggcggcgccagcggcgcgatgaggtcgtcggactcgtcgcggttcgtgcaggagctcgtgctctacgccgccagcgccgcgctcagctgcctcgtcctcttcgccggcctccgccagctcgaccccaaccgcgccgcctcccagaaggccgcgcagcagaagaaggagatcgccaggcgcctcggccgcccgctcgtctccaccacgccctacgaggatgtgattgcgtgcgacgtcatcaaccccgacagcatcgacgtcgagttcgactccatcggcggcctcgaccacgtcaagcaggcgctctacgagctcgtcatcctgcccctgcgccgcccggagctcttcgccttcggcaagctcctcagcccccagaagggcgtgctcctctatggcccgcctggcaccgggaagacaatgctcgccaaggccatcgccagggagtccggcgcagtcttcatcaatgtcaggatttccaatctcatgagcaagtggtttggggatgcgcagaagctcgttgcggctgtgtttagccttgcccacaagctccagcctgctattatcttcatcgatgaggttgatagtttcttggggcagcgacgcacaacagaccatgaagccatgactaatatgaagacggagttcatgtccctctgggatggcttcaccactgatcagaatgctcgtgtgatggtccttgctgctacaaacaggccttctgagttagatgaggccatcctcaggcgctttacacagatatttgaaattggaattcctgttcagagtgaaaggagcaagatacttcaggttgtattgaagggtgaaaatgttgagccaggtattgattatgatcacattgcaagattgtgtgagggctttactggatcagatatcctagaattgtgcaagcaggcagcattctaccctatcagggagctgttggatagtgagaaaaatgggaggaacatagataaacctagaccattgagacaatcagacttggagagagccctatcaacatctagaaagggcaagaaggctgcaagctcagagctacagtcacccttgtgggttcggcccttggattcagaagacgatcaggtacagagcgcaatttttgagatatctaagctgatgtctcgaatagttcagaacagtcagtcagaatcagaaccgcaagagccttcttcaccttaatctaatccttttgctagatctcgtgaaaatctgcagtggagtaaacacaagcattacctcgatttcgttaggttttcttgtgcagcttgcaaaggttcatcacatgtattagttccttttcgcttggcgaggctgcactggtttttgaagcaaattgcagccggcaaagtggcaagtttgcactgatgtttaagttgattcagaattctatgtgcccggccaaaaactaactatcagaactccatggttgtctggctgaagtactgttttgcttgccttgtatttttaaacagttttagggtagtcaatatacataatgaagaaagggctcttccattccaggtccacaagtagtgcacttcggtttatctgattctatcactcacatgcctttaatctctgtcaaggaagttcgtttcagagcataaactgtttgacacctgccatcagtactatgac

SEQ ID NO: 18413 - protein, 392 aa, Panicum virgatum
  misc_feature: Ceres CLONE 1796875
  misc_feature (121)..(305): Pfam Name: AAA Pfam Description: ATPase family associated with various cellular activities (AAA)
  misc_feature: SWISSPROT Homolog: EC 3.6.4.3 Microtubule-severing ATPase
MRSSDSSRFVQELVLYAASAALSCLVLFAGLRQLDPNRAASQKAAQQKKEIARRLGRPLVSTTPYEDVIACDVINPDSIDVEFDSIGGLDHVKQALYELVILPLRRPELFAFGKLLSPQKGVLLYGPPGTGKTMLAKAIARESGAVFINVRISNLMSKWFGDAQKLVAAVFSLAHKLQPAIIFIDEVDSFLGQRRTTDHEAMTNMKTEFMSLWDGFTTDQNARVMVLAATNRPSELDEAILRRFTQIFEIGIPVQSERSKILQVVLKGENVEPGIDYDHIARLCEGFTGSDILELCKQAAFYPIRELLDSEKNGRNIDKPRPLRQSDLERALSTSRKGKKAASSELQSPLWVRPLDSEDDQVQSAIFEISKLMSRIVQNSQSESEPQEPSSP

SEQ ID NO: 18414 - DNA, 2924 bp, Panicum virgatum
  misc_feature: Ceres CLONE 1796878
  misc_feature: Encodes the peptide sequence at SEQ ID NO. 18415
acataacagcgcgcccgcgcacgctccagggttcacacggcggcccaggatgccaggccaccaccaccagcgcacacgcggggcaaactgaacgcacgcgcgcgcggccggcggcggcagcgggaaacccagcgggaaccagagccccaaaagacacgccgagaccatggcacccgggcgacccggcctccgcgccctgcccctggcgctcgccttggcgttggcgtgcctcctcccgcgcctcgccgcggcgcagcagcagcaggctggcgaggcgcagctgctgctccggatcaagcgggcgtggggcgacccgccggcgctcgcgtcgtggggcgccgcggccgcggcctcgcactgcaagtggacctacgtgggctgcgacgcggcggggcgggtcgcgtcgctggcgctccccaacgtgacgctggcgccgggcgccgtgctgcccgacgacatcggcgggctcgcggccctcacggcgctcgacctctccaacaccagcgtcggcggcggcttcccggcgtccctctacaactgccccgccatcgcgcgcgtcgacctctccaacaaccggctcgccggggagctgccggccgacatcggccggctcgggggcagcctcacctacctcgccctggaccacaactacttcaccggcgcgattccggcggcgttgtccaagctcaccaacctgacgtacctcgccctcaacgggaaccagctcaccggcacgatcccgacggagctcggtgagctggttaaccttcaggcgatcaagctggagaaaaatctgttcggcgccggcacgctgccggagtcgttcaagaacctgacgaagctgacgaccgtctggctggcgaactgcagcctcggcggcgaattcccgagttatgtcacggggatgccggagatggagtggctcgatctgtccataaatggattcaccggcaacataccgcccgggatttggaacctccggaagctgcagtacttgtacctgtactccaacaacctcaccggcgagatcaccatcaacgaccggatcggagcagcaagtttggttgaggttgacctgtcggtgaaccagctgatcggaaccatcccagaaagtttcgggagcttgctgcaactaaggttattgaacttgcaacagaataatctcaccggcgggataccgccgagcattgcccggctgccgtccttggtattgctgtggctgtggaacaaccacctcagcggagagctcccggcggagctcgggaaggagacgcctctgctaagagacatccagatcgacggcaacgacttcttcgggccaataccggaggggatctgcagccaccaacagttgtgggtgctcaccgcctccggtaaccgcctgaacggctcgatcccgaccggcctcgccagctgctccgctctcatatggctcatgctccaagataacgagttgtccggcgaggtgccggccgctctgtggacggtgccgaagcttctgaccttgtatctgcagaacaatcggcagctgagcggaagcctgccggagaacctgtattggaacacgacgaggatatacatcgacaacaatcggttcaccggacggattcctgcatcgggcactcgtctccagaggttccacgccagcaacaacttgttctccggcgacataccggcggagttttccgccgggatgccacggctgcaggagctggacctgtcggcgaaccagctctctggggctatcccagagagcatcgcgtcgctcactgacgtgatgcagatgaacctcagccacaacctgctcaccggcgagattccggcagggttgggctccataccggcgctcaacctgctggacctttcgtcgaaccagctttccggtgccataccgccgtctctgggatcgctgaggtctagtcagctcaacttgtcgtccaacaagctcaccggcgaggtcccggtggcgctggccagccccgccaacgaccaaagcttcttgggcaacccggggctctgcgccgccgcatcgctggttgggagcctcaagggcgtgcgctcgtgcgcggcccagccaaccgaccatgtctcgccgcgtctccgcgcgggcctcctcgccgcgggcgtcgcgcttgtcgtcgtcgtcgcggcgctcgcagtcttcgtcgcccgcgacatcaggaggcggaagcggcggctcgcgcaggccgaggagccctggaagctcacccctttccatcccctggacttcggcgagacctccgtggtgcgcgggctcgccgacgagaacctcatcggcaagggcgggtcggggcgcgtgtaccgcgtcacgtacaccagccggagcagcggcggcacgggtggcaccgtggccgtgaagcgcatctggaccggcgggaagctggacaggagcctggagcgcgcgttcgcggcggaggtggacgttctcggccacatccggcacagcaacatcgtgaagctcctgtgctgcctctcccgcgcggagaccaagctcctcgtctacgagttcatggacaacggcagcctggacaagtggctgcacggtcacaaatggttggccgggggcgcgatggcgagggccccgtcggtccggcgggcgccgctggactggccgacgagggtcaaggtggccgtcggcgccgcgcgcgggctctactacatgcaccacgagtgctcgccgccgatcgtgcaccgggacgtcaagtgcagcaacatcctgctcgactcggagctcaacgccaaggtcgccgacttcggcctcgcaaggatgctggtcgaggccggcagggctgacacggtgaccgccgtcgccggatcattcggttacatggctcccgagtgcgcgtacacgaggaaggtgaacgagaaggtcgacgtatacagcttcggggttgtcctcttgg

SEQ ID NO: 18415 - protein, 919 aa, Panicum virgatum
  misc_feature: Ceres CLONE 1796878
  misc_feature (704)..(919): Pfam Name: Pkinase_Tyr Pfam Description: Protein tyrosine kinase
  misc_feature (33)..(73): Pfam Name: LRRNT_2 Pfam Description: Leucine rich repeat N-terminal domain
  misc_feature (63)..(802): SWISSPROT Homolog: EC 2.7.11.1 Non-specific serine/threonine protein kinase
  misc_feature (835)..(919): SWISSPROT Homolog: EC 2.7.12.2 Mitogen-activated protein kinase kinase
MAPGRPGLRALPLALALALACLLPRLAAAQQQQAGEAQLLLRIKRAWGDPPALASWGAAAAASHCKWTYVGCDAAGRVASLALPNVTLAPGAVLPDDIGGLAALTALDLSNTSVGGGFPASLYNCPAIARVDLSNNRLAGELPADIGRLGGSLTYLALDHNYFTGAIPAALSKLTNLTYLALNGNQLTGTIPTELGELVNLQAIKLEKNLFGAGTLPESFKNLTKLTTVWLANCSLGGEFPSYVTGMPEMEWLDLSINGFTGNIPPGIWNLRKLQYLYLYSNNLTGEITINDRIGAASLVEVDLSVNQLIGTIPESFGSLLQLRLLNLQQNNLTGGIPPSIARLPSLVLLWLWNNHLSGELPAELGKETPLLRDIQIDGNDFFGPIPEGICSHQQLWVLTASGNRLNGSIPTGLASCSALIWLMLQDNELSGEVPAALWTVPKLLTLYLQNNRQLSGSLPENLYWNTTRIYIDNNRFTGRIPASGTRLQRFHASNNLFSGDIPAEFSAGMPRLQELDLSANQLSGAIPESIASLTDVMQMNLSHNLLTGEIPAGLGSIPALNLLDLSSNQLSGAIPPSLGSLRSSQLNLSSNKLTGEVPVALASPANDQSFLGNPGLCAAASLVGSLKGVRSCAAQPTDHVSPRLRAGLLAAGVALVVVVAALAVFVARDIRRRKRRLAQAEEPWKLTPFHPLDFGETSVVRGLADENLIGKGGSGRVYRVTYTSRSSGGTGGTVAVKRIWTGGKLDRSLERAFAAEVDVLGHIRHSNIVKLLCCLSRAETKLLVYEFMDNGSLDKWLHGHKWLAGGAMARAPSVRRAPLDWPTRVKVAVGAARGLYYMHHECSPPIVHRDVKCSNILLDSELNAKVADFGLARMLVEAGRADTVTAVAGSFGYMAPECAYTRKVNEKVDVYSFGVVLL

SEQ ID NO: 18416 - DNA, 658 bp, Panicum virgatum
  misc_feature: Ceres CLONE 1796878-R
cgtgcacgcggccgacgatgaaggacgtgctgcagatactgcagcgctgcgagcagtcgcactggaagaccgccgacgagaaggtcgccggcgactacgacgccgccccgctactccaggtgcgaggaggcagccgccggaaacagctctccgatgccaaagtgagcgacgatggcggcaagggcggtttcgactgcaacgtctgaagaaaagtagaatgggtgaatatctgtctataggaacccaaccttctgaggttaggatctaggacggtgcactagcagccagccttgtgcggtgttaggtgatcagaggtgttgggggtcaccactgcacacacccgagatagccctgactgcgggacggaagccgaaggtactgaagggcgccatagcccggaggtcgaatgaaggcgtccgaaggtctccagaggaagccgaaggtcccatgaagcctgaaggtcactccggaggcccgaaggctgtggcgatcctccggaggtcttaagggaccttcgggatagcgtgccgtgcacgaatcggatagagtagacaatttatacattccaacatgtaaaatgacttttgacccggaatattccgggcatgtgagggtattgaggtcattgtgtaataaaggatggggatataaatactcc

SEQ ID NO: 18417 - DNA, 1810 bp, Panicum virgatum
  misc_feature: Ceres CLONE 1796883
  misc_feature: Encodes the peptide sequence at SEQ ID NO. 18418
gcatcacctgcagcagtgcctcaagcacccccaggctatggaccttctccacattttccttatccaggccgcctcttgtcttctgggcatccatatggagatgtgtctggtaatatggagaactcagcgccacgtagtctccatagatggattcagtgtgatggttgtggagtgcaaccaattgtcggtccacgctacaaatctaatgtgaaagaagactatgatttgtgtgattcctgtttccatcgcatgggaaatgaaatggagtacaccaaaatagacaagcctattttaccccacaggttactgagagatcctcatgcgtaccgaaagatgcatcacccacgggttgtcatgaagtcaaaacgggagaaactcgatagtcgcttcattttggatgtaactgtcctggatggaacactgatggcaccttctaccccattcatgaagatttggcgcatgcataacaatgggtctattgtgtggccattgggcacacagcttgtctgggttggtggagatcagtttgcattgcagacctctgttccattagagattccggtcaatgggtttccattggataaggagattgatgtcgctgttgattttgtggcacctacaaggcctgggaggtacatagcttactggaggttggcatcaccttctggtcagaaatttggtcaacgagtttgggttcacatccaggtggaagatccttcctttgctaatgacaacaacaggaatgcagctattaatctgaatctgcctccagaaagcaatattacaaacacctctaatttaattgatgtgaacgttgagcctgctgagacgacccttagtgcacatgccaaacgcactaaaaagtttcacttctatccgatcgatgttccagagcctaagaaatctcagcctgctcctgttgttacctctatgcctgcagcagctccagcaaaccctactattgatgttgccatgtccagtgcaactacagctgcttttatgccttctgttagtatgcctgcacctgagcttgttgtgcctgctgtaccttcaccacctgttaatgtgcctatcataccttcagctgtgcctatttctgcacctcctcatgcacctgcatctgcatctgtatctggccctgcttctatgcctgtgcctccaactgttgctagtgctacagcacctgagccttttgacatagatgatcacaatgaagagaagctgctgagggagctggaggaaatgggctttaggcagattgatctgaacaaggaaatccttaggcagaacaattacaacctggagcagtctgttgatgatctgtgtggcgtcaacgaatgggatccactccttgcagagctggaggagatgggttttgacgataccgagatgaacaaggagctgctcgcgaagaacgggggaagcatcaagcgagctgtgatggacctcatcgccagggagaagaaggacaagtgaagatcgtgtgcctgtgctgtgcacataattatctatgatctacatgtaaataatgaggctattgcacgcctgcaccagtgcaccactccggtgcgtgcagcactatcacgtctcagagcttgcttaccttagaaccgttgatgtttatgcgacgtctttatattggtcgtgcgtgtgcgtgtagtgtctggtgtcgtgtcgatgacttgcgctgagcgcctcaggaaagcagttaccctgccaggtgaactgcttgtaaggattggctgtgatgccttctatctgttaccgagacatgcgaacttataatatgatgctcggactgtggatgtgt

SEQ ID NO: 18418 - protein, 491 aa, Panicum virgatum
  misc_feature: Ceres CLONE 1796883
  misc_feature (404)..(441): Pfam Name: UBA Pfam Description: UBA/TS-N domain
  misc_feature (446)..(483): Pfam Name: UBA Pfam Description: UBA/TS-N domain
  misc_feature (47)..(90): Pfam Name: ZZ Pfam Description: Zinc finger, ZZ type
ASPAAVPQAPPGYGPSPHFPYPGRLLSSGHPYGDVSGNMENSAPRSLHRWIQCDGCGVQPIVGPRYKSNVKEDYDLCDSCFHRMGNEMEYTKIDKPILPHRLLRDPHAYRKMHHPRVVMKSKREKLDSRFILDVTVLDGTLMAPSTPFMKIWRMHNNGSIVWPLGTQLVWVGGDQFALQTSVPLEIPVNGFPLDKEIDVAVDFVAPTRPGRYIAYWRLASPSGQKFGQRVWVHIQVEDPSFANDNNRNAAINLNLPPESNITNTSNLIDVNVEPAETTLSAHAKRTKKFHFYPIDVPEPKKSQPAPVVTSMPAAAPANPTIDVAMSSATTAAFMPSVSMPAPELVVPAVPSPPVNVPIIPSAVPISAPPHAPASASVSGPASMPVPPTVASATAPEPFDIDDHNEEKLLRELEEMGFRQIDLNKEILRQNNYNLEQSVDDLCGVNEWDPLLAELEEMGFDDTEMNKELLAKNGGSIKRAVMDLIAREKKDK

SEQ ID NO: 18419 - DNA, 1850 bp, Panicum virgatum
  misc_feature: Ceres CLONE 1796898
  misc_feature: Encodes the peptide sequence at SEQ ID NO. 18420
accgaatcctcgaatcgaatcgcgaccaaatcccccgccccacgctcccctcccctggcctccctcctcaccccgcgcgcgcgcgcaccaacccccccccccccccccacacccgccgtcctcaccgcatccgccgccccaaccgatccccctcaagcgccctcgccgcgcgtgacggcgcaatgacggccgccacggcgcccccgcggcagctgagcctggaggacctgaaggcggtgtccgtgctggggcgcggcgccaagggcgtcgtgttccacgtcctgcccaccccgggggacccggagggsgagggcgccscggcggcggakgcggccatggcgctcaaggcggtctcgcgggaggtggcgcggcacaggaaggcggcgagcgggtacggggacggccaccgccggatctggttcgagcgggacgtgctcctcgcgctgcgccacccgctgctcccctcgctccgcggcgtcctcgccaccgacgccgtcgtgggattcgccatcgaccgctgcggcggcggcgacctcaactcgctccggcgccgccagaccgagaagatgttctccgactccgtcatccggttctacgcggcggagctggtgctggcgctcgagtacctgcacagcctcggcatcgtgtaccgggacctcaagccggagaacgtcctcatccaggacagcggccacatcatgctcgtcgacttcgacctctccacgcggctcccgacgccaccgcaggagctgaacgcgccggccgagagcaccaaaccggcgcctccggtcgctgcgccgtcgccgggccgcgggaagctaaggaaacccgcgagcgccgccctgtgcttcccattccgcaccggccgcaccgcgaagccggccgcgccggccgcggactcgccgtcgatctcgcggacggcctcctcatcgtcctcatcctccacggcgaccacggcctcctccggggcctcggccggcgcgcggacgcccgcgaagtcgaactcgttcgtgggtacggaggactacgtggcgccggagatcatcgccgggcgcggccacgacttcgccgtggactggtggggcctgggcgtggtgctctacgagatgctctacgggcgcacgccgttccgggggcagaaccgcaaggagaccttctaccgcgtcctcgccaagcagccggagctcgtcggcgagcagacgccgctgcgcgacctcatcgcccgcctcctcgagaaggaccccgagaagcgcatcggcgcgcgcggcgtcaaggcccaccccttcttccggggcgtcgactgggaccgcatcctccacgtggcgcgcccgccgttcatcccgaccccgccgcaggaagaggacggcgacgacgcgctcgacgtcgagaaggtcgtgcgcgaggtgttcgcgtccaatgacgccgaagctgcaaagacgggcgagggcgagaaggcttcgccggaggcggatgggggccgcggcggcgacggcgaagggcggaggagagacccatcaaaagatggtgacttctccgtgtttttctgagcttatattttttatttttttccttttttgggaaaattaactactacttgtatttgttgtttattgagttgccttttttttaaggatttgtagtatgaacatgatgggatttagcggatgagattaggaggggagtacggcgcagtggccggtggagtacataaattaaagaggtgctccagttcgatgggggtatagtcactatatagcttcttttttcctttcgattttctttttttatttgcttctttgttggatactttgcttcgtacataatgaataatgagagtggaatcggctcac

SEQ ID NO: 18420 - protein, 454 aa, Panicum virgatum
  misc_feature: Ceres CLONE 1796898
  misc_feature (16)..(369): Pfam Name: Pkinase Pfam Description: Protein kinase domain
  misc_feature: SWISSPROT Homolog: EC 2.7.11.1 Non-specific serine/threonine protein kinase
  misc_feature (46)..(46): Xaa is any aa, unknown, or other
  misc_feature (49)..(49): Xaa is any aa, unknown, or other
MTAATAPPRQLSLEDLKAVSVLGRGAKGVVFHVLPTPGDPEGEGAXAAXAAMALKAVSREVARHRKAASGYGDGHRRIWFERDVLLALRHPLLPSLRGVLATDAVVGFAIDRCGGGDLNSLRRRQTEKMFSDSVIRFYAAELVLALEYLHSLGIVYRDLKPENVLIQDSGHIMLVDFDLSTRLPTPPQELNAPAESTKPAPPVAAPSPGRGKLRKPASAALCFPFRTGRTAKPAAPAADSPSISRTASSSSSSSTATTASSGASAGARTPAKSNSFVGTEDYVAPEIIAGRGHDFAVDWWGLGVVLYEMLYGRTPFRGQNRKETFYRVLAKQPELVGEQTPLRDLIARLLEKDPEKRIGARGVKAHPFFRGVDWDRILHVARPPFIPTPPQEEDGDDALDVEKVVREVFASNDAEAAKTGEGEKASPEADGGRGGDGEGRRRDPSKDGDFSVFF

SEQ ID NO: 18421 - DNA, 706 bp, Panicum virgatum
  misc_feature: Ceres CLONE 1796903
  misc_feature: Encodes the peptide sequence at SEQ ID NO. 18422
ccggcctccttcctcctccgatctctctctctctccctctctcgctccgctacctgctgcttattgctttccccctgcgatccgttccttgccctagctagccgccggccggatcgagcgatcgaggctgtactcgccgtccgtcctcgtcctcgactactcccccgccgatctcgacagcgccagcgcctcaggtgccggagctgccgcattcggtcgccgaaatctgtcatgatgtcgtcctcgtcctcgtcgtcggccgccttcccgctggaccacctcgcgccgtcccccaccgagcagctctgctacgtgcactgcaactgctgcgacaccatcctcgccgtcggcgtgccctgcatcagcttgttcaagacggtgacggtgcgctgcggccactgcgccaacctgctctccgtcaacctccgcggcctcctgctaccgcccgtggcgccgccggccaaccagctcagcttcggcggcggcggcggcggcggccactccttgctctcccccatatccccgcatggcctcttggacgagttcgcgctccaggcgccgagcctcctgatggatcacgcgagcgccaacctgagccacaccatgagtggccgcagcatcagcagcagctgcgccagcaacctgcccgccgcgccgatgcaggcagcgaagccgcccgtgcagcaggagcccgagataaccaaga

SEQ ID NO: 18422 - protein, 158 aa, Panicum virgatum
  misc_feature: Ceres CLONE 1796903
  misc_feature (15)..(157): Pfam Name: YABBY Pfam Description: YABBY protein
MMSSSSSSSAAFPLDHLAPSPTEQLCYVHCNCCDTILAVGVPCISLFKTVTVRCGHCANLLSVNLRGLLLPPVAPPANQLSFGGGGGGGHSLLSPISPHGLLDEFALQAPSLLMDHASANLSHTMSGRSISSSCASNLPAAPMQAAKPPVQQEPEITK

SEQ ID NO: 18423 - DNA, 300 bp, Panicum virgatum
  misc_feature: Ceres CLONE 1796904
  misc_feature: Encodes the peptide sequence at SEQ ID NO. 18424
cggggggcaccaccacaccaccacgaccatgagatcgatggacatcgtctcggcagctagctactccggctcggccgcctgcgcggcctccgtttcccccccctccccggcctgctgctccgccctgtccttctcccactcgtacagggacaaggcgtccggcccccccaccgccttctacagcgagcctgtgcgggtgaactctgctccgccgctcgcgtggaggcaaaccaaagcagcgagccgcgcggatctcctcatgcggtgcgagatcggcgacaggctgcaagactttctgac

SEQ ID NO: 18424 - protein, 87 aa, Panicum virgatum
  misc_feature: Ceres CLONE 1796904
  misc_feature: SWISSPROT Homolog: EC 3.1.3.37 Sedoheptulose-bisphosphatase
MDIVSAASYSGSAACAASVSPPSPACCSALSFSHSYRDKASGPPTAFYSEPVRVNSAPPLAWRQTKAASRADLLMRCEIGDRLQDFL

SEQ ID NO: 18425 - DNA, 2295 bp, Panicum virgatum
  misc_feature: Ceres CLONE 1796921
  misc_feature: Encodes the peptide sequence at SEQ ID NO. 18426
atcccgtcacgtcccctcgcagcagcagcattgcattgcttcactggtgtggagtcacttattaccgcaatacactagctagcacagccaagcgcccaagcccgtcgctaggatcggatcggatcagttgatcttgctgctgcagcgtgcatacgtgtgttccctagcagctcgccggccggccggcaatggaggtggggacgtgggcggtggtggtggcggcggcggcggcggccgcgtacctggcatggttctggcggctgtcgcgggggctcagcgggccgcgggtgtggccggtgctcggcagcctgccggggctggtgcagcacgccgaggacatgcacgagtggatcgctggcaacctccgccgcacgggcggcacgtaccagacctgcatcttcgcggtgcccggggtggcgcgccgcggcgggctggtcaccgtcacgtgcgacccgcgcaacctggagcacgtcctcaaggcgcacttcgacaactaccccaagggccccttctggcacgccgtcttccgggacctgctcggcgacggcatcttcaactccgacggcgacacctgggtcgcgcagcggaagaccgccgcgctcgagttcaccacgcgcacgctccggacggccatgtcccgctgggtgtcgcgctccatccacctcaggctgctgcccatcctggaggaggccgccagcgacaagacgcagcacgtcgacctccaggacctcctcctccgcctcaccttcgacaacatctgcggcctggccttcggcaaggaccccgagacgctcgcgccgggcctgccggagaacgccttcgcctcggccttcgaccgcgccacggaggccacgctcaaccgcttcatcttccccgagtgcctgtggcgctgcaagaagtggctgggcctcggcatggagaccacgctggcccgcagcgtcgcgcacgtcgacgagtacctcgccgccgtcatcaaggcgcgcaagctcgagctcgcgccgggcaatggcagcaggtgcgacgcggcgcacgacgacctgctctcccggttcatgcgcaagggctcctactcggacgagtcgctgcagcacgtggcgctcaacttcatcctcgccggccgcgacacctcctccgtggcgctctcctggttcttctggctcgtgtccacgcaccccgacgtggagcgcaagatcgtgcgcgagctctgcgccgcgctcgccgcgtcccgcggctcccacgacccggcattgtggctggcctcgcccttcaccttcgaggagctcgaccgcctcgtctacctcaaggcggcgctctcggagaccctgcgcctgtacccgtccgtcccggaggactccaagcacgtcgtcgccgacgactacctcccggacggcacgttcgtcccggcggggtcgtcggtgacctactccatctactcggcggggcgcatgaagacggtgtggggggaggactgcctcgagttccgccccgagcggtggctgcccgccgacggcgctcgcttcgagccgcacgactcgtaccggttcgtggcgttcaacgccgggccgaggatctgcctgggcaaggacctggcgtacctgcagataaagaacatcgccggcagcgtgctcctccgccaccgcctggccgtcgtgccgggccaccgcgtggagcagaagatgtccctcacgctgttcatgaagcacgggctccggatggaggtgcgcccgcgcgacctggccccggtcatcgacgagctccgcggcgccggcgcggcggcaatgccgaccacggcgccctgcgcgtagaggatccgggggtcccgtgcgccaagatccgtgctgccgaggagacaccgagcattcaatgttgttgataagcgtacaggacagtaagtaaattaaatgggtctggtgagagcattcaagtcacttccttcgttccgcaatttaccattctgatgagggagatggggaaattttgcaattggcaagatctaagctagatttggatccgggcatgtactactaccacaaattaaaaggggtgaaacaaaagggagagtaaaaaaaaagatagagtaataattcaggatcgagtgctgcagattatttggtcgaggcagttcgtgttggtggccagccaactgttctactattattctttctttatttaatttttttaatgtttttcagtactattatattcctagagagctgttcagtttaccaagaaacatgtaaagtaaacgtgtactgaaccttgttttgcttctctgagaccatcattttcatgggc

SEQ ID NO: 18426 - protein, 538 aa, Panicum virgatum
  misc_feature: Ceres CLONE 1796921
  misc_feature (29)..(513): Pfam Name: p450 Pfam Description: Cytochrome P450
  misc_feature: SWISSPROT Homolog: EC 1.14.13.30 Leukotriene-B(4) 20-monooxygenase
MEVGTWAVVVAAAAAAAYLAWFWRLSRGLSGPRVWPVLGSLPGLVQHAEDMHEWIAGNLRRTGGTYQTCIFAVPGVARRGGLVTVTCDPRNLEHVLKAHFDNYPKGPFWHAVFRDLLGDGIFNSDGDTWVAQRKTAALEFTTRTLRTAMSRWVSRSIHLRLLPILEEAASDKTQHVDLQDLLLRLTFDNICGLAFGKDPETLAPGLPENAFASAFDRATEATLNRFIFPECLWRCKKWLGLGMETTLARSVAHVDEYLAAVIKARKLELAPGNGSRCDAAHDDLLSRFMRKGSYSDESLQHVALNFILAGRDTSSVALSWFFWLVSTHPDVERKIVRELCAALAASRGSHDPALWLASPFTFEELDRLVYLKAALSETLRLYPSVPEDSKHVVADDYLPDGTFVPAGSSVTYSIYSAGRMKTVWGEDCLEFRPERWLPADGARFEPHDSYRFVAFNAGPRICLGKDLAYLQIKNIAGSVLLRHRLAVVPGHRVEQKMSLTLFMKHGLRMEVRPRDLAPVIDELRGAGAAAMPTTAPCA

SEQ ID NO: 18427 - DNA, 2333 bp, Panicum virgatum
  misc_feature: Ceres CLONE 1796928
  misc_feature: Encodes the peptide sequence at SEQ ID NO. 18428
actcttcaacttcaaaggctcaaagctcagagagagagagagagagctctactgcctcaggcattctttgtcacaggggtcgaggggacagagacagagggctgaggatcacatggtgcccctttttttgggtatgtgacagcttctgcttttagtcttttagtgcttccttttatctccccttcatgaaacccctttcaaaacctcaaatcaccacctcatcggctgatcagtgattgccttctcctgctcctttaagaaccctcttccctgccctcatttttcttcatccctcacctgtgcccaaaaggcaagaacaaagcaatatgatgctctgatcgcttcgccgaccgccatcgtgatcctacacattctggtgacgcaccaagataatacacaacccctctgcttttactgccctccatattacaagaggcagccccaggaattgctcacgccatggaggtttccatgctctgcacaagagttagcctgctcatcctcatcctctccctctgctctccatacaagttcatacagagccccatggacttcggccccttgaacctgctccccaccaccaccactgcgtccagcgattttggtaggatacttttccacgctccagccgcagtgctgaagccccagtcctcaagggacatctccctgcttctcagcttcctatctggctcgtctctgagcaaggtcacggtggcggccaggggagcaggtcactccattcatggccaggcccaggctctagatggcattgtggtggagatgtgctctttgcctgccgagatagaattctacaaaggaggagaaatatcgtatgctgatgtgagtggtggggttatgtggatagacctcctggagcagagcttgaagcttgggttagctccaagatcatggactgactacctctatctcaccgttggcggaacgctgtccaatgctggcatcagtgggcagacatttaagcacggtcctcagattagtaatgttctacagctggaggtagtcacaggacgaggggagattgtgacatgctcacccagcaaggatgcggatttgttcaatgcggttctgggaggtcttggccagtttggcatcataactagggccaggatcctgctgcaggaagctccacagaaagtgaggtgggtgagagccttttatgatgatttcaacaccttcaccaaggaccaggagttgctggtatccatgccggatttggtagactatgtggaaggtttcatagtcttgaatgaacaatcccttcacagctcctccatcgccttccctgcaaatgtggacttcaacccagattttggcaccaagaaaagccctaacatttactactgcatggagtttgcagtccatgattaccagcacaagaacactgatgtggagcagattgtggaagttatctcaaggcagatgagccacatggtgtcccacttgtacactgtggaggtgtcctacttcgattttctcaatcgggtcaggatggaagagatgagcctaaggagcatcgggctgtgggaggtacaccacccatggctcaacatgtttgtgccaaaggcggggatcaacgacttcagggacctgctcatggacaacgtttcaccagatagctttgagggcctgatcctcatctacccactcctcagagacaagtaggacaccaacacatcggtcgtgctgccagattccggatccacggagcgggtgatgtacgtggtgggcatcctcaggtccgcaaaccctgaaggtggctgctcccaccactgcctccaagagctcctccgccgccaccgccgcatcgccgacacggctggagttcacctcggcgccaaacagtacttggctcaccacccgactccgtcgggttggcaccagcactttggctggcggtgggagcggttcgcggagcgcaagacccggttcgacccgctacgcatcctggggccgggccaaggcatattccccaggagagacgacagtgccgcgtatgggagctagctttagccggcagaaagtgaataagggatgtaggcagctgactaggatgcgatcttgttctttctttttctagatcttctcttgagtttcctcggcaattttgaggcaccggttgggttattctgtgggagtgggggggcactttgagtttgagaggacccggtggtgaatatcacggggaattttggaactttgtacaggctgaggaagcacaagctctagggatagagatagtgattctattcgatctgtattccttgttcgacgtggacagtagtagggttattattgactttttactgttgttc

SEQ ID NO: 18428 - protein, 407 aa, Panicum virgatum
  misc_feature: Ceres CLONE 1796928
  misc_feature (230)..(407): Pfam Name: Cytokin-bind Pfam Description: Cytokinin dehydrogenase 1, FAD and cytokinin binding
  misc_feature (56)..(198): Pfam Name: FAD_binding_4 Pfam Description: FAD binding domain
  misc_feature: SWISSPROT Homolog: EC 1.5.99.12 Cytokinin dehydrogenase
MEVSMLCTRVSLLILILSLCSPYKFIQSPMDFGPLNLLPTTTTASSDFGRILFHAPAAVLKPQSSRDISLLLSFLSGSSLSKVTVAARGAGHSIHGQAQALDGIVVEMCSLPAEIEFYKGGEISYADVSGGVMWIDLLEQSLKLGLAPRSWTDYLYLTVGGTLSNAGISGQTFKHGPQISNVLQLEVVTGRGEIVTCSPSKDADLFNAVLGGLGQFGIITRARILLQEAPQKVRWVRAFYDDFNTFTKDQELLVSMPDLVDYVEGFIVLNEQSLHSSSIAFPANVDFNPDFGTKKSPNIYYCMEFAVHDYQHKNTDVEQIVEVISRQMSHMVSHLYTVEVSYFDFLNRVRMEEMSLRSIGLWEVHHPWLNMFVPKAGINDFRDLLMDNVSPDSFEGLILIYPLLRDK

SEQ ID NO: 18429 - DNA, 1545 bp, Panicum virgatum
  misc_feature: Ceres CLONE 1796933
  misc_feature: Encodes the peptide sequence at SEQ ID NO. 18430
atccgtttggcccacacgctccccctcttctctcaccccggcgtcgctagggttttgagttttgactcctaaaccgcgacgccatgatgcagccgccgccgccggcacagcagcaggtatgggcaatggcgcccccgcccccgccgcagtactaccaggcggggcaccccccaccgccgcccccgcagttctaccaggcggggcctccgccgcccgccatgtggggccagccgccgccgcaggcggcgcccgcgccggcgcccgcgccggcaccgtccggaggtgcgggaggggacgaggccaggaccctctggattggggacttgcagtactggatggacgagaactacctctacagctgcttctcccaggccggcgaggttatttcagtgaagataattcggaacaagcagactgggcaacctgagggttatggttttattgaatttggcaaccatgctttagctgaacaagttctccagaattataatggtcaaatgatgcctaatggcaaccaacctttcaaattgaattgggctacaagcagggctggtgagaaacgtggagatgatggttcagattatactatatttgttggggatctggcctcggatgttacagatttcattctacaagatacattcaagagtcgttatccatcagttaacggcgcaaaagttgtctttgacagaactaccggccgctcaaaaggctatggttttgttaaatttggagatttggatgaacagacacgagcaatgactgaaatgaatggccaatactgttctagcaggcccatgcgccttggaccagcatccaacaagaagaataccggtggacaacaacaggcatcaagtgctacataccagaatacacaaggaactgattctgacaatgatccaaacaatactactgtatttgttggtggtcttgacccgagtgtgactgatgagcttctgaggcaaactttcagtccatatggagagcttctctatgtcaaaatacctgtaggaaagcgctgtggatttgtccaatattctaacagggcatcagctgaggaggccataagggtgctaaatggaacccagttaggaggccagagcgtaaggctctcatggggtcgtagccctgcaaacaagcagcctcagcaagagcagaaccaatggagcagcggctactatgggtatccccaaggatacgatccatatggttatgctcggcctcctcaagatcctgccatgtatgcttatacagcatatccagggtatggaaattaccagcagcagccaccacagcagcccccgccacaacagtaagaataatggctcgggaggatcatcattcgcaagctggcaatggagtagttgggcagcaacttaggtgcattggcatgagaaactatgtgactgttgcttgtgttatattgctccaacgtccttgtacacgtagcctgtgttgtaacttgagattttgctgaggcctagagtgactagtgtttcagctgtaactggtcagacatttttccactgttcaagaagttttgtc

SEQ ID NO: 18430 - protein, 365 aa, Panicum virgatum
  misc_feature: Ceres CLONE 1796933
  misc_feature (233)..(298): Pfam Name: RRM_1 Pfam Description: RNA recognition motif. (a.k.a. RRM, RBD, or RNP domain)
  misc_feature (124)..(196): Pfam Name: RRM_1 Pfam Description: RNA recognition motif. (a.k.a. RRM, RBD, or RNP domain)
  misc_feature (31)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 536 in the 10/666,642 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: Functional homolog of the protein sequence given in SEQ ID NO 50786
  misc_feature: Useful for making plants with altered terpenoid content
MWGQPPPQAAPAPAPAPAPSGGAGGDEARTLWIGDLQYWMDENYLYSCFSQAGEVISVKIIRNKQTGQPEGYGFIEFGNHALAEQVLQNYNGQMMPNGNQPFKLNWATSRAGEKRGDDGSDYTIFVGDLASDVTDFILQDTFKSRYPSVNGAKVVFDRTTGRSKGYGFVKFGDLDEQTRAMTEMNGQYCSSRPMRLGPASNKKNTGGQQQASSATYQNTQGTDSDNDPNNTTVFVGGLDPSVTDELLRQTFSPYGELLYVKIPVGKRCGFVQYSNRASAEEAIRVLNGTQLGGQSVRLSWGRSPANKQPQQEQNQWSSGYYGYPQGYDPYGYARPPQDPAMYAYTAYPGYGNYQQQPPQQPPPQQ

SEQ ID NO: 18431 - DNA, 1155 bp, Panicum virgatum
  misc_feature: Ceres CLONE 1796935
  misc_feature: Encodes the peptide sequence at SEQ ID NO. 18432
acaaactcatttcaaaccctcttcttagtttgcctcccaaaaaaaaaacacttagcgcccctcctcgcggcaacacgatgctcaccacagcacacagccggcagcatcatcacgccttcgagaagagccctagcagccacatgaagaacctcgacaggaagctgcagcaggccatgagcaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgcttctgtatggcggcaccttcagcccctggggcgatgtgctggtgtctctggagatgaggagagaggaggacgacaaggccagcgaccacgacgttgaagggggtgaggacttcgattgcagcgagccggggagcttgcataggtgcagctggatcaccaagaacagtgccgcctcttcgagcttctgtcgctgtccgggatgctcatagactacaactggaccgagatactcaagaggcgagacatgtacagggaggtgttcgccgacttcgaccccagcacggtggccaagatggacgaggacgccgtcgccgaaatcagcggcaacaaggagctcaagctggccgagtccagggtccggtgcatcgtcgagaacgccaagtgcatccagaaggtggccaaggaattcgggtcgttcagcgggtacatgtgggggcacgtgaaccaccggccggtggtgggcaagtacaggcaccacaagtacatcccgttccggacgcccaagtcggaggcggtgagcaaggacctcgtccgccggggcttccgcctcgtcggccccgtcatcgtctactccttcatgcaggcagccggcatggccatcgaccacctcgtcgactgcttccgcttcccggagtgcgtccgcctcgccgagcgatcctggggcatcaccaacatcgccgcgtagccgccggccggccggtcgtcggaggcgtgctcggtcgctcggcgctccatttttttttttttttacaccttctggtgtgacttccttcaagtgtgtgtgaactgtaaagtagtacagtaaatgctaagttatgatgtgat

SEQ ID NO: 18432 - protein, 161 aa, Panicum virgatum
  misc_feature: Ceres CLONE 1796935
  misc_feature (2)..(145): Pfam Name: Adenine_glyco Pfam Description: Methyladenine glycosylase
  misc_feature: SWISSPROT Homolog: EC 3.2.2.20 DNA-3-methyladenine glycosylase I
MLIDYNWTEILKRRDMYREVFADFDPSTVAKMDEDAVAEISGNKELKLAESRVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 18433 - DNA, 1483 bp, Panicum virgatum
  misc_feature: Ceres CLONE 1796939
  misc_feature: Encodes the peptide sequence at SEQ ID NO. 18434
aggaacgggcgctgccgagctcgcgccacccatcgccgatggcgtcctccactctcgccgctccccccttcctcccgactcttcccgccccaaaccccagtaagcgagtgtccatccgaacctccgttcgccgtctccccgtcgcagcctccgcggccccttcgggcgccgctgcggcggcgagggagcgcaggcgcttcctggagccgtacgggctcaaccccgacgacttcgaggatgacgcggaggaggacccaagggaagagaggaggagggataggcgggggcggcggcggtcggggagaggggaggaggccgcggaggcttcggttgctccgtcgaaagcgacggagcctcgggagactcacaaattgcttcaggtgctaggtggaaaagtccgtagaagaaaattactttcacccaaagataggaatgttcgtccaatgatggaagtagtccgaggagcagcctttgacattttgcagtcagctggtggttctcctgcttcactcagaccaggtcggtggttagacttgtatagtggtactggatctgttggaatcgaagctatgagccgaggatgttcagaggcacattttgttgagatggatccttgggttatctcggaggttcttaaaccaaatctggagtgtactggatttcttgatgtctcacagatacatatgcttcgtgttgaaaattttttggccaatgccgaaaaatctcaaggtaaatatccttcctttgattatattagtgtaacaccaccatatctggaggtcaactatagcacactactcgatcaactttcaaggtcaccattggttggaaaagattgtttcattctagttgagtacccactgaaaacagatatggctgaatcctgcggaaaccttataaagatagctgacaggaggtttggtagaaccaacttgttaatatacgggccaacatggtcagagaaaaagagaagaacttgagataatttctgaagcatcaaggcaacacacaagatatatacttgatgacgagaaatgaggttgttacatcatatcatcgcctgccaagaattgataccaccgttgggcgaggttaagctttcaacttctgtaccagagataactgacctagcgcataggaaaaacgtcattcacggtgcattaagagatcatacgtctctttcattccggttcactgatcggcatcccagaatgaaaaaaatggccatctgccttccaagcatcagcatcaggtcacatttcataacaccttgggaaagagatgcctgactgtacgttgctattgctatgctaattgagtaactgatgccgcatctagtattcttttgagaaggcttgtacacttccataattgtatcaagcgtgcccgtattttgtgtcctgtatgatcaaaagtgcctatatgtaaatcaggtacgccggttcaacctgcagcttttagtctgttaacaatagcttaacgc

SEQ ID NO: 18434 - protein, 313 aa, Panicum virgatum
  misc_feature: Ceres CLONE 1796939
  misc_feature (113)..(303): Pfam Name: Cons_hypoth95 Pfam Description: Conserved hypothetical protein 95
  misc_feature: SWISSPROT Homolog: EC 2.1.1.52 rRNA (guanine-N(2)-)-methyltransferase
MASSTLAAPPFLPTLPAPNPSKRVSIRTSVRRLPVAASAAPSGAAAAARERRRFLEPYGLNPDDFEDDAEEDPREERRRDRRGRRRSGRGEEAAEASVAPSKATEPRETHKLLQVLGGKVRRRKLLSPKDRNVRPMMEVVRGAAFDILQSAGGSPASLRPGRWLDLYSGTGSVGIEAMSRGCSEAHFVEMDPWVISEVLKPNLECTGFLDVSQIHMLRVENFLANAEKSQGKYPSFDYISVTPPYLEVNYSTLLDQLSRSPLVGKDCFILVEYPLKTDMAESCGNLIKIADRRFGRTNLLIYGPTWSEKKRRT

SEQ ID NO: 18435 - DNA, 571 bp, Panicum virgatum
  misc_feature: Ceres CLONE 1796953
  misc_feature: Encodes the peptide sequence at SEQ ID NO. 18436
gtacacttctgcacttcaagatctaacaaaagatcccccgccccacccacccccacccccaatccatcctctccttcctcgcagatcccaccaaccccggcggcgatgaccggcacagtgtcgaagctggcggcgccccggccggcggcggcgctgctcccgccggcgtccctccgctccgccgccctcgccttcgccccctccccgcgccggttccgcgtctccatcgccggccgcgccaggagccccgtcattgcgatggcttctgccaaggaagggaatggtgctccgaccaagaagaccgcacttcacgatctctatgagctccagggcctgtcaccatggtacgacaacctctgcaggcctgtcactgacttgctgccccttatcgccagtggtgttcgcggagtcaccagcaaccctacgattttccagaaagccatttcatcatcaagcgcatatgatgatcaattcaagcagctcattacagctggaaaggatgcagagagtgcttactgagaactcgttataaaggatatccaagatgcgtgcgaactttttgagcctatct

SEQ ID NO: 18436 - protein, 137 aa, Panicum virgatum
  misc_feature: Ceres CLONE 1796953
  misc_feature: SWISSPROT Homolog: EC 2.2.1.2 Transaldolase
MTGTVSKLAAPRPAAALLPPASLRSAALAFAPSPRRFRVSIAGRARSPVIAMASAKEGNGAPTKKTALHDLYELQGLSPWYDNLCRPVTDLLPLIASGVRGVTSNPTIFQKAISSSSAYDDQFKQLITAGKDAESAY

SEQ ID NO: 18437 - DNA, 2274 bp, Panicum virgatum
  misc_feature: Ceres CLONE 1796990
  misc_feature: Encodes the peptide sequence at SEQ ID NO. 18438
atccagcttccagccgtcctggagacctgaagtagccgcgccatagcccggccggtatcacttgtctcatcacaaacagttcgccgtacggccggggatccatggcaaaggagatcaggacgacgtgaattgaagggcgatgatggcctcgccgtcgccgcacatgatgttgttgttattcctcacatcagctctactagcagcagccgtgcggccagcaacgagctcgtcgtcgtcgccgccgtccggcacctcgccggagcccgtaccgaccttctgctccgggcaggctcctgactccaacaactcctcctcctccccggctgtcgacgccgtgttccgcgaggacgagtacacggcgaccgtcgtgttcaacgcgacccgccgagcgccgctgccgtaccggcgtggcggcaaggcggcggtgaggcgcctcctcgccgccgccgcgagcggcacgacgagcagccacatgtgccgcggcgccggcgcgagcagggccggcgctggcctgatgatgtacggcctcacgcggtgcgccgccgggacgccgtgcgacgactgccgccgctgccttcgcggcgcgctcgcggcggtcgagaaggggtacaacggcagcacggggatgcaggtcctgcggctcagctgcatggccaggtacgagagctatcccttctacaacgccacgaccgtgaggaggcgcgcgtttgagcaggccagcggtacgggagcagtcatggggccgcgtttgcctgcgccggctacacatcctcctccccttgcgccgccccctgacggtcataccccaccaccgcgtttgcctccgccggctgcagtacatagtccccttgcgccccctgcaggttattcgccacggcctccaccagccgcatcgcccgttgaaacacagctcgcgcaacaaagccacgggaagaagacgccgaagacactcataatgctgatcctttctattgcaaccggaatagtggttatcaccgtcatccttcttgtacacatctggtatcgtcgtcgaaagcattcaaataagatgcaacatgtcgtagctggcattccaggtgagaacatgtatgaccaagaagacgggcaatggagcatggaagatgaagaggacaaggatggagagagaatgacctgccaactctacagctaccaagttcttgaggctgcaacatgtcacttctcaaatagaaacaagctagggagtggtggatttggaacagtgtacaagggcatacttgagaacggaagagaagtggcggtgaaaagactcagggattccaagcggaacctgcaagaacttgagagggagatctccatcgtggccactttgtgccataagaacctcgttaggtttttagggtactgcttccaagacgaagggaagtttctcgtctacgagtatgtacccaataatagcctcgacaaattcgggtacaaagcatgttcccagtcacagaagctagaatgggctacatggttcaacatcatcttaggggtcgcccgtggcctccagtttctccatgacaagggaatcattcatagagatttgaagccacacaatgtacttctcgatgaaaacgtcacccccaagatcgccgacttcgatctcatgaggacgtacgataaacagaagacccacgagagcacggagaaggtcgccggaacatttggttacatagcgcccgaatgcacgtccggccggaagttcctgctgtcgatcaagtccgacgtgtacagctacggcgtcctggtgctggaggtcatcaccggccacaagatctacacgttcgaaggccaaaaatccgaaggcctcgtcgaatacgtgtggcagcactgggaagagaagagagcaggagacatcatggacggcgacctgctgggcgtcgcgggccaggagctcgcggcgcggcaggcacagaggtgcgtgcacgtcgcgctgctctgcgtgcagtcagatcagtcaaggaggccgaccatggggcaggtcatcgccatgctgacaagtgacgacggcgggatggagctgccagagccgtctctgcccgggtaccttgtcgtcgtccacccaagggctctggtccggctgccatgtctcgggtgtaggtagctagggatgaaaatgaaaatggtaatttcgaagtatcagaaatcgttttcgagattttatcgatttttgtggctaaacggaaactgtagcggttaccgtgaaaacggaaacggaatcggtaatgcaatccgaaaatgagaatgttt

SEQ ID NO: 18438 - protein, 661 aa, Panicum virgatum
  misc_feature: Ceres CLONE 1796990
  misc_feature (353)..(626): Pfam Name: Pkinase Pfam Description: Protein kinase domain
  misc_feature: SWISSPROT Homolog: EC 2.7.11.1 Non-specific serine/threonine protein kinase
MASPSPHMMLLLFLTSALLAAAVRPATSSSSSPPSGTSPEPVPTFCSGQAPDSNNSSSSPAVDAVFREDEYTATVVFNATRRAPLPYRRGGKAAVRRLLAAAASGTTSSHMCRGAGASRAGAGLMMYGLTRCAAGTPCDDCRRCLRGALAAVEKGYNGSTGMQVLRLSCMARYESYPFYNATTVRRRAFEQASGTGAVMGPRLPAPATHPPPLAPPPDGHTPPPRLPPPAAVHSPLAPPAGYSPRPPPAASPVETQLAQQSHGKKTPKTLIMLILSIATGIVVITVILLVHIWYRRRKHSNKMQHVVAGIPGENMYDQEDGQWSMEDEEDKDGERMTCQLYSYQVLEAATCHFSNRNKLGSGGFGTVYKGILENGREVAVKRLRDSKRNLQELEREISIVATLCHKNLVRFLGYCFQDEGKFLVYEYVPNNSLDKFGYKACSQSQKLEWATWFNIILGVARGLQFLHDKGIIHRDLKPHNVLLDENVTPKIADFDLMRTYDKQKTHESTEKVAGTFGYIAPECTSGRKFLLSIKSDVYSYGVLVLEVITGHKIYTFEGQKSEGLVEYVWQHWEEKRAGDIMDGDLLGVAGQELAARQAQRCVHVALLCVQSDQSRRPTMGQVIAMLTSDDGGMELPEPSLPGYLVVVHPRALVRLPCLGCR

SEQ ID NO: 18439 - DNA, 2373 bp, Panicum virgatum
  misc_feature: Ceres CLONE 1797006
  misc_feature: Encodes the peptide sequence at SEQ ID NO. 18440
cccgtcggtgcccacccacggagctccagctaccagctcactcccactccactcgagcagctcgcgctccaaggtcgggctcggctgggctgggttccttcgccagggaggcgccatgaagtacagcaaggaggacaagcccgagagggcgggcggcgccggcgcggggggcagggcggtgccggtggcgctcctcgtcatcgtgctctgcgccttctccttctacctcggcggcgtctacagcacgggccgcagcctcctcgattccatccagccggcgccgactctcctcgccctcggcaccaccgccacccagcaatcctccgccctggtccagccagcaccgtccaccacggccacggcgctcgcggcggtgtcgttccccgagtgccccgccgacttccaggactacaccccctgcaccgaccccaggctctggcggcgctacggcaactaccgcctcagcttcatggagcgccactgcccgccgccgccggagcggcagcagtgcctcgtcccgccgcccaaggggtacaagccgcccatccgctggcccaagagcaaggaccagtgctggtaccgcaacgtcccctacgactggatcaacagccagaagtccaaccagcactggctcgccaaggacggcgaccgcttccgcttccccggcggcggcaccatgttccccaacggcgtcggcgcctacgtcgacgccatgcgggcgctcatcccggggatgcgcgacggcaccgtccgcaccgcgctcgacaccggctgcggcgtcgccagctggggcggcgacctgctcgcccgcggcatcctcaccgtctccctcgcgccgcgggacaaccacgaggcgcaggtgcagttcgcgctcgagcgcggcatcccggccatcctcggcatcatctccacgcagcgcctgcccttcccgtcggcggccttcgacatggcgcactgctcgcgctgcctcatcccctggaccgagttcggcggcctctacctcctcgagatccaccgcgtcctccgccccggcggcttctgggtgctctccggcccgcccatcaactacgagaaccgctggcacggctggaacaccaccgcgcaggcgcagaaggccgacctcgaccgcctcaagaagatgctcgccgccatgtgcttcaagctctacaacatcaagggcgacatcgccgtctggcagaagtcgcccgacgccaccgcctgctacgacaagctcacgcccatcaccacgccggccaagtgcgacgacagcgtcgacccggacgccgcctggtacgtgcccatgcggtcctgcgtcaccgcccccagcgcgaggtacaagaagctgggactcaacgccacgcccaagtggccgcagcgcctcaccgtcgcgccggagcgcatcaacgtcgtccccggcagcagcgccggcgccttcaagcaggacgacgccaagtggaagctcaggaccaagcactacaaaacgctgctgccagcgctcgggaccgacaagatcaggaacgtcatggacatgaacacggtctatggaggattcgcggccagcatcatcaaggaccccgtctgggtcatgaacgtcgtctcctcttacgggcccaactcgctcggcgtcgtctacgacagaggcctcatcggcgtcaaccacgactggtgtgaggcattctcgacatacccacgcacctatgatcttttgcatcttgatggcctcttcactgaagagtctcacaggtgcgagatgaagtttgtacttcttgagatggaccgcatccttcgccccacgggttatgcgataatcagggagagcacctacttcctggattctgtagcagccattgccaaaggaatgagatggagctgtgagaggcgtaaccctgaaaacaagactgacaaggacaagatcctaatctgccagaagaagctttgggcaggaaagcagtgagagggaattgtttgatccaagtataaaaagaaagaatccttaacctggatggatgatttgttgatccagtcaatggtatacggctcaaatgtgctgtgacctcagccacctaggcaaaggcgcttcaccatctggtacacatgaaacatgaacactctgatgtacaagaatgttcacagttaagataaataagagtaaacctccgtataggatccaaaagttagtactatttgccattaatcacacagttaattcttttttgtacgaacagttaggggtgggtggttgataccaagagcaactgtaagttactccacagtccacactacatgtgttcatttgtacaacatatagcttggtgctgtcattgtaatagagtgccatatttatttaaacatttatggagcaagatactactc

SEQ ID NO: 18440 - protein, 612 aa, Panicum virgatum
  misc_feature: Ceres CLONE 1797006
  misc_feature (216)..(311): Pfam Name: Methyltransf_11 Pfam Description: Methyltransferase domain
  misc_feature: SWISSPROT Homolog: EC 2.1.1.41 Sterol 24-C-methyltransferase
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
MKYSKEDKPERAGGAGAGGRAVPVALLVIVLCAFSFYLGGVYSTGRSLLDSIQPAPTLLALGTTATQQSSALVQPAPSTTATALAAVSFPECPADFQDYTPCTDPRLWRRYGNYRLSFMERHCPPPPERQQCLVPPPKGYKPPIRWPKSKDQCWYRNVPYDWINSQKSNQHWLAKDGDRFRFPGGGTMFPNGVGAYVDAMRALIPGMRDGTVRTALDTGCGVASWGGDLLARGILTVSLAPRDNHEAQVQFALERGIPAILGIISTQRLPFPSAAFDMAHCSRCLIPWTEFGGLYLLEIHRVLRPGGFWVLSGPPINYENRWHGWNTTAQAQKADLDRLKKMLAAMCFKLYNIKGDIAVWQKSPDATACYDKLTPITTPAKCDDSVDPDAAWYVPMRSCVTAPSARYKKLGLNATPKWPQRLTVAPERINVVPGSSAGAFKQDDAKWKLRTKHYKTLLPALGTDKIRNVMDMNTVYGGFAASIIKDPVWVMNVVSSYGPNSLGVVYDRGLIGVNHDWCEAFSTYPRTYDLLHLDGLFTEESHRCEMKFVLLEMDRILRPTGYAIIRESTYFLDSVAAIAKGMRWSCERRNPENKTDKDKILICQKKLWAGKQ

SEQ ID NO: 18441 - DNA, 701 bp, Panicum virgatum
  misc_feature: Ceres CLONE 1797007
  misc_feature: Encodes the peptide sequence at SEQ ID NO. 18442
aacagaatcgctagctttttgccaacgaccaagaggtagcgagctcctgctcctcacgtttgtagtgtgagccatcctactctacggcagcaataaccaaagagccaaagcaaagctccaagtgatcgacctgcaactactcgagctaattaactggcttattggtagctcagacagaagccgggtggcggcggcgggcgatcggcggcgagcgcatgggcaacgccctggggtgcgccggactcggcgagcggctggcggccgccgcgagggacggcgacgcggcggaggtgcgacggctgctggaggcgaacccggggcacgcgcggtgcgccgccttcggcagcctcaactcgccgctccacctcgccgccgccaaaggacaccacgagatcgctgcgttgctgctgcagaacggagctgacgcgaacgcccgaaacatttacggacaagtgtcgaaggtggacagcctcagcagccggacggcgctgcacctcgcggcggccggcgggcacgtcaagtgcgccaggctgctgctggccgcggccgccggcgacggcggccggttcgtgaacagggcgggcagcggcggcgtcacggcgctgcacctcgcggcgctgcacggccacgccgactgcgtgcacctgctcatcgacgagcacgccgacctcgccgcgcagaccctcccctgcgtcgcgtcg

SEQ ID NO: 18442 - protein, 161 aa, Panicum virgatum
  misc_feature: Ceres CLONE 1797007
  misc_feature (44)..(76): Pfam Name: Ank Pfam Description: Ankyrin repeat
  misc_feature (125)..(157): Pfam Name: Ank Pfam Description: Ankyrin repeat
  misc_feature: SWISSPROT Homolog: EC 2.7.11.1 Non-specific serine/threonine protein kinase
MGNALGCAGLGERLAAAARDGDAAEVRRLLEANPGHARCAAFGSLNSPLHLAAAKGHHEIAALLLQNGADANARNIYGQVSKVDSLSSRTALHLAAAGGHVKCARLLLAAAAGDGGRFVNRAGSGGVTALHLAALHGHADCVHLLIDEHADLAAQTLPCVA

SEQ ID NO: 18443 - DNA, 669 bp, Panicum virgatum
  misc_feature: Ceres CLONE 1797007-R
aggcacgagctgtgcgtcaagtgcgcgctggacctgtgctcggtgatcaagtcctacgacgtgccggggatcgccggaagcatcccgtgcccgctctgccggagcgcgatcgcctcgttcaggaaacgggcagcctcggaagcagaggacgggctcgagcctgacctgagcgccgcctgctccggcggcggccactgcaagagctgcagcagcgccggcgaccaccaggcgtcgtccagcccggagaagaaacggagcacggattcggatcagcccatcggcatcctccccctctactctcctcccgccgtcctgtcctgaaggtcgtcagggttgcagttgcagctcgatgcgtgttagcagatgcagaggagctgcatcaccattagaacaatgtgcagtattatgcaagtacagataggtagattgctcagggacagacagattgtttgattctcttgcgttcgttgtgctaatcgatggcatttgcagatcattttatggcggtgtacatagtatgggtgtaacgtgtacgtctgattggtttgttgtagagtggttgtgttgtagaaaggaactaaaaagaaagaacattctttgctgtaaaaggttctggattttgactcaggatcctttgtttctgttgaagaatttgtggaattggaatat

SEQ ID NO: 18444 - DNA, 2321 bp, Panicum virgatum
  misc_feature: Ceres CLONE 1797009
  misc_feature: Encodes the peptide sequence at SEQ ID NO. 18445
gaagacgagccgaggctggccgctggcctctcgttgcctcccccgcgccccggcggcccccgtccggccatccgcggcctccctccccttcccccgcttcccgattccagctcacaatcgcaacgccgccgccgtcgctgacctcgcgcgggcacgagccgattcaccaccgctcgcgcccctccttcctgcatccgcgcaagcgcaatccctccccttcgctaagctgttgggatagataggcctaataacaatctgacataagcaccgccattgtctccgccccgcggaggagggcggcgcctgcgccatggcgtttctattcggcgctttcctgggcctggtggtgggcgtggccgtggtgatggcgttcgcgcgcctcgagaacgcccgcgcggagcagcgccgcgagctggctgctatagttgcatctttctcaaagttgaatgtacaggatttgaggaaactcatcccacctgagttctatccatcatgggtttcattcacacaaaagcagaagctgaaatggctgaaccaagagttagtaaaaatctttccatttgtcaatgaggctgcatcagagctgattaaagcttccgtggaacctgtttttgagcagtacaagtcattcattttggcttccctccatttctcaaagttgacgcttggtactgttgcccctcagtttactggagttgaaatcttggagagtgatgattctgcaatcaccatggaacttgagttgcaatgggatggcaatcccaatatagtacttgacatccaaacaacacttggaatttctcttcctgtacaggtgaaaaatattggattcacaggagtacttcgccttgtattcaaacctctggtggctgaattcccgtgttttggagctgtttgctgttctttaagggataagagcaaggtggaatttaccctcaaggttattggcggcgaaatgactgctattccaggaatctctgatgcaattgaggggacaatacgtgatactattgaggatacactgacatggccgaatcgcattattgttccaattgtacctggagactatagtgatttggagctgagacctgttggggtattagaagtgaaacttgtggaagctagggacctgaagaacaaggatctcgtgggaaagtcggaccctttcgctgtgttatacatacgtccattgcacgagaaaacaaaaaaaagcaaaacaattaacaatgatttgaaccccatctggaatgagcactatgaatttgaggtcgaggacatatctacacagcacctgactataaaaatctatgatgatgaagggctccaaccatcagagatcattggttgtgttcgggtagacttagccgatctacagccaggaaaagtgaaggatttatggttagatcttgtgaaggacttggaaattcaacgggacaaaaaacctcgtggtcaggttcacctggagcttctctactacccttacgctaaacatgaaggggtttccaatccttttgctaatcagattcaactgacttctttggagaaagttctcaagactgaatctaatggatatgatattaaccagaggaaaaatgttattatgagaggagttttttctgtaacagttatatctgcagaggacttgccaccaatggacattggtggcaaggctgacccatttgttgtcctgtacttaaagaagggagaaactaaaaagaagacaagggttgtgacagacacgctatatccaatatggaaccagacatttgattttgtggtagaagatgcactgcatgatttgctcatggtggaactatgggaccatgatacatttggaaaggattacgtagggaggtgcatcttgaccctcacaagagttctactggaaggccagttccaagatacctttgtcttgcaaggttccaaatctggaaagctgaacttgcactttaagtggatgccacagccaatctaccgtgatcgtgaacgggaccagtgaaatatgaatataccttaaatggaaaggaagataaacacatcatcccctacgatggacctgtacagcaaatccacaaacttggagccacacggttaaaatcaaagaacagatcgaccttctatagtttcccctagacgatggagatgcatgaacccgatgagaagtagtacttgacacgggtgacttgtgttagatccaatgttcatttatgtagactgatccttagcatagtcagttgttaaatgtggtgtcaatgaactaagccttgtatgctgcttttgtgcgtattaaaaaaaatgtgcgcaaaagttagatagttctt

SEQ ID NO: 18445 - protein, 562 aa, Panicum virgatum
  misc_feature: Ceres CLONE 1797009
  misc_feature (264)..(348): Pfam Name: C2 Pfam Description: C2 domain
  misc_feature (435)..(517): Pfam Name: C2 Pfam Description: C2 domain
  misc_feature: SWISSPROT Homolog: EC 2.7.11.13 Protein kinase C
MAFLFGAFLGLVVGVAVVMAFARLENARAEQRRELAAIVASFSKLNVQDLRKLIPPEFYPSWVSFTQKQKLKWLNQELVKIFPFVNEAASELIKASVEPVFEQYKSFILASLHFSKLTLGTVAPQFTGVEILESDDSAITMELELQWDGNPNIVLDIQTTLGISLPVQVKNIGFTGVLRLVFKPLVAEFPCFGAVCCSLRDKSKVEFTLKVIGGEMTAIPGISDAIEGTIRDTIEDTLTWPNRIIVPIVPGDYSDLELRPVGVLEVKLVEARDLKNKDLVGKSDPFAVLYIRPLHEKTKKSKTINNDLNPIWNEHYEFEVEDISTQHLTIKIYDDEGLQPSEIIGCVRVDLADLQPGKVKDLWLDLVKDLEIQRDKKPRGQVHLELLYYPYAKHEGVSNPFANQIQLTSLEKVLKTESNGYDINQRKNVIMRGVFSVTVISAEDLPPMDIGGKADPFVVLYLKKGETKKKTRVVTDTLYPIWNQTFDFVVEDALHDLLMVELWDHDTFGKDYVGRCILTLTRVLLEGQFQDTFVLQGSKSGKLNLHFKWMPQPIYRDRERDQ

SEQ ID NO: 18446 - DNA, 1485 bp, Panicum virgatum
  misc_feature: Ceres CLONE 1797015
  misc_feature: Encodes the peptide sequence at SEQ ID NO. 18447
acatggacatggctatggctgcgcgcttgggccccctcgtcctcccgcacgcggcgctcctcggctcctccgccgctgcctccacccgagctctgcctctcgccccgtcccgtgctcctcgcctcccttatcctcttcctcatttccccacctgccgccgccccgcctcctcctcctccgccgccgcctacgcggcgcgcccccgcccccgcccccgccgcgggtcgccgcgtcttctggctgtccgcgccatggcgtccgggaacccctacgccgccgagctcgccgcggccaagaaggccgtcaccctcgccgcccgcctctgccaggcagtgcaacaggacattgtgcattcaggcattcagtctaaggcggacaaaagccctgtcacagtggccgattatggatctcaaatattggtcagccttgtcttgaagatggaagtatcatctggcccgttttcattggtggctgaggaggactcggaagaattgagaaaagatggcgctgaagaaattttggaagaaattactgatcttgtcaatgaaaccatctctgattctggttcatataacatttcatttacgaaggaaggtatcctctcagcgattgatgatggaaagtccaagggaggcccaactgggagacattgggtcctagatccaatcgatggtactaaaggtttcgtaaggggtgaccaatatgcaatcgcactggccctgcttgatgaaggtaaagttgttctgggtgtattgggttgtccaaatcttcctttgtcatcaataagcaatccgaatggtagctcttcgggcggtcaagttggtgcccttttttctgctacaattggttgtggggctgaagtagagtctctagatggttctccgccacagaagattagtgtttgctccattgacaatccagtcaacgcctcattctttgaatcctatgaaagtgcacactccatgcatgatctgactggctctattgcagagaaacttggtgtcctagctcctccagttagaattgacagccaagcaaaatatggtgctatggcccgaggcgatggtgccatttacttgcgttttccacacaaaggttacaaagagaagatatgggaccatgcggctggctcaattgtcgtgactgaagctggaggtatagtaacagatgctgctgggaatgacttggatttctccaaagggagatttcttgatctcgacacaggcatcatcgcaacgaacaagcagttgatgccgtcactcctgaaggccgtccaagatgctattaaggagaagaaccaggccgcctccctcttgtaggctgtagcagtcagtgatcaacaaaaaatgttagttgcaataatgtttcatattcataccgtgtcttacatgtgcctggccttttgttgtgacattacaatttcatgttgtaccacttgtgatgaggctctttcctcttggcaatcagataatcgttctttttctt

SEQ ID NO: 18447 - protein, 355 aa, Panicum virgatum
  misc_feature: Ceres CLONE 1797015
  misc_feature (42)..(346): Pfam Name: Inositol_P Pfam Description: Inositol monophosphatase family
  misc_feature: SWISSPROT Homolog: EC 3.1.3.7 3'(2'),5'-bisphosphate nucleotidase
  misc_feature: Functional homolog of the protein sequence given in SEQ ID NO 50737
  misc_feature: Useful for making plants with modulated drought sensitivity
MASGNPYAAELAAAKKAVTLAARLCQAVQQDIVHSGIQSKADKSPVTVADYGSQILVSLVLKMEVSSGPFSLVAEEDSEELRKDGAEEILEEITDLVNETISDSGSYNISFTKEGILSAIDDGKSKGGPTGRHWVLDPIDGTKGFVRGDQYAIALALLDEGKVVLGVLGCPNLPLSSISNPNGSSSGGQVGALFSATIGCGAEVESLDGSPPQKISVCSIDNPVNASFFESYESAHSMHDLTGSIAEKLGVLAPPVRIDSQAKYGAMARGDGAIYLRFPHKGYKEKIWDHAAGSIVVTEAGGIVTDAAGNDLDFSKGRFLDLDTGIIATNKQLMPSLLKAVQDAIKEKNQAASLL

SEQ ID NO: 18448 - DNA, 504 bp, Panicum virgatum
  misc_feature: Ceres CLONE 1797020
  misc_feature: Encodes the peptide sequence at SEQ ID NO. 18449
acgtcactatgcgagctctcctctcccttatccacctgcacccgcccgcggccaccgcacccttcctcctccccacctccccggccgcctccaaaaccctcgccccgctccgcctcgtccgccgcttcgccgccatggccgccggcgccgccgaggagttcgtcaagggccgcgtcttccccaacggcgtcgccgtcatcacgctcgaccgccccaaggccctcaacgccatgaacctcgaaatggacattagatacaaggcacttcttgatgaatgggaaacaaatccaagtgtcaagtgtattctcgtggaaagcagctctccccgtttcttctcagctgggatggatattaagggtgttgccgcggaaatacaaaaggacaaaaacacaccacttgtgcaaaaggttttcacagcagaatactcgttgatttgcaagatacatgagtatgcaaaaccttatatatgcttgatggatggagtgacgatgggatttggaattg

SEQ ID NO: 18449 - protein, 165 aa, Panicum virgatum
  misc_feature: Ceres CLONE 1797020
  misc_feature: SWISSPROT Homolog: EC 3.1.2.4 3-hydroxyisobutyryl-CoA hydrolase
MRALLSLIHLHPPAATAPFLLPTSPAASKTLAPLRLVRRFAAMAAGAAEEFVKGRVFPNGVAVITLDRPKALNAMNLEMDIRYKALLDEWETNPSVKCILVESSSPRFFSAGMDIKGVAAEIQKDKNTPLVQKVFTAEYSLICKIHEYAKPYICLMDGVTMGFGI

SEQ ID NO: 18450 - DNA, 2262 bp, Panicum virgatum
  misc_feature: Ceres CLONE 1797027
  misc_feature: Encodes the peptide sequence at SEQ ID NO. 18451
cccccccccctctctctcccacgaaaaaattgccgctacgctttcggctcgaccacccccttcctcctcggagccctcccctcggcggcggcctaagaagaagagatggcggagcggctgacccgtatcgcgatcgtcagcgaggacaagtgcaagcccaagaagtgccgccaggagtgcaagaagagctgccccgtcgtcaagaccgggaagctttgcattgaagtgactccggcatcgaaacttgctttcatttctgaggagctgtgcatcggttgtggtatttgtgttaagaaatgcccatttgatgccattgatatcatcaacctcccaaaagatttggaaaaggacaccactcaccgatatgggcccaacacattcaagttgcacaggttgcctgtcccgaggcctggtcaggttttgggccttgttggaacaaatggaattggaaagtcaacagcacttaaagttttggctggcaagctgaaacctaatttgggacgcttcaaaaacccacctgattggcaggaaatccttacacacttccgtgggtctaaacttcagaactacttcacacgcatattggaagataacctcaaggcaatcattaaacctcagtatgttgaccacattccaaaagctgttcaaggaaatgtagggcaagtacttgaacagaaggatgagagggatatgaaagctgagctgtgtgttgaccttgaattaaaccaagttattgaccggaatgttggagacctgtctggtggtgagctccagagatttgcaatagcagttgttgctgtacaaaatgcggaaatttacatgtttgatgagccatcaagttaccttgatgttaagcagaggcttaaagctgcacaagttattaggtccttgcttaggcccaacagctatgtcatcgttgttgaacacgacttgagtgtcttggattacttgtccgacttcatttgctgcttgtatggaaagccaggtgcttatggggtggttaccttgccattctcggttcgagaaggcatcaacattttcttggctggatttgttccaacagaaaatcttcggttccgagatgaatctcttacatttaagattgcagagactcaagaaagtgctgaggagattgagacatatcaacgttacaagtaccctaccatgagcaaaacacagggaaatttcaagttaactgttgttgagggtgaatttactgattcccagattgtcgtgatgcttggtgaaaatggtacagggaaaactacattcatcagaatgctggctgggttgttgaagcccgacacagtggaaggaacagatattgaaattcctgaattcaatgtgtcgtacaagccccaaaagattagtccaaaatttcagaataccgtgaggcatttgcttcaccagaaaatacgcgattcttatatgcatcctcagttcgtgtctgacgtcatgaaaccactacaaattgagcaactcatggaccaggaggttgttaatttatcaggtggagaacttcaaagagttgctatatgcctctgccttggaaagcctgcagatatctatttgattgatgaaccaagtgcgtatcttgattcagagcagcgtattgttgcctcgaaggttatcaaaagattcattctccacgccaagaaaactgcatttattgttgagcacgatttcatcatggcaacctacttggctgacaaggtcattgtttatgaggggcgaccttctattgactgtacagccaacgcgccacagtctttggtatctggaatgaataagttcttatcgcaccttgacattacctttagaagagacccgaccaactataggccccgtattaacaagctgaactccacgaaggacagggagcagaagtcggctggatcctattactacctagacgactaatgagcgcgtacagaatcttctcaaggagagctttccgttcatgatctttccatgatgtggaaatgcgaggctagattgaagctgccactacatcacggcatgagacttgttgaataattggctgccaggagtcaccagttaacttataaagcagagcatgctgtgttgatagtttgatactgatgttttttttttgttggcttgatctatctatatgacaatggaagatgagatcggtgttaaaaggtgggctttgtcaggggagaatcaatcaccgctagtttctgtttatttgtaccgttgatttgccatcgagcaacttcaatcctcgatttatagatg

SEQ ID NO: 18451 - protein, 604 aa, Panicum virgatum
  misc_feature: Ceres CLONE 1797027
  misc_feature (373)..(543): Pfam Name: ABC_tran Pfam Description: ABC transporter
  misc_feature (103)..(292): Pfam Name: ABC_tran Pfam Description: ABC transporter
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
  misc_feature (66)..(284): SWISSPROT Homolog: EC 3.6.3.17 Monosaccharide-transporting ATPase
  misc_feature (356)..(542): SWISSPROT Homolog: EC 3.6.3.20 Glycerol-3-phosphate-transporting ATPase
MAERLTRIAIVSEDKCKPKKCRQECKKSCPVVKTGKLCIEVTPASKLAFISEELCIGCGICVKKCPFDAIDIINLPKDLEKDTTHRYGPNTFKLHRLPVPRPGQVLGLVGTNGIGKSTALKVLAGKLKPNLGRFKNPPDWQEILTHFRGSKLQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVVNLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLNSTKDREQKSAGSYYYLDD

SEQ ID NO: 18452 - DNA, 724 bp, Panicum virgatum
  misc_feature: Ceres CLONE 1797038
  misc_feature: Encodes the peptide sequence at SEQ ID NO. 18453
gtatcctcagttccacagtgttcccaacttcatcaccaacgcgcaacgcaaatggcctgtcacactcacaccgccctcccccttctcctcctcctccctttcctcttcgctgcggctgccgacgacgtcgtcgctcctgctccaggtccatccccaccaggcgagctcaacctgaccagcatccttgaaagtggcgggcagtactcgacgctgctccggctcctgcaggccacccggatctccgagcagctgaccagccagctcaagaactcgtacgatggcctcaccttcttcgcgcccaacgacaacgccttcaccaagctcaaaaccggcacgctgaacggcctcaccgaccagcagaagatccagctgctgctgtaccacgtcctgccccgctactacagcgtcaccaccttccagaccgccagcaacccgctgcccaccgaggcgtcgggccccggcggcatgtacagcatcaacgtgaccacaaccaccacgagccacctggtgaacatgtccacgggcgtcgtcgacgtgcccatcagcagcactctgtcggccaagttcccgctcgccgtctactccgtcgacgatgtgctgctgcccgagcagctgttcggtacgtctcacaagggcggggcgccagcgccggagcccgcgggacaggccggagcggcggctggggaggcgagcgcgcggaagaaggggtggtggtgtcccgaag

SEQ ID NO: 18453 - protein, 224 aa, Panicum virgatum
  misc_feature: Ceres CLONE 1797038
  misc_feature (50)..(185): Pfam Name: Fasciclin Pfam Description: Fasciclin domain
  misc_feature: Functional homolog of the protein sequence given in SEQ ID NO 50548
  misc_feature: Useful for making plants with altered carbohydrate content
MACHTHTALPLLLLLPFLFAAAADDVVAPAPGPSPPGELNLTSILESGGQYSTLLRLLQATRISEQLTSQLKNSYDGLTFFAPNDNAFTKLKTGTLNGLTDQQKIQLLLYHVLPRYYSVTTFQTASNPLPTEASGPGGMYSINVTTTTTSHLVNMSTGVVDVPISSTLSAKFPLAVYSVDDVLLPEQLFGTSHKGGAPAPEPAGQAGAAAGEASARKKGWWCPE

SEQ ID NO: 18454 - DNA, 689 bp, Panicum virgatum
  misc_feature: Ceres CLONE 1797038-R
  misc_feature: Encodes the peptide sequence at SEQ ID NO. 18455
gcgagaagggcgtgggcaagaaggggaagccgctccactacaagggctcggtcttccaccgcgtcatccccgacttcatgtgccagggcggcgacttcaccgacggcaacggcaccggcggcgagtccatctacggcgccaagttcgccgacgagaagttcgtgcgcaagcacacgggccccggggtgctctccatggccaacgccgggcccaacaccaacggctcccagttcttcatctgcaccgtgccctgcccttggctcgacggcaagcacgtcgtcttcggccaggtcgtcgaggggctcgacgtcgtcaaggccatcgagaaggtgggctcccgcagcggctccaccgccaaggtggtcaaggtcgccgactgcggccagctcgcctagatccgcgccgatctgctggtcccggccgccctccatccgccgtcgtcgcctccttccgttcgctccgctccccccctccgcactgaataagatgacggtgatctgagaggtgcttcttccgaattgagtcgagtcgtgttcgtttgtcgtgtgctgtgctggtggtgtctagggttttaggtggtggatctgcgaatccgatgggccatggttggatggtgtctctgcctgcttgttgtggtacgatgaattgatgatgatgatgctatgatgagaagtgagaactgaaacctg

SEQ ID NO: 18455 - protein, 130 aa, Panicum virgatum
  misc_feature: Ceres CLONE 1797038-R
  misc_feature (1)..(129): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
EKGVGKKGKPLHYKGSVFHRVIPDFMCQGGDFTDGNGTGGESIYGAKFADEKFVRKHTGPGVLSMANAGPNTNGSQFFICTVPCPWLDGKHVVFGQVVEGLDVVKAIEKVGSRSGSTAKVVKVADCGQLA

SEQ ID NO: 18456 - DNA, 1929 bp, Panicum virgatum
  misc_feature: Ceres CLONE 1797048
  misc_feature: Encodes the peptide sequence at SEQ ID NO. 18457
agtggcccattgggcgacggcagcgcggcctgctacagatgttctagtatgtaaaaaaccccgaaacgtgagtcccttccgctcgggagaattgggggaagaagagctagcgtgaaactgaaactagggtttaggccttcagtggattcgggcccgggaggaccgcgatgagcatcgtgccgaaggagacaatcgaggtcatcgcccagagcgtcggcatccctagccttggcgccgatgtcgccgccgccctcgcccccgacgttgagtaccgcctccgcgagatcatgcaggagtccattaaatgtatgcgccatgcaaaacagacagttctgactgcagatgatgttgacagtgctctcagccttaggaatgttgagcctgtatatggattcgcttctggtgatccattgcggtttaagcgagctgttggacataaggatctcttttatcttgatgaccgggaggtagacttcaaagagattattgaagctcctctgccaaaggcccctcttgacacagcagttgtagcccattggctagcgattgagggtgtgcagcctgcaattccggagaatcctcctatcgatgcaattataccaccagctgaaaataaaaggtcagaacatgggaaggatgatgggcttgcggttgatgttaagcttcctgttaaacatgtattatctagagaactacagatgtactttgataaaatagctgagcttactatgagtagatctgatacgcccctttttaaagaagctttagtgagcttggcaaaagattcaggccttcatccattggttccttacttttcctacttcatcgcagatgaggttacccggagtttgggggatcttcctgttttatttgctctcatgcgagtagtccgaagtcttctccataatccacacattcatattgaaccttatttgcaccagttgatgccatcaatgattacgtgcattgttgcaaaaaggctagggcataggctctctgataaccactgggaacttagagacttttctgccaatttggttgctttggtatgccggaggtttggtcatgtctatcacaaccttcaaaaccgattaacaaaaacattaatccatgcgtttcttgatcctgcgaaatcattgacccaacattatggtgctgttcaagggatatctgcgttggggcccagtgcgattaggctgctgcttttgcccaacctcgtgacatatatgcaacttctggagccagaactgcagcttgagaagcagaaaaatgagatgaaaaggaaggaagcctggcgtgtttatggtgccttgctgtgtgctgcaggcaaatgcttgtacgatcggctcaaattatttcctgttttgctttctccatcgacacgtcctcttttgaggagcgataaaagggttttaaccaataacccaaataagcagaaatccagcacagatctctctgcatcccagccacctctgaagaagatggcaccggacacttcagtcaactccatggcaggaaacatgcaaggagccatggatggcttttccactcagttgggtaaccctgggatgatgcaggcttcgtcctctggacagatggtggagagcatcccatcagctgcgatccggagagatcagggcagcgatcttgcacagagagtgtccacggtgctgaggcaagcttggaaggaggatcaggatgccggtcatctcctggggtcactgtatgaggtcttcggtgaagccatcttctcgtttgtccaaccaccagagatatccttgtttgtgtagaaagtggactcataggcttggaggtattttaatctgtgctgtacaagtaggaatgtattgctggattcttggaattgttcctggttgggtggtgtaacttgcatcagctgatctaatgagttgcagtataattttaacc

SEQ ID NO: 18457 - protein, 540 aa, Panicum virgatum
  misc_feature: Ceres CLONE 1797048
  misc_feature (2)..(68): Pfam Name: TAF Pfam Description: TATA box binding protein associated factor (TAF)
MSIVPKETIEVIAQSVGIPSLGADVAAALAPDVEYRLREIMQESIKCMRHAKQTVLTADDVDSALSLRNVEPVYGFASGDPLRFKRAVGHKDLFYLDDREVDFKEIIEAPLPKAPLDTAVVAHWLAIEGVQPAIPENPPIDAIIPPAENKRSEHGKDDGLAVDVKLPVKHVLSRELQMYFDKIAELTMSRSDTPLFKEALVSLAKDSGLHPLVPYFSYFIADEVTRSLGDLPVLFALMRVVRSLLHNPHIHIEPYLHQLMPSMITCIVAKRLGHRLSDNHWELRDFSANLVALVCRRFGHVYHNLQNRLTKTLIHAFLDPAKSLTQHYGAVQGISALGPSAIRLLLLPNLVTYMQLLEPELQLEKQKNEMKRKEAWRVYGALLCAAGKCLYDRLKLFPVLLSPSTRPLLRSDKRVLTNNPNKQKSSTDLSASQPPLKKMAPDTSVNSMAGNMQGAMDGFSTQLGNPGMMQASSSGQMVESIPSAAIRRDQGSDLAQRVSTVLRQAWKEDQDAGHLLGSLYEVFGEAIFSFVQPPEISLFV

SEQ ID NO: 18458 - DNA, 1370 bp, Panicum virgatum
  misc_feature: Ceres CLONE 1797059
  misc_feature: Encodes the peptide sequence at SEQ ID NO. 18459
ctcacagtgatctgaaacactcataaaaaaattcggtgaactagtcgcgtagcatggcaacgcatccaaagcagcaccaggagagcaaaggtgaggggatggcggccggcaagggcgacgagtccaccccgacaaacggcggcggcgtcctcccggccaacttcgccgaggtggtggcctcccttccccaagggccgcagtgctccatgtttccttccctccgccattaccgcggcttctggatcccggagatcagcctgctgagcctccccgaggtccacgcccgcttcgcgctgagccccacggatgtcctcgtcgcgagcttccccaagtgcggcaccacctggctcaagtccctttgcttcgccgccgcgcgccggtcctcccacccgccactcgacggcgggcacccgctcctccgccgcaacgcacacgactgcgtcaggtccatcgacacccttcggttcctgcaaggcggcggggacgacgacggcgaggcgccgcgcctcctcgggactcacctgccctactccctgctcccggcgcgcgccacggcggaggacggctccgggtgccggatcgtgtacgtcatccgggaccccaaggacacgctggtctccctctggcacttcaactccggcgtggtgctgacggcgccaggcggcggcgacgccaacggcgcgccgccgccaccggagaagaccaagttcgaggaggcgttcgagctcttctgccagggccactacgggctgggcccgcagtgggagcacgcccgcgagtactgggaggcgagcaggcggcgccccgtcagcgtgctgtgcctcaggtacgaggagatgctgcgggaccccgcgggcaacctgaggaagatcgcggcgttcatggggtgcccgttctcggaggcggaggaggaggccggcgtcgtgcgcgccatcctcgagctgtgcggcatggagaagcagcggagcctggcggtgaacaggagcggggcctacgtggtcaaggacctgctcaccatcggcaaccagcatttcttcaggaagggggtggcgggggactggaggaaccacatgacgccggagatggcggcgaggttggacggcatcgtcgaggaggcgctccagggttcaggattttcctttggcgacgcaagtagctaaggcaaatgcgtacgtggctctgaataatcatgccggccatttcggtttggcatcagcttggtgtgttggcctatgagtcgtttgttcagccgatgctgtttgtgtggcatctgtatgtgttgtttccgtttgtttccctttgttacgtgtctttgtgattttattacttcttctaataaattctcggcaaatctcttgccgtccttttcc

SEQ ID NO: 18459 - protein, 368 aa, Panicum virgatum
  misc_feature: Ceres CLONE 1797059
  misc_feature (83)..(360): Pfam Name: Sulfotransfer_1 Pfam Description: Sulfotransferase domain
  misc_feature (219)..(363): SWISSPROT Homolog: EC 2.8.2.1 Aryl sulfotransferase
  misc_feature (79)..(193): SWISSPROT Homolog: EC 2.8.2.4 Estrone sulfotransferase
MATHPKQHQESKGEGMAAGKGDESTPTNGGGVLPANFAEVVASLPQGPQCSMFPSLRHYRGFWIPEISLLSLPEVHARFALSPTDVLVASFPKCGTTWLKSLCFAAARRSSHPPLDGGHPLLRRNAHDCVRSIDTLRFLQGGGDDDGEAPRLLGTHLPYSLLPARATAEDGSGCRIVYVIRDPKDTLVSLWHFNSGVVLTAPGGGDANGAPPPPEKTKFEEAFELFCQGHYGLGPQWEHAREYWEASRRRPVSVLCLRYEEMLRDPAGNLRKIAAFMGCPFSEAEEEAGVVRAILELCGMEKQRSLAVNRSGAYVVKDLLTIGNQHFFRKGVAGDWRNHMTPEMAARLDGIVEEALQGSGFSFGDASS

SEQ ID NO: 18460 - DNA, 1971 bp, Panicum virgatum
  misc_feature: Ceres CLONE 1797067
  misc_feature: Encodes the peptide sequence at SEQ ID NO. 18461
cgacgggcgacgaccacccccattccttcccccaacttatcggctccccaccttcctcgccgcggaacacgcgctcccgtcccggatttgctcgttttattcgctcgagactcctccccgcggcgagtcctcgaatccaatcccatctaccgtccaatcccctcggctctgttgcggatttgtctgctgcgtggcagggtgcggtagccgagcgctccggccatggcgttcttccggggcctcaccgcgatctcgaggctgcgatcccgcgtggcgcaggaggccagcgcgctgggtggtgtcagatggttgcagatgcagagcgcttccgatctcgatctcaagtcccagttgcaggaactgattcccgaacaacaggatcgcctaaagaagcttaaatcagagcatggaaaggtccagcttggaaacataaatgtagatatggtccttggtggaatgagagggatgattgggatgctttgggaaacatcactacttgacccagaggagggcattcgctttaggggcctctcaattccagagtgccagcaagtgctgccaacggcagttaagggtggtgagcctttgcctgagggtctcctttggcttcttttgacaggaaaggttccaaccaaagagcaagttgatgccctatcaaaggaattgctggcccgttcaagtgtcccagctcatgtctataaggcaatagatgctctccctgtaactgcacaccctatgacacagtttaccactggaataatggctcttcaggttgagagtgaatttcaaaaggcttatgacaaaggattgccaaaaacaaagttctgggagcctacttatgaagatgtcttaaatttgattgctcggcttccaccagtggcttcttatgtttaccggaggattttcaaggacgggaaatcaatagaagctgataattctctggattatgctgcgaatttttcacacatgcttggttttgacaatcccaaaatgttggagttgatgcgcctctatataacaattcacactgatcatgaaggcgggaatgtcagtgcacatactggtcatctggttggaagtgcactgtccgatccctatctttcttttgcagcggctctgaatggtttagctgggccacttcatggtctggctaatcaggaagtgcttctatggatcaaatctgtaattgaggaaactgggagtgacgttacaacagatcaactcmaagactatgtctggaagacactgaagagtggaaaggttgttcctggctttggtcatggtgttctgcgaaagacagacccacggtattcatgtcaaagggagttcgccctaaagcatttgcctgaggatccacttttccagttggtatccaagttgtatgaagtcgtgcctccaatcctcactgagcttggcaaggtgaagaacccatggccgaatgttgatgctcacagtggagttttgcttaaccactttggactatctgaagcacggtattacacagtcttgtttggtgtctcaaggagcatggggataggatctcagctcatctgggaccgtgctcttggcctaccactggagaggccgaagagtgtcaccatggagtggctggaaaactactgcaagaacaaggctgcttgaagctaaacagtggcttatttttttacacaccatgccaaatgccatctttcctgttaataagttacagtagtgttttctttcttttggcggtccaataacaagagcaagaggctctcagacggcagaattttgtatcctccgtcactcgggacatccagatagctaatctctgtggtaccaccgggcagacgagatcaggacatgattagtctttaatacatgatggcgcatgccaattcttttttaaccttccagttatttgggttttggcatgccgcatgcatgagctgactgttccttaatgaaaaagcgagtatatattttgatgcc

SEQ ID NO: 18461 - protein, 472 aa, Panicum virgatum
  misc_feature: Ceres CLONE 1797067
  misc_feature (78)..(455): Pfam Name: Citrate_synt Pfam Description: Citrate synthase
  misc_feature: SWISSPROT Homolog: EC 2.3.3.1 Citrate (Si)-synthase
  misc_feature (335)..(335): Xaa is any aa, unknown, or other
MAFFRGLTAISRLRSRVAQEASALGGVRWLQMQSASDLDLKSQLQELIPEQQDRLKKLKSEHGKVQLGNINVDMVLGGMRGMIGMLWETSLLDPEEGIRFRGLSIPECQQVLPTAVKGGEPLPEGLLWLLLTGKVPTKEQVDALSKELLARSSVPAHVYKAIDALPVTAHPMTQFTTGIMALQVESEFQKAYDKGLPKTKFWEPTYEDVLNLIARLPPVASYVYRRIFKDGKSIEADNSLDYAANFSHMLGFDNPKMLELMRLYITIHTDHEGGNVSAHTGHLVGSALSDPYLSFAAALNGLAGPLHGLANQEVLLWIKSVIEETGSDVTTDQLXDYVWKTLKSGKVVPGFGHGVLRKTDPRYSCQREFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCKNKAA

SEQ ID NO: 18462 - DNA, 2034 bp, Panicum virgatum
  misc_feature: Ceres CLONE 1797073
  misc_feature: Encodes the peptide sequence at SEQ ID NO. 18463
agctcgctcgctctgctttgcccctgcgcgtcgccccactatataagccccgcctccgccccatcccccgcactccatcgcctcgccgccgttccccgcaacacctcacgacctaatcgcgcgccggccccggctcgccgtcgcgctctccagatctccgccccgccgccgaggtagcagcatctgttctgctgcagtctgacaaagtggagggcttaggtgttgctgcttcttttatgtctgaacaatctttgctttatttgggattgttgggagagtattctcgtgcaacgagaaaaaggcacaagcttccattccactgcatgcatcaagagcccatctggtcatcttgttctgaggtgtcttttgctggtgctcagagtcagcctggttttctccaaggatcagcagctactctcggttcaggattctgccacatctgatagcatcagcttcagaaatctttatccaagatggctctgcaaaacattggtgcttcaaacagggatgatgccttctacaggtacaagatgccaaggatgattaccaaaatagaagggcgtggtaatggcatcaagacaaacattgtgaacatggttgacattgcaaaagcacttgccaggccagcttcctacacaaccaaatactttgggtgtgagcttggcgcacagtctaagtttgatgagaagacaggagtttccttggttaatggtgctcatgacactgcaaagctggctggtctacttgaggtgttcatcaagaagtatgtccagtgttacgggtgtgacaaccctgagactgagattctgatctctaagacccagatgatgtcactgaaatgtgctgcctgtggcttcatctcagatgttgacatgagggacaagcttacaaccttcatcctgaagaacccacctgaacagaagaagggaggaaaagataagaaggccatgaggagagctgagaaggaacgtctgaaggaaggtgaggctgccgatgaggagcagaagaaactgaagaaggatgcaaagaagaaaggtgtatcttccaaggaatccacagctaaggtttcaaagaagaaggctgctgcagctggctctgatgaagatcattcaacatctccaactcgcagtcgtgatggagacaatgcagctgcagaagaggatgatgatgtcgagtggcagactgacacttctctggaggctgcaaaacaacgcatgcaggagcaactgagtgcggcaactgctgagatggtgatgctctccactgatgatactgagaagaagaagcaggccacccctaaagaagccactgctaatggttctgcgaaagcccaagagagctctgagccagccgtcactaagcccagtccctacagtgaactggttggagacatcaaggctagcttgggaagtgctgcaacacccactcagctcaagtctgtactggcatcctcagccctccctccccaggatgtgatgaacgctctcctcgaggctctctttgatggagtggggaagggatttgcaaaggaggtgatgaagaacaagaagtaccttgctgccgctgtgcctgatgagagtgcccagaccgtgctgatccaggcaattgagtcttttggcggcaagtgcacccccgaggcactgaagcaggtcccagtcgttctgaaagccctgtacgatggagatgtgctggaggaggaaaccatcgtggagtggtacaatgctgctgtgactgcaggcaagaactcccaggttttgaagaatgccaagccgtttgtggattggctccagagcgccgagtctgaagaagaggatgatgagtgaggcctgtggatgcggtgctgctttgatttcacagcgctccccattactacttatctttgtgtcttgattgtctcgtagtcggtttatctcgtgtgatattgtcggtgtcgtatcccgtgtgatcgtgtcagtcttttgtatccagtctcaacaattggtgtttgtctaaactgcgttatgcgagtttgtaagcaagcgtacctttgtggtt

SEQ ID NO: 18463 - protein, 449 aa, Panicum virgatum
  misc_feature: Ceres CLONE 1797073
  misc_feature (1)..(131): Pfam Name: eIF-5_eIF-2B Pfam Description: Domain found in IF2B/IF5
  misc_feature (368)..(449): Pfam Name: W2 Pfam Description: eIF4-gamma/eIF5/eIF2-epsilon
MALQNIGASNRDDAFYRYKMPRMITKIEGRGNGIKTNIVNMVDIAKALARPASYTTKYFGCELGAQSKFDEKTGVSLVNGAHDTAKLAGLLEVFIKKYVQCYGCDNPETEILISKTQMMSLKCAACGFISDVDMRDKLTTFILKNPPEQKKGGKDKKAMRRAEKERLKEGEAADEEQKKLKKDAKKKGVSSKESTAKVSKKKAAAAGSDEDHSTSPTRSRDGDNAAAEEDDDVEWQTDTSLEAAKQRMQEQLSAATAEMVMLSTDDTEKKKQATPKEATANGSAKAQESSEPAVTKPSPYSELVGDIKASLGSAATPTQLKSVLASSALPPQDVMNALLEALFDGVGKGFAKEVMKNKKYLAAAVPDESAQTVLIQAIESFGGKCTPEALKQVPVVLKALYDGDVLEEETIVEWYNAAVTAGKNSQVLKNAKPFVDWLQSAESEEEDDE

SEQ ID NO: 18464 - DNA, 1517 bp, Panicum virgatum
  misc_feature: Ceres CLONE 1797111
  misc_feature: Encodes the peptide sequence at SEQ ID NO. 18465
atgaggctagggtttctccttgtcgaactctccccatccccggtcccctgtctcctgtctccaacccctcgcgccgccgccgccgccgccgcccaaaaccctaccctcctctcccccgctccccaactcctcttcttattctaatggcggcccaacccgtccggcgaagctgctagtgcttgcatccagtcccttcatcaggtgcctcgcgaccccactgcagccccctctcccggcgccgccgtcgctgctgccatggccaccctcaacccgttcgacctcctcggcgccgacgacggcgatgacccctcgcagctgattgccgccgcggcgacggcggcgcagaaggccgaggcgaagaaggccgccgcggcgcctgctgggaaggcggcccagcccgcggcggccgccaagttcccgactaagcccgctcccccctcgcaggctgtgagagatgcacgtggaggcggtgcaccagctcgtggtggctatggccgtggcgaacgtggccgtggcagaggtggacggggatatggccagaaccgtgacttcggtggtgaatctgccaatggcttccagggaggttatggtggcggaggctttggggatggtgctgtaactggtggagctgaaggggaaagggagagaggccctcgccccccttaccgtggaggaggcagacgtggtggctacaggaatggtgagtttggcgatgactctgagaggccacctaggagaaactatgaacgccacagtggaactggccgtgggtatgagatgaagcgtgatggcgcagggcgtgggaactggggaactgccaccgatgaagttcttgcccaggaaactgaggaagctctcaaggtggaggaggatgctcctattgctgagaaacagggcgagcagaatgacgccccagcaacagatgagaacaaagataacaaggatgctgctgctgaggaggaagagaaggaagaggacaaggagatgactctggaggagttcgagaaaataagggaggagaagaggaaagcactactttcattgaagactgaagagaggaaggttgaagttgataaggatctgcagtctctgcagccactctcaaacaagaaagaaaatgatgaagttttcattaagctgggttctgacaaggataagaagaaggaaagtgctgagcgtgatgagcgcgccaagaagtcgctgagcatcaacgagttcctgaaacctgctgaaggagaaaggtactatggtggtcgcggtcgtggaaggggccgtggggagcgtggtggttttagaggtggatatgctgggggttacagtcgcggcccagctgctgccccatccattgaagatcaagctcagttcccaagccttggtgggaagtgaagggcgcttagtgtcatcatctcaagcattgcattgtctactggtgttatctttgaattttggcccgacgttacattattgtgccacggttgaaccggaacaaataatggtgtttcatgtggctttctttc

SEQ ID NO: 18465 - protein, 376 aa, Panicum virgatum
  misc_feature: Ceres CLONE 1797111
  misc_feature (159)..(271): Pfam Name: HABP4_PAI-RBP1 Pfam Description: Hyaluronan / mRNA binding family
MATLNPFDLLGADDGDDPSQLIAAAATAAQKAEAKKAAAAPAGKAAQPAAAAKFPTKPAPPSQAVRDARGGGAPARGGYGRGERGRGRGGRGYGQNRDFGGESANGFQGGYGGGGFGDGAVTGGAEGERERGPRPPYRGGGRRGGYRNGEFGDDSERPPRRNYERHSGTGRGYEMKRDGAGRGNWGTATDEVLAQETEEALKVEEDAPIAEKQGEQNDAPATDENKDNKDAAAEEEEKEEDKEMTLEEFEKIREEKRKALLSLKTEERKVEVDKDLQSLQPLSNKKENDEVFIKLGSDKDKKKESAERDERAKKSLSINEFLKPAEGERYYGGRGRGRGRGERGGFRGGYAGGYSRGPAAAPSIEDQAQFPSLGGK

SEQ ID NO: 18466 - DNA, 610 bp, Panicum virgatum
  misc_feature: Ceres CLONE 1797122-R
  misc_feature: Encodes the peptide sequence at SEQ ID NO. 18467
ggccggcgcgcagatcttctccgagggcgggctggactacctgggcaaccccaacctggtgcacgcgcagagcatcctggccatctgggcgtgccaggtgatgctcatgggcttcgtcgagggctaccgcgtcggcggcgggccgctcggcgaggggctcgacaaggtgtacccgggcggcgccttcgacccgctggggctcgccgacgacccggacaccgccgcggagctcaaggtgaaggagctcaagaacggccgcctcgccatgttctccatgttcggattcttcgtgcaggccatcgtcaccggcaagggccccatcgagaacctcttcgaccacgtcgccgaccccgtcgccaacaacgcctgggcctacgccaccaacttcgtcccgggcaactgatcaatctgctctgcttgtaggcgtgtagtagttgcacgcgccggcgtatgctccgtgtgctctcgtcagattcagattcagatcatcagcagctgcgtctgcctgcacgtgatgtaaacttgtaaactacgcacggacatgcatgtgtaagatcaatggtgtacgtgtaccataccattcatgagtggatcttcttgtcactcatcc

SEQ ID NO: 18467 - protein, 133 aa, Panicum virgatum
  misc_feature: Ceres CLONE 1797122-R
  misc_feature (1)..(100): Pfam Name: Chloroa_b-bind Pfam Description: Chlorophyll A-B binding protein
AGAQIFSEGGLDYLGNPNLVHAQSILAIWACQVMLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 18468 - DNA, 710 bp, Panicum virgatum
  misc_feature: Ceres CLONE 1797122
atcggcatggcttgtttgtagcaggagaaagagagccgagaggtgctagtgctactacggtggcgcagcggcagcggcaggagccatgagcggccgggagagcaggtggccggagctcgcgaccctgcggcgcgcgctgatggcgcacgacgccggggtggcggcggggagggagcagcggcagcagcagcagccggggcggcgcggcgccagcggtgggcgcgaggaccacggcaagacggccaaggtgatgcacctgctgctctggggacccaagtgacgctatgctctctgctctgctcggcccggccggcggcgctccggcgtgctcccggcggccggatctgtaccgtgctctgtaccgtagtactagctactaccactagttgtttgcttgctcctcctcttgcaccactctgctgtttgctcgactgctggaagccatagctaagagctttctgtaaatagcaagtcccggagtggtgcttggagcagcagagtaccatctctgtaatctaagaacgcgtatccaccaccgctcgatcagccgaacaatctccccggacacgcgcgcagaaccgaagatggccgcgtcggcgctgcaccagaccaccagcttcctcgggcaggccctggtaccccgccccgccggcgccggcgccgacaccggcggccgcatcaccatgcgccgcaccgtgaagagcgctccc

SEQ ID NO: 18469 - DNA, 2568 bp, Panicum virgatum
  misc_feature: Ceres CLONE 1797130
  misc_feature: Encodes the peptide sequence at SEQ ID NO. 18470
acctcgcaggcctcgcctccggctccgatctgctaaggccccccgccggatcgggttgcgggtcgcctccaccaccgaccccgatccaccaccgctcgccgccgaccgccgccgccgaggtggcctctaccgtgagcccgggccggtgcctagggtggccgggccctgggtccgcccatggagccaacaccaattgaagtgcaaaatggtgcctcagtcagcaatgcagtggagcctgcgcctgcagttcacaatccacggacgcggaaactgcgctctgcagtttggaaggacttcacgagagagcgccgtgccgatggcaactatgtggctatctgtaagcactgcaagaagcagctcacggcgacaagccgatcaggcaccacgcacctgcgcaaccacctcgccacctgcaccaccacctccacacgacgtgctggtaaacgccggaagcttgttgtgcgccgtattcaccacagcaaatccttcgctgatgggcaatctggtgagggccatgcctcaggcgacgacaatgacaatgagggcacgcactttgatcaagaactcagccgccgagaccttgtgcacatgattgtccagcatggttaccgcttttcgatggtagatgatgtgggcttccaaaagtttgtcaagaacctccagcctcagtttaggatggtgtcatatgacacggtgagggctgatagcatggaaatatatgaaggtgagaaacttaagctacaggatgtgctctctaagatcccctgccgggttagcatctcagttgatatgtgggagtcaaatacacagatggaatacatgtgcttgacctgtcactacattgaccatgccaatgatgagtggaaagttaggaaaaaaattctcaactttgtgcctatggaggcaccttttacagttgatcagattgctaatctgattgtagagaagttgcatagttggggtattgacagaaaactaggtgctgttgtactggacaattgcagtggtggtgaaattgttgccagggagcttctcagaattttgcagcccaggagtcttctgttaaatggggatttgttccaagtacgctcttgtgcgcacattctaaatctcactatccaagaaagctgggaagaggcatcagatataactgatagagtccgcaagatgattacctatgtcaagtttgaaaggttccagaagtttcaggatatctcaaagctactgcatgtggatcaaaagcacttagttgttgattctcctgataacttgtcgtcgatttacttaatgtttgagtctgcatgctactatcatgatgttcttgtgcgcctcgcagaacaggaagggcactatgatgtttttctggctgctgctgactgggctgatgtgaaagccctcactgaaatactagatgtagtctatcatgctatggagaagtttccgttggaaaacccaactgcaaacctctattttaatgagatgtgtgagatccatgtgcttttgagaacctggcgcaatagtccatctcctgttgttgccaaagttgctgctcagatgctttctaaatttgagggctactgggatatcactaggcctgtaatggcatttgcatctattcttgatcctcgttataagatgaagtcccttgaatacttctttcggctcatttatgctgatgagcaatttgcagcgaagacaatgatagatgtcatccagaatacctttcacaatctgtataatgagtacaagcaccagtcatcagattcatggaagaatccatctgttctctgttactctagaaatagtcgctcttgcatgggctctatgtacagcaatggggatgattctaggaccttctctcgtatcacattatctgatgctcgacgaggacttgatcagtatatacaagagacatcatcgggccaatccttgaagtctgacttggagatgtatctcgaggaagcagtttatcgtcaaaaagaaggaaatcaggataattttgacatccttggatggtggaagtcctttgcagccaagtatcctgtactgtcacaaatggctcgtgatattttagctatccctgtatctatcatccctttggacaatgaagcccgtacacttaatgagtatctcagtactatggacccttcaacagttcagggattggtgtgtgcgcaagattggttgcgggaagacccagaagttgctgtttcaggtggtcaagcaaatgatggagcaccgcacggtgacgaactgattctggtgccgagccaaaatagttgaatatattggagagtggactattctgaaagaaggcttttgagaagactgaaggcggcacgggaactaaataatctattgtccaagatccagcaatactctcctgtaaattgatcgttctagttagatgttgatctgtacaatgaactcctagagtcgccctccaaggagactaacattatccagccacctagtgccattgaaaacagcctaccatgtattcatgatggattgatgtgtattgtgctgctcaggtaacctaaactatgtgtcagatttcgcaaggcc

SEQ ID NO: 18470 - protein, 701 aa, Panicum virgatum
  misc_feature: Ceres CLONE 1797130
  misc_feature (588)..(670): Pfam Name: hATC Pfam Description: hAT family dimerisation domain
  misc_feature (34)..(80): Pfam Name: zf-BED Pfam Description: BED zinc finger
MEPTPIEVQNGASVSNAVEPAPAVHNPRTRKLRSAVWKDFTRERRADGNYVAICKHCKKQLTATSRSGTTHLRNHLATCTTTSTRRAGKRRKLVVRRIHHSKSFADGQSGEGHASGDDNDNEGTHFDQELSRRDLVHMIVQHGYRFSMVDDVGFQKFVKNLQPQFRMVSYDTVRADSMEIYEGEKLKLQDVLSKIPCRVSISVDMWESNTQMEYMCLTCHYIDHANDEWKVRKKILNFVPMEAPFTVDQIANLIVEKLHSWGIDRKLGAVVLDNCSGGEIVARELLRILQPRSLLLNGDLFQVRSCAHILNLTIQESWEEASDITDRVRKMITYVKFERFQKFQDISKLLHVDQKHLVVDSPDNLSSIYLMFESACYYHDVLVRLAEQEGHYDVFLAAADWADVKALTEILDVVYHAMEKFPLENPTANLYFNEMCEIHVLLRTWRNSPSPVVAKVAAQMLSKFEGYWDITRPVMAFASILDPRYKMKSLEYFFRLIYADEQFAAKTMIDVIQNTFHNLYNEYKHQSSDSWKNPSVLCYSRNSRSCMGSMYSNGDDSRTFSRITLSDARRGLDQYIQETSSGQSLKSDLEMYLEEAVYRQKEGNQDNFDILGWWKSFAAKYPVLSQMARDILAIPVSIIPLDNEARTLNEYLSTMDPSTVQGLVCAQDWLREDPEVAVSGGQANDGAPHGDELILVPSQNS

SEQ ID NO: 18471 - DNA, 2316 bp, Panicum virgatum
  misc_feature: Ceres CLONE 1797137
  misc_feature: Encodes the peptide sequence at SEQ ID NO. 18472
acccgagaaacagcaggcgggcggaagtgcggaacaggggaaagcccagaccacctccccgaaaccgcgacgacccgacacctcgtccacctcctctcctctcctcctgacctccctttccggctcctactggctatccaccgcccgtaccccgcgcgatcaagccgaccagagccggcaccccgatggtggtcgtggcggtgggagggggcggcggcggaggagggtgggggacgtgggaggagctggtgctgggcggcgccgtgctccgccacgggggcgccgcgtgggccgccgtcgccgacgagctccggacccgctccccgtgcgccttctctcccgaggaatgtgaagcgaaatttgcagagatacagttgcgctactctgcatgcaacgcttggtttgaagagcttcgcaagcagagagttgctgaactgagaagggaattggagaagtcggaaaattctattggatccctccaatctgtgattcaaagcctcagcaatagcaaacatggtgatggtagttctgaatgtcgcaccagtcagaccgaatcatgttcgcactctgaaaatacagtggatacttcctcaggtaaagaggcatccagagacagatcatcagcggctaatttcacagaggaagcaagcaacagtcagaaagctcagcaagtgcagcagtgtgatactgattcagttcaggctaataatccattaccggatgagtcatatcctcaggatcaagttgagaaggtctgtccgaaagatagcctgctttggggctctagaaagcaaagaggaaggagagctagacggactattatcaaaggtgatggtagtagtagggatggtgagcctacatctacagcatgcaaagagagggagggttcctctgaaggcttcttgaaggacttgaaaactccaaaagcagaatcagttgtgatgaagaagggtttgaaaactccaaagccagaatctggtgtgctgaataaggatttcaaaagtccaaatgtaggatctggcctaatgaagaagggtctgaaaactacaaatggagaatctgatgtgacgaagaagggcctgaaaactcccaaggcagaatctgacgttttgaaggtcttgaaaactcccaaagcagaatctgatgttatgatgaagggcttgaaaactcccaaagcagaacctgatgttgtgaagaagggcttgaaagctccaaaagcagaatgtggtcagcttgtgagtgaaagaatcaagcaaaagttggcagagattttgaaaactatatccactcaaggcgactgtttgatgttgcaacaccaacttgatacccagaggaaaagggttagatacaagaagatgattcgccggcatatggacttccggacccttcactctaagatcaagagtggtgccatctcttccaccaaggagcttctgagagacattctcatttttgtgaataatgtaatagccttctacccaaaggctacattagagcacatggctgcggttgagcttcggaacctttcgtgcaaaattgtgaagcagggtgcaagcttgctcttgaagatccgtggagagacaggaacagctggtgcctctgcagtgaagaagaatgctcgagcccagcaggcaggacgccctggccctggtgatgcaaggggatgcaaggtttcttcaagggaagctactgccaaggaaggcgagggcaagggctgtaaaagtgatgcatcattagcagctaatcaaaagactacccagagaaatgagccggccaagaagagaggcgtcggtcggcctccgaagagtgggcagaggactgctggggcacaggaagataaccccagtaaaggcaggaagaggggcgctggggcacaggaagatagtcccagtaaaggcaggaagaggggcgctggggcgcaggtggatagccccagcaaaggccggaagaggagtgctgcagcatctgaggatagcctcagcaaaggcggcaagaagacccggggatgaagcttaccatcagctcaacgccggtgaaactgtgtacagcttaaccatatcataggctagtcccttccagtggttgctggcagaaaaaaaagctgtggcccagtaatcaagctgatgtaacaggaagggttagctgtttttggtggtgttttgtaagggctgaggagtaaggacagctagaaggggatccatattttcctgtagagattgtccaattaggctagctatacttgtcttactgtgtaatgtttgtctgacaattgttgctgcttgttatcagtgtcagctgatgcttaaacaccaagat

SEQ ID NO: 18472 - protein, 607 aa, Panicum virgatum
  misc_feature: Ceres CLONE 1797137
  misc_feature (355)..(443): Pfam Name: Bromodomain Pfam Description: Bromodomain
MVVVAVGGGGGGGGWGTWEELVLGGAVLRHGGAAWAAVADELRTRSPCAFSPEECEAKFAEIQLRYSACNAWFEELRKQRVAELRRELEKSENSIGSLQSVIQSLSNSKHGDGSSECRTSQTESCSHSENTVDTSSGKEASRDRSSAANFTEEASNSQKAQQVQQCDTDSVQANNPLPDESYPQDQVEKVCPKDSLLWGSRKQRGRRARRTIIKGDGSSRDGEPTSTACKEREGSSEGFLKDLKTPKAESVVMKKGLKTPKPESGVLNKDFKSPNVGSGLMKKGLKTTNGESDVTKKGLKTPKAESDVLKVLKTPKAESDVMMKGLKTPKAEPDVVKKGLKAPKAECGQLVSERIKQKLAEILKTISTQGDCLMLQHQLDTQRKRVRYKKMIRRHMDFRTLHSKIKSGAISSTKELLRDILIFVNNVIAFYPKATLEHMAAVELRNLSCKIVKQGASLLLKIRGETGTAGASAVKKNARAQQAGRPGPGDARGCKVSSREATAKEGEGKGCKSDASLAANQKTTQRNEPAKKRGVGRPPKSGQRTAGAQEDNPSKGRKRGAGAQEDSPSKGRKRGAGAQVDSPSKGRKRSAAASEDSLSKGGKKTRG

SEQ ID NO: 18473 - DNA, 1506 bp, Panicum virgatum
  misc_feature: Ceres CLONE 1797145
  misc_feature: Encodes the peptide sequence at SEQ ID NO. 18474
accacttcgcgttgtgctcttgcgtttccgtgttgagacttgagagagatggagtacaggagagccaaggaccaggagagtgatgacatatctcagaaggacgtagaaagccttgatctgaggtctctgtctcatacttcagcaacttcgagtcttagcactgcaggagggccaaagggcaagaatacttggaagctcaagtccattgttacacttgcattgacattgctaacaagttcccaggcaatattgattgtgtggtcgaaaagagctggaaagtatgaatatagtgtcacaacagcaaatttttcggtggaatttctgaaatgtctattatcgtttctagccttgtacaaaacatggaacagtcaaggcattaccgaagataataggttaactacatcattcgatgaagttagtgtttaccccattcctgctatactttacatggtgaagaacttattgcagtattatatctttgcatatgtggatgcaccagcttaccagatcctgaaaaacctgaatattatcagcaccggtgtcttataccgtatcattctaaagaaaaagttgagtgaaatacagtgggctgcatttattctcttatgtgctggttgcactactgctcagctcaatccctcgtcagatcatgttcttcagacccctattcaaggttggatgatggcaattgtgatggctcttttaagtggttttgctggtgtatatacagaagctattatcaagaaacgcccttcaagaaatattaacgtgcagaatttttggctgtacatttttgggatgctcttcaacttagttgcaatttgtgttcaggactttgatgctgtgattaataaaggcttttttcacggctactcatttattacaattctgatgattcttaaccacgcactcagtggaattgctgtatcaatggtgatgaagtatgcggacaatattgtcaaggtgtattctacttcagttgcaatgcttcttacagcaatcatatctgtcttcttattcagcttccatctatcccttgcattcttccttggatctacggttgtttctgtctctgtgtatctgcactccgttgggaaacctcagcagcagaaatagatatcctcctcccgcgcagcagaaatagtgttttgttcatccatcgagcgatcgccacttggcaccatccatgctgcatcctggaatgaattgagtggcgatgcaaggccgttgcacagaagagacaggattcattcttgatcgtcaatgttctgcaatcaagttctgatggagttaactccgatacaccaacgtcggcgtggccttgaagcacccaattgactccaaacgttgacatgtgcagcgtcagtactttttaactttaaggcactcaactcttcttctatgtgacctgtaagtatgtaacgaatatatttcaagcttccttaggccgaggcgactattttctaacccgtttaaccacacccagagtcccagtgggaaagttac

SEQ ID NO: 18474 - protein, 355 aa, Panicum virgatum
  misc_feature: Ceres CLONE 1797145
  misc_feature (118)..(339): Pfam Name: Nuc_sug_transp Pfam Description: Nucleotide-sugar transporter
MEYRRAKDQESDDISQKDVESLDLRSLSHTSATSSLSTAGGPKGKNTWKLKSIVTLALTLLTSSQAILIVWSKRAGKYEYSVTTANFSVEFLKCLLSFLALYKTWNSQGITEDNRLTTSFDEVSVYPIPAILYMVKNLLQYYIFAYVDAPAYQILKNLNIISTGVLYRIILKKKLSEIQWAAFILLCAGCTTAQLNPSSDHVLQTPIQGWMMAIVMALLSGFAGVYTEAIIKKRPSRNINVQNFWLYIFGMLFNLVAICVQDFDAVINKGFFHGYSFITILMILNHALSGIAVSMVMKYADNIVKVYSTSVAMLLTAIISVFLFSFHLSLAFFLGSTVVSVSVYLHSVGKPQQQK

SEQ ID NO: 18475 - DNA, 1341 bp, Panicum virgatum
  misc_feature: Ceres CLONE 1797152
  misc_feature: Encodes the peptide sequence at SEQ ID NO. 18476
gcagcagtgattcaagcagcgaaaccgggagaggcaccaggcacgcgagcagctcgccgcccgtgccgaccggggccgagcctccctcctccgcggcggcgtgccgagatgagcctctcccaccgcctcccgccggcggacccctactacgtgtacgcgccgcgcccggacccgcaccggcagggcgtgctcacgctcttcgtcgctggcctccccgacgacgtgaagccccgcgagatccacaacctcttctcgcaccgccccggcttcgaccactgcctcctcgagtataccggccgcggcaaccaggcggttgcttttgtgacgttcttcactcatgaggcggccctgtcggcaatgacttctttaaatggaacaatttttgatccggatactggtgaccgtttgcacattgagctagctaaatcaacttcacgcagacctcgtggaggtggcgatgtctaccgagttattgacaaacgagctaacaaaccagaaggaaatgctgatcatgagaactttggtgaagaaggatgggaagaggatgagagtgatggtcatgatgatgatggtgatggaggatcagatgagccatcaggcacagaaaatgaaaattccagtgataagaatgaattgcctgcggataagagtgatcaaccagtgcacaagcagcagaatgggtctccctcaaatgatggacgagacaagtcttcaagtgatataccaccttgttctacactctttattgcaaatttgggacgtacatgcacagaggatgaactgaaggaagttttatccaaggaacccggttttcatgtccttaagatgcgtcgccgtagtggaatgcctgtagcttttgctgattttacggatattgaatcatctacagctgctatgaatagcctccaaggcactgtactggcttcttctgataatgaaggattgcacatcgaatacgcgaggtcaaagatgaggaaaagctaagctagttggatgttgatggactagaatgttttgcatgtgatctccgctcatcctgagggtatcagtagtaggcaggcatccctgcacatgtaagctgcatgtagctgtagcgttcggattttgctttatgtatcaaagcttgagaaccgagagcggtgctgattgtcttatgccagaatagccgggatattttagtattgttgaaggaacttccctgtttggaaactgctataatcagatcaggcacgctctgagcggtgcgaatttttttagggatatagaagtcaagagtagttaacataaggatatgtaggtaaaggactccttaaagaaaagatccatctctatgtccttttt

SEQ ID NO: 18476 - protein, 291 aa, Panicum virgatum
  misc_feature: Ceres CLONE 1797152
  misc_feature (30)..(102): Pfam Name: RRM_1 Pfam Description: RNA recognition motif. (a.k.a. RRM, RBD, or RNP domain)
  misc_feature (211)..(281): Pfam Name: RRM_1 Pfam Description: RNA recognition motif. (a.k.a. RRM, RBD, or RNP domain)
MSLSHRLPPADPYYVYAPRPDPHRQGVLTLFVAGLPDDVKPREIHNLFSHRPGFDHCLLEYTGRGNQAVAFVTFFTHEAALSAMTSLNGTIFDPDTGDRLHIELAKSTSRRPRGGGDVYRVIDKRANKPEGNADHENFGEEGWEEDESDGHDDDGDGGSDEPSGTENENSSDKNELPADKSDQPVHKQQNGSPSNDGRDKSSSDIPPCSTLFIANLGRTCTEDELKEVLSKEPGFHVLKMRRRSGMPVAFADFTDIESSTAAMNSLQGTVLASSDNEGLHIEYARSKMRKS

SEQ ID NO: 18477 - DNA, 1888 bp, Panicum virgatum
  misc_feature: Ceres CLONE 1797165
  misc_feature: Encodes the peptide sequence at SEQ ID NO. 18478
gcgaaccaacccagtcctaggagcagcagccagcaagtagcaactctgctttgtgtttgtgatgtctccccgcaccgccgagctgcccctcgccgacgccgacgccgaccgggcgcggctgcagcagctgggatacaagcaggagctcaagcgcggcctctccctcctctccaacttcgccttctccttctccatcatctccgtgctggcgggcgtcaccacgacgtacaacaccggcttgcgctacggcggcccggcgtccatgacgctgggctggctcgtcgtcgcggcgttcaacggctgcgtggccctgtccatggcggagatctgctcggcctacccgacctccggcgggctctactactggagcgccaagctcgccggcgaggactgggcgccactcgcttcctgggtcaccggatggttcaacatcgtgggccagtgggcctgcaccaccagcgtggacttctcgctggcgcagttcgtccaggtgatcgtcttgcttagcacgggtggagccaatggcggcggatacatggcctccaagtacgtagtgctggccatctactgtgccatcttgatcctacacgggctgatcaacagcctctctatccaatggctggcatggtttggccaatttggagccttttggaaccttgcaggtgtatttgccttgacgatattgattcctgccgttgctaaggagagggcaaccatggagtttgtctttacccactgctacaccgactctggtgtggggatccacagcaaggtttatgcactagccatcggtttgctgacaagccaatactccctcctcggatacgacacatccgcccacatgtcagaggagacgaagaacgcggcctggagcgggccaatggggatcgtcgtctctgttgctctgtcgagcgtcttcgggtggatctacctggtgtccctgacatccatcgtcaccaacatcccggccctccttgaccccagcaacgacgccggcgggaacgccatcgcgcaggccctgtacaccgccttccgctcgaggttcggcagcggcgccggggggatcgtgtgcctggcggccatggccgtcgccatcttcctctgcggcacggcgtcggtgaccagcaactcaaggatggggtacgccttctcgagagacggggcgatgccgttgtcgccggtctggtaccgggtgaacaagcaggaggtgcccttgaacgtggtctggctctccgtctcggtggcgttcgtcatggccctcacgtcgctggggaaccaggtggcgttccaggcgatggtgtccatcacgacgctgggcatgtacatcgcctacgggctgcccatcttgttccgggtgacggcggcgcggaggtcgttcgtgccggggccgttccacctcgggaaatacggcgtcctcgtcggctgggcggccgtcgcctgggtgagcctcgtcaccgtgctcttctgcctgccggtggcgtaccccgtcgcggtggacaacttcaactacacgccggcggccgtcgggggcgtgctgctgctcagcctcgccgcctgggcgctgcacgcccgcttctggttccaagggcccgtcaccaacctcggcgacgcctcatgaccgatgaggagaggtggccacccacgctctgtttgtttgtgttaagctacgattcggtctttgtttttgtacttatcgaccttcttaatcctttttttctttagacaaatcagcttaatctctctgacgtggtagacctgttcccgaaacatttggttctgcttaactagcaaggtggcccgcgcaatttgcgcaggtatagtttttcctctaaacttttagatttttttacattagaaaagttgaatgcaaatagttttgtttagttgt

SEQ ID NO: 18478 - protein, 518 aa, Panicum virgatum
  misc_feature: Ceres CLONE 1797165
  misc_feature (42)..(515): Pfam Name: AA_permease Pfam Description: Amino acid permease
MSPRTAELPLADADADRARLQQLGYKQELKRGLSLLSNFAFSFSIISVLAGVTTTYNTGLRYGGPASMTLGWLVVAAFNGCVALSMAEICSAYPTSGGLYYWSAKLAGEDWAPLASWVTGWFNIVGQWACTTSVDFSLAQFVQVIVLLSTGGANGGGYMASKYVVLAIYCAILILHGLINSLSIQWLAWFGQFGAFWNLAGVFALTILIPAVAKERATMEFVFTHCYTDSGVGIHSKVYALAIGLLTSQYSLLGYDTSAHMSEETKNAAWSGPMGIVVSVALSSVFGWIYLVSLTSIVTNIPALLDPSNDAGGNAIAQALYTAFRSRFGSGAGGIVCLAAMAVAIFLCGTASVTSNSRMGYAFSRDGAMPLSPVWYRVNKQEVPLNVVWLSVSVAFVMALTSLGNQVAFQAMVSITTLGMYIAYGLPILFRVTAARRSFVPGPFHLGKYGVLVGWAAVAWVSLVTVLFCLPVAYPVAVDNFNYTPAAVGGVLLLSLAAWALHARFWFQGPVTNLGDAS

SEQ ID NO: 18479 - DNA, 708 bp, Panicum virgatum
  misc_feature: Ceres CLONE 1797167
  misc_feature: Encodes the peptide sequence at SEQ ID NO. 18480
accaacaaccaaaggagagcacccgcgcatgtttagcttcgccgggcgcgcctccaccgcatcgagcatcgtcgccagcctcgccacccccgcgccgccgtccaagcccatcagccccgccttcgcctccgcccgccgccccaggctcatcatgagcgcgcccgtcttcgccgcccccagcgccgtcgcgagcatggacgccgtcgagcgcttgaagagcgggttcgagcagttcaagacccaggtctacgagtaagtcgcccgctccactcgatgcagcacccgccggcgttcgattccagctttcatgcatggcgctttgattccttcggggaattcccgggagctccactccaactgacgcccctgaatttcctctctgcagcaagaagccggagctgttcgagccgctcaaggccggccaatgccccagggtatgtactcctcccatcccatcccatcccatcccatcagtccatcacccttgtagactgctaagatttttgtctgcacccactccggccggccggccggccggatcctcgtcacaattcgtgggaagctttttttttttctttttttgacgcccaattcctgggaagcttaatttaggcaaaccgcgttcaggagctcggggtttccgggcagcgcctgtcgttttgctgggccacagatttggtagtgtacttgctggttcccatccgtcca

SEQ ID NO: 18480 - protein, 75 aa, Panicum virgatum
  misc_feature: Ceres CLONE 1797167
  misc_feature: SWISSPROT Homolog: EC 4.2.1.1 Carbonate dehydratase
MFSFAGRASTASSIVASLATPAPPSKPISPAFASARRPRLIMSAPVFAAPSAVASMDAVERLKSGFEQFKTQVYE

SEQ ID NO: 18481 - DNA, 1698 bp, Panicum virgatum
  misc_feature: Ceres CLONE 1797170
  misc_feature: Encodes the peptide sequence at SEQ ID NO. 18482
aacgtaccagcgaggcatatccatagctgatcgagctgagctcccgagcaagcacacaagcacacgctgccagaacagcaaagttcgccgcagatcgcgatccgaaaaaggcatcacgagatttggttgattatatttagcccccgcccgcagcagagtgagggaggcgagtcgagtaggcgctgtccggaaattccacaattaagcccaccgtacctgcctctccgcttctctgcctccaggctccagtagctccactgctccgcccgcccggcgtgctcgccgctgctcgcgggaggggacatgtcggcctccgcgtcgacgccggccggcgaggagaagcaggagctggcgcccgtggtgcagtgcaagggcgtcaacgacctcgacaaggtcgtcctccgcgaggtccggggcagctccgccgaggtttacctgtatggtgggcatgtgacatcatggaaagatgatcatggagatgagttactttttgttagcaataaggctattttcaagcctccaaaagctatacgtggaggaataccaatctgctttccacagttttccaactttggaaatctggaacaacatggatttgcaaggaatagagtctggaccattgatactgatccaccaccatttcctgtgccaaccaccaatacagcttatattgatttaatccttaaacctacggaagaggatttgaagatctggcctcatagttttgaataccgtctgagggttgcacttagtcctggtggtgatttgatgctaacttcacgtataagaaacactaatgcagatggaaagtcattctctttcacctttgcataccacacatacttcaagatttctgatataagtgaggtgcgagtagaaggcctggaaactctggattacctagacaacttacaagacagagcccgtttcactgaacaaggagatgcaattgtttttgaatccgaactggacagaatatatctgggcacaccatcaaaaattgccattattgatcatgagaagaaaagaacatttgttgtgaggaaaggaggacttcctgatgctgttgtttggaatccttgggacaaaaaggcaaaggctatgtcagattttggtgatgatgaatataaacgcatggtttgtgtggaggcagctgctatagagaagccggttactctaaagcctggtgaggaatggaccggaaagttggaactttctgctgtgccatctagttattacagtggtcagctagaccctgaccgtgtgattcaggattcaagtgtcccagaggattcaatcagctagtccttactgtaattctgtgcaggtagagcattatatcatgtataagggacactggcagcaaggattgtcacaacgtttcttctattctattcaaatctttgttgttttctgttcggggtgcatatcgaaccaagggatgtgaaattggtttactttttttggatctacgtgacataaaggacaagtcagtgttcgtaccctgtatatggatgtttgaggcgagaaacatcttccatgggttgtaaaataaagaaaaaaaatcctctctaccggtagttcattgtctttagatgtaagttctatattaaacctaggaagcagagatgttgtggaaatggacacacataatgtgcgaactgttccaggcattgtagcttcttgtggttccatgac

SEQ ID NO: 18482 - protein, 333 aa, Panicum virgatum
  misc_feature: Ceres CLONE 1797170
  misc_feature (29)..(305): Pfam Name: Aldose_epim Pfam Description: Aldose 1-epimerase
MSASASTPAGEEKQELAPVVQCKGVNDLDKVVLREVRGSSAEVYLYGGHVTSWKDDHGDELLFVSNKAIFKPPKAIRGGIPICFPQFSNFGNLEQHGFARNRVWTIDTDPPPFPVPTTNTAYIDLILKPTEEDLKIWPHSFEYRLRVALSPGGDLMLTSRIRNTNADGKSFSFTFAYHTYFKISDISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSSVPEDSIS

SEQ ID NO: 18483 - DNA, 503 bp, Panicum virgatum
  misc_feature: Ceres CLONE 1797181-R
  misc_feature: Encodes the peptide sequence at SEQ ID NO. 18484
gacctgcacgttgtgcttcctttgtgcactcaacctggaaaataggcctctatatctggccaccttcctgtcattcatctatgctattggtcatttcctaacggaatacttgatataccacaccatggctgtggcaaatctcagcacggttggcttctttgcaggaacgtcaattgtatggatgcttcttcagtggaattctcatggcaacccccgtggatcccatgctgtgaagcagtcatgagaaatgctcgggttgtcagcttgatgtggtctgggggaggaaggatgcgtgaagaaaccttgccataaaggcttcattgccattcgtacttcatttgtcatcatgttatttcagttcatgaaatgtttgttccactgattagaatctggaaattcgaacgttgtaaactgcgcgcatctgagtcttgtagccaagagctgtaatttccggtttgatcacattcaggcgtgcctgggaaacagattagctgttgtttttc

SEQ ID NO: 18484 - protein, 80 aa, Panicum virgatum
  misc_feature: Ceres CLONE 1797181-R
  misc_feature (1)..(57): Pfam Name: Erg28 Pfam Description: Erg28 like protein
TCTLCFLCALNLENRPLYLATFLSFIYAIGHFLTEYLIYHTMAVANLSTVGFFAGTSIVWMLLQWNSHGNPRGSHAVKQS

SEQ ID NO: 18485 - DNA, 647 bp, Panicum virgatum
  misc_feature: Ceres CLONE 1797181
ccgtctccgacctccactccactccactccactccacgccaccggtggattggaagcattgccacggggggcgccatgccggcggacgggagcaagaagaagggcgtgccgccgctgggctggtggctcatgctcgtcggctccctccgcctcgcctccgtctggttcggcttcttcgacatctgggcgctccgcgtcgccgtcttctcccaagcggagagtgagcgcccccggccctctgcacccctccatctcccactccgcctccctccttgtgtatttgcagcccagcccatccgtacggggtctgtctgtgattcttgactcttgagtaagtaggtaggtagatctgatcgggtggagatgaggtgcgctaattttaccctgagatccgcactttcttacaacttgcttgctccaatccgccaggcaaagttgggcttctttgtgcatctgtggtcgtggctttatcggattggtctttgagccaagacctcacgtttgctaaatgtcgtctttttactagttttcactcattctatggataagtccaggctaataatagtaaggaagtatttcaagactgcaattggcatagacgcatagttgagacttgagactagtctgactagggcactaataactga

SEQ ID NO: 18486 - DNA, 1821 bp, Panicum virgatum
  misc_feature: Ceres CLONE 1797193
  misc_feature: Encodes the peptide sequence at SEQ ID NO. 18487
aaacgcatccttctcccgaaaacctgaacctcccaagatcgatcgatcgatctacccctactcgccggaggacctcgccatggcggacgccatcgtctccgccgtcataggcgatgccgtcagcagggtgatctccctcctcacgggacgcttcggcgccggccaccagcagagcaccgaggccaagctgcggaggatctgccgcacgctcgtcagggtccacgccgcggtggaggaggccagagggcggcagatcaccaacggcggcgccctccggtggctctcggagctcatcgacggcgagtaccaggcccggtacctgatcgacacggttggcctaggccgcggcgacgagcaggtgccgccatctccgcgagattcctccacgacgtccacgtccccgttcaaccctgcgaagcgcgtgcgggtcgccgtgaagagggctctgtcgcgccgcgatcccggtggtgccgacggcgacgacatcgacggggctctcgagagcttgcaggaggtctcggcccatttcggtgagttcatcctgctcctccaaggctgccgcccgatccgccgtcccctgccaacgagcatcctcgtcgacgggcagatgttcggccggcacgtggagaaggagcgggtcatcaacttcctgctccacggcggcggcggcgccggggagctgggcgtgctccccgtcgtcggcgccatcggggccggcaagacgaccctggtgcagcacgcctgcgacgacgatcgggtgcgcgcccacttccccgcgatcctcttctttaacttctcgtgcacctacgccatcgccgcgagcggaggagccgccgccgccctccggtccaaacacgtcatcggcggcgacgctccgctcagcctgatgagcgacccgctgcggtggatcaaggggaatttccagagcaggaggttcctggccgtgttcgaggacgtcgacatgcgcgggaagcagaggctggaggagctcctgcgcaagctgcggtgcgctgcgcgggggagcagggtcatcttcacgacgagcgaccggcgcgtctcgacattgttgggaacggtggagccggtcgtgctcagggtcctgccccggccggagtactggttcttcttcaaggcgcacgcgttcgccggcagggacctcgaggagtgcccgaggctggtggccgcgggcatggcgattgcccggaagctcagcgggtccttcttcggagccaagattgtgggagggctgctcagggaccatccggaccccaggttctggggcagggtgctggggagcaacattgggggcctgtccctgctcggcgatggcatcggttacatcgcggatttggccgagaacctgctcccggatcatgtgaacgttcaccaggtgaccatctccaaggcccccttcgcctcacaggtagagctgccaagattccaggacctgctggtgcgtgaacccggcttggcagggaacaccagctttgtcagagtactgctgtgcaagtcggtgatgccgttctacagcactcactacattgcttcttgcactgttggctcaggaaacagttggtacgagcgcgctatggttccatctagtttcttgttggatcatgtgtagagctctagatagcgtcaagtgaaagccaagcttgtatgtctgtcatccatgatccagctccagcagtgcttccttctgtacatgtgttctcagagtaggagctctgttgtttatgcctgtctttctgtagtttctgaagtatatgtataacgcctgtcatttttcttcttcctaaatgccggcgaaagattgcattc

SEQ ID NO: 18487 - protein, 514 aa, Panicum virgatum
  misc_feature: Ceres CLONE 1797193
  misc_feature (162)..(468): Pfam Name: NB-ARC Pfam Description: NB-ARC domain
MADAIVSAVIGDAVSRVISLLTGRFGAGHQQSTEAKLRRICRTLVRVHAAVEEARGRQITNGGALRWLSELIDGEYQARYLIDTVGLGRGDEQVPPSPRDSSTTSTSPFNPAKRVRVAVKRALSRRDPGGADGDDIDGALESLQEVSAHFGEFILLLQGCRPIRRPLPTSILVDGQMFGRHVEKERVINFLLHGGGGAGELGVLPVVGAIGAGKTTLVQHACDDDRVRAHFPAILFFNFSCTYAIAASGGAAAALRSKHVIGGDAPLSLMSDPLRWIKGNFQSRRFLAVFEDVDMRGKQRLEELLRKLRCAARGSRVIFTTSDRRVSTLLGTVEPVVLRVLPRPEYWFFFKAHAFAGRDLEECPRLVAAGMAIARKLSGSFFGAKIVGGLLRDHPDPRFWGRVLGSNIGGLSLLGDGIGYIADLAENLLPDHVNVHQVTISKAPFASQVELPRFQDLLVREPGLAGNTSFVRVLLCKSVMPFYSTHYIASCTVGSGNSWYERAMVPSSFLLDHV

SEQ ID NO: 18488 - DNA, 1808 bp, Panicum virgatum
  misc_feature: Ceres CLONE 1797199
  misc_feature: Encodes the peptide sequence at SEQ ID NO. 18489
atcccagagaagggagagcagcgggcgcggcggccgaagcagaaacgacacccaagttcccaacgggcggatttttaagtgctcgcacacccgccgccgcccccttcccttccccttccgcccgcccgcccccgcttcgccttctttttacccgtcggccaaagggcagcggcccgcgcagccgggagttggggagcgcttgcttgcctggtgcccatggcggcggcgcgggcgtgcttggtagcgctcgccgtggcggcggcgctcttcctcgagggaactgcagcggcggcggcggcggcggagaatgccggggcggcgtcgctgaagcagcggcggcggcagcttctgcggcagcggcaggtgcgcagccacctcaagcgcctcaacaaggcgccgctcgccaccatcgagagcccagacggtgacttcatagactgcgtgcacatctccaaccagcctgccttcgatcacccgttcctcaagaaccacaccatccagatgcggcctgcctaccacccggaaggcctgtatgatgagtccaaggttgcatctcaacagcagacccagaccatcacccagatgtggcatcagaatggcaagtgcccaaaggacacgatacctatcaggaggaccaagaaggaggacgtcctaagagcaagctctgtgaggaggtatggcaagaagaggcaccgtagcacccccaaccccatgtctgttgaccctgacatgctcaatgagagtggccaccagcacgccatagcttatgtggagggggacaagtactatggcgccaaggccaccatcaatgtgtggcaaccgaagatcgagcaggccaatgaattcagcctgtcccagctctggatcttggggggctccttcggccaggacctcaacagcatcgaagcaggatggcaggttagcccagacctgtatggagacaacaacactaggctcttcacctactggactagtgatgcatatcaagcaacaggatgctacaacctgttgtgctcggggttcatccagataaataatcagatcgccatgggtgccagcatcttccccatctccaactatggtggctcccaatatgacatcaatattttggtgtggaaggacccaaaggagggaaactggtggttgcagttcggtaacaattacgttctaggctactggccgtccttcctcttctcctacctggctgacagtgcctccatgatcgagtggggtggcgaggtagtgaactcggagcctgatggcagccacacctccacacagatgggtagtggccacttcccggaggaagggtttggcaaggccagctacttcaagaacatccaggtggtggactcgtccaacaacctcaaggcgccgaagggcgtgggcgccttcaccgagcagtccaactgctacgacgtgcagaatggcaacaatggcgactggggcacgtacttctactatggcggtcctgggaagaactctaactgtccatagtgaagattgagcttgctatcagagccctaacacccccttgacacctttgtatcatccagtaaattagtctatatacctcattttctttaatcttttttccttgttcttggcttttggtttttacttctacccctagtttattaacttctaggcgagtgtgtgttgacatgtgaatttgttctctgcctcagagatgttggtcgtctgattctagggaggagcgtggtcaagtttctgaagaggaacaggcctgtgtggtttggtttgtgccttgtgtctgtcaagtaattttgtttcaccccatgcctttc

SEQ ID NO: 18489 - protein, 426 aa, Panicum virgatum
  misc_feature: Ceres CLONE 1797199
  misc_feature: Functional homolog of the protein sequence given in SEQ ID NO 50345
  misc_feature: Useful for biocontainment applications
MAAARACLVALAVAAALFLEGTAAAAAAAENAGAASLKQRRRQLLRQRQVRSHLKRLNKAPLATIESPDGDFIDCVHISNQPAFDHPFLKNHTIQMRPAYHPEGLYDESKVASQQQTQTITQMWHQNGKCPKDTIPIRRTKKEDVLRASSVRRYGKKRHRSTPNPMSVDPDMLNESGHQHAIAYVEGDKYYGAKATINVWQPKIEQANEFSLSQLWILGGSFGQDLNSIEAGWQVSPDLYGDNNTRLFTYWTSDAYQATGCYNLLCSGFIQINNQIAMGASIFPISNYGGSQYDINILVWKDPKEGNWWLQFGNNYVLGYWPSFLFSYLADSASMIEWGGEVVNSEPDGSHTSTQMGSGHFPEEGFGKASYFKNIQVVDSSNNLKAPKGVGAFTEQSNCYDVQNGNNGDWGTYFYYGGPGKNSNCP

SEQ ID NO: 18490 - DNA, 1224 bp, Panicum virgatum
  misc_feature: Ceres CLONE 1797203
  misc_feature: Encodes the peptide sequence at SEQ ID NO. 18491
atcgcgacccaaccgcgcgggccggacggtgccctggtgccgcgcgtctccactgatccgcgcgggctcgcccggcgccccggccgggtgagctagcgagcgagctgcatggatcccccggggccagccggggcgtcctcggcgccgggcggcgacgcgcaggcgccgcagcaccatgtgcagccgctggcccaggcgcagccgcaggtcgcgccggcgccggcgccgccgcagcagctgagcaggtacgagtcgcagaagcggcgggactggaacacgttcctgcagtacctgcggaaccaccggccgccgctgacgctggcgaggtgcagcggcgcgcacgtcatcgagttcctcaagtacctggaccagttcggcaagaccaaggtgcacgccgccgggtgcgcctacttcggccaccccagcccgccggcgccgtgcccgtgcccgctgcgccaggcctggggctccctcgacgcgctcatcggccgcctccgcgccgcctacgaggagagcggacacccgcccgagtccaaccccttcgcggcccgcgccgtgcggatctacctccgcgaggtccgcgactcgcaggccaaggcgcggggcataccctacgagaagaaccgcaagcgcaagcagcccgcgccgccggccccaggggaggcggcgccgtcgtcgtcgtcatcgtcatcggcggccgccgcggcggcacgggaggcggcccccccgccacgagcggcggtgacgggtccagtggcaccgcggcggcggcggcggcagctgcaccgacgactggccaggcgggagggagtggcggcgctgctgcaccggccagcacatcatcccgagtatagtagaatcactttgcaaaccatggtctatttgcttctgtacgtctcgctagctatacctcgagctttgcaacatttgagctgctatttctttcttctgccatttggttttcggcgtccttacatcttgctccttagaaattgcctctcctgcttgctgctgtttttttccctcttcctttggctggattatattcttcctgctcccttattgagctagtcattttcactatgctgaattatccagcagctactaggtcagtaataataataatacatggaaatttggcaaaaactgaatgataatatgggcctttctgtttgctcatgtcccatgcatacccatggtgagatcagagcaagatttgaggct

SEQ ID NO: 18491 - protein, 320 aa, Panicum virgatum
  misc_feature: Ceres CLONE 1797203
  misc_feature: Functional homolog of the protein sequence given in SEQ ID NO 50806
  misc_feature: Useful for making plants with modulated low light sensitivity
  misc_feature: Useful for making plants with modulated nitrogen use efficiency
  misc_feature: Functional homolog of the protein sequence given in SEQ ID NO 50807
  misc_feature: Useful for making plants with modulated flowering time
  misc_feature: Functional homolog of the protein sequence given in SEQ ID NO 50808
  misc_feature: Useful for making plants with modulated biomass
  misc_feature: Functional homolog of the protein sequence given in SEQ ID NO 50809
  misc_feature: Useful for biocontainment applications
MDPPGPAGASSAPGGDAQAPQHHVQPLAQAQPQVAPAPAPPQQLSRYESQKRRDWNTFLQYLRNHRPPLTLARCSGAHVIEFLKYLDQFGKTKVHAAGCAYFGHPSPPAPCPCPLRQAWGSLDALIGRLRAAYEESGHPPESNPFAARAVRIYLREVRDSQAKARGIPYEKNRKRKQPAPPAPGEAAPSSSSSSSAAAAAAREAAPPPRAAVTGPVAPRRRRRQLHRRLARREGVAALLHRPAHHPEYSRITLQTMVYLLLYVSLAIPRALQHLSCYFFLLPFGFRRPYILLLRNCLSCLLLFFSLFLWLDYILPAPLLS

SEQ ID NO: 18492 - DNA, 1722 bp, Panicum virgatum
  misc_feature: Ceres CLONE 1797210
  misc_feature: Encodes the peptide sequence at SEQ ID NO. 18493
attatcgtcactccaaatcaccgccgaggaccgccgccaccgcaacgacgcacaccgaggcacaacgcgcctgtttcccgtgcgggcagcagcggctcagggatccctaaggctccctatccaggctcttgcggcagattgaactccaagtaatcctccatcgaggctccctgtccaggctccagcgcggcaggtcaagctccaagtaatcctccatcgcggctccatgtctaggctccagtgcagtaggtcgagctccaagtaatcctccttcgaggctccctatccaagctccagcgctgtccaagcacaaaagggttgacaatcaaagcaagtgcaggaatcgcagcagctcttcttctgttcctgatgatgatgggcgccgccattttcgtcatactacacaagcgaaggaagaagaaacgatccgcctcactggacggcctcatccgtgacggcacgccgctagcgtctcttaggaaagaattcagcatgaccggctcgccgcgcacgcacatcttcagctacgaggagctcgacgaggcgaccgacgggttcagcgaagcccgcgagctcggcgtcggcggcttcgggacagtctacaaaggcattctgagcgacggcagcgtggtggcggtgaagctgcagtacaataacagctacaagggcgtggagcagttcctgaacgaggtggacatcctgtcgcggctgcgccaccccaacctggtcacgctctacggctgcacctcgcagcagagcagccgggaccgcgacctcctcctcgtctacgagttcgtccccaacggcacgctcgccgaccacctccacggcgcgcgcgccggcgccggaccggccacggggtcctcgccgccgctgctcccgtggcccacgcggctcggcatcgccgtcgagacggcgagcgcgctggactacctccacgccgtggagccgcggcaggtggtgcaccgcgacgtcaagaccatcaacatcctccaggacgaagggttccacgtgaaggtcgccgacttcgggctgtcccggctgttccccgccgacgccacgcacgtgtccaccgcgccgcagggcacgccggggtacctcgaccccatgtaccaccagcggtaccagctcaccgacaagagcgacgtgtacagcttcggcgtggtgctggtggagctcatctcgtccaagccggcggtggacatgaaccgcaccagcgcagacgtgaacctggccaacatggccgtgcacatgatccagggccacggggtcgaccggctggtggacccgcggctccggtacgcgacggacggatggacggtcgacgtcgtggccgagatggcgttccggtgcctgcagccggagcaggacgtgaggccgccgattagggaggtgctggacgcgctgagagagttgcagaggatggagcaggctggggatgacgtgggactgctgaggaaaaagagcagggacgggtcgccgcctcgccggacaccgtcatgtacccgtggacaagcccgtccacgacggcccataacagcagttgaggcttattcagagaaatgtttccttttctttcagtgacctgtgtgcacactcttctattaaacatgggccatgcgctagattgataggtacggttgctcagattgttttttttttgacacagttgctcagattgttggtatggatgatcggaggattcctctgaccctctgcact

SEQ ID NO: 18493 - protein, 404 aa, Panicum virgatum
  misc_feature: Ceres CLONE 1797210
  misc_feature (63)..(346): Pfam Name: Pkinase Pfam Description: Protein kinase domain
  misc_feature: SWISSPROT Homolog: EC 2.7.11.1 Non-specific serine/threonine protein kinase
MMMGAAIFVILHKRRKKKRSASLDGLIRDGTPLASLRKEFSMTGSPRTHIFSYEELDEATDGFSEARELGVGGFGTVYKGILSDGSVVAVKLQYNNSYKGVEQFLNEVDILSRLRHPNLVTLYGCTSQQSSRDRDLLLVYEFVPNGTLADHLHGARAGAGPATGSSPPLLPWPTRLGIAVETASALDYLHAVEPRQVVHRDVKTINILQDEGFHVKVADFGLSRLFPADATHVSTAPQGTPGYLDPMYHQRYQLTDKSDVYSFGVVLVELISSKPAVDMNRTSADVNLANMAVHMIQGHGVDRLVDPRLRYATDGWTVDVVAEMAFRCLQPEQDVRPPIREVLDALRELQRMEQAGDDVGLLRKKSRDGSPPRRTPSCTRGQARPRRPITAVEAYSEKCFLFFQ

SEQ ID NO: 18494 - DNA, 1482 bp, Panicum virgatum
  misc_feature: Ceres CLONE 1797219
  misc_feature: Encodes the peptide sequence at SEQ ID NO. 18495
atcgcgccacgcagacgcgaaattcccgagacctaagcgcaagcccccaacgaaaccgaaaggaaatccagtgagggatcacgagttccaccgagatggcgagggacgcgggcagcggcggccgccgcctgacgcggctccgcacgctcggccgcggcgcgtcgggcgccgtcgtgtcgctcttcgcggcgggcgacgagggcgagctcctggccgtcaagtcaacggccggcgccgcgggggcggcgcagctgcggcgcgagggcgggatcatggccgccctccgctcgccgcacgtgctcccctgcctgggcttccgcgccgccgcggacggggagttccagctgctcctcgagttcgcgcccggcggctcgctggccgacgaggtggggaggaatgggggccgcctcgcggaggccgccgtgcgggcgtacgcggcggacgtgacccggggcatcgcgtacctccacggggaggagtccgtggtgcacggggacgtcaaggcgaggaacgtggtgatcggcgccgatgggcgcgccaagctcgcggacttcgggtgcgctaggcgcgtgggctccaagggcccgatcagcggcacgccggcgttcatggcgcccgaggtggtgcgcggggaggagcagggccccgccgccgacgtctgggcgctgggatgcaccgtcatcgagatggccaccgggcgcgccccgtggaccgacctggacctggaggacgtggtcgcggtggtgcgcctgatcgggtacacggacgccgtgccggaggcgccggagtggctgtccgcggaggcgaaggatttcctgggcaagtgcctgaggcgtgacgccggcgagcggtggacggcggcgcagcttctggagcacccgttcctggcatccgcgggctgcggcgtcaaagcagaggacgcgaagaccaagtgggtgtctcccaagagcactctggatgccgcattttgggagtcggacgccgacgacgaggacgatgagatgccagagagcgcagctggcaggatcagggcattggcaggcccaccctcggccttgccggagtgggaatccgacgatggttggatcgaagtgtgcggcggttgctctgaactttctgacgccgcggccggtggccaagaagtgaaatttccaagcgcgcaatgtgaatttcccagcacggcggtggcggcatcatcggagcaggtgcacggtgaagttcctgatgttccatccgtggctgcgccgccagccgagacgacgagctacgaaaacttctggggggacgagtccgaagcagagctggagactgagccttttggcgctgacttggatgttggcgatgatcctgtgcacaatgtaggcgcgggcgatgcctatgtgcatcagcaacagctagattttcatgtgaatttcaccagtaatccaattgtacttcatattggtatttctgaagaaataacaaaaacttccttttatggtc

SEQ ID NO: 18495 - protein, 462 aa, Panicum virgatum
  misc_feature: Ceres CLONE 1797219
  misc_feature (12)..(264): Pfam Name: Pkinase Pfam Description: Protein kinase domain
  misc_feature: SWISSPROT Homolog: EC 2.7.11.25 Mitogen-activated protein kinase kinase kinase
MARDAGSGGRRLTRLRTLGRGASGAVVSLFAAGDEGELLAVKSTAGAAGAAQLRREGGIMAALRSPHVLPCLGFRAAADGEFQLLLEFAPGGSLADEVGRNGGRLAEAAVRAYAADVTRGIAYLHGEESVVHGDVKARNVVIGADGRAKLADFGCARRVGSKGPISGTPAFMAPEVVRGEEQGPAADVWALGCTVIEMATGRAPWTDLDLEDVVAVVRLIGYTDAVPEAPEWLSAEAKDFLGKCLRRDAGERWTAAQLLEHPFLASAGCGVKAEDAKTKWVSPKSTLDAAFWESDADDEDDEMPESAAGRIRALAGPPSALPEWESDDGWIEVCGGCSELSDAAAGGQEVKFPSAQCEFPSTAVAASSEQVHGEVPDVPSVAAPPAETTSYENFWGDESEAELETEPFGADLDVGDDPVHNVGAGDAYVHQQQLDFHVNFTSNPIVLHIGISEEITKTSFYG

SEQ ID NO: 18496 - DNA, 420 bp, Panicum virgatum
  misc_feature: Ceres CLONE 1797220
  misc_feature: Encodes the peptide sequence at SEQ ID NO. 18497
agacttattgatggactcaagagagtatctgtcagcaacccagtgatgcttctcgacgaaattgacaagactggttctgatgtacgtggggatccagcgtcagcactactagaagttcttgatcctgaacagaacaaaacattcaatgaccactatttgaatgttccgttcgacctgtcaaaggtcatatttgttgcaactgccaacaggatgcaacctatcccacctcctctcttagataggatggaggtcattgagctaccaggttacacacctgaagagaagctcaaaatagccatgaaacatctgataccaagggtattggagcagcatggcttgagttcggcgtatcttcagattcctgaggctatggtcaaactgatcatcgagagatacacgagagaagctggagtacgtaat

SEQ ID NO: 18497 - protein, 139 aa, Panicum virgatum
  misc_feature: Ceres CLONE 1797220
  misc_feature (5)..(139): Pfam Name: AAA Pfam Description: ATPase family associated with various cellular activities (AAA)
  misc_feature: SWISSPROT Homolog: EC 3.4.21.53 Endopeptidase La
RLIDGLKRVSVSNPVMLLDEIDKTGSDVRGDPASALLEVLDPEQNKTFNDHYLNVPFDLSKVIFVATANRMQPIPPPLLDRMEVIELPGYTPEEKLKIAMKHLIPRVLEQHGLSSAYLQIPEAMVKLIIERYTREAGVR

SEQ ID NO: 18498 - DNA, 1637 bp, Panicum virgatum
  misc_feature: Ceres CLONE 1797230
  misc_feature: Encodes the peptide sequence at SEQ ID NO. 18499
atcaaacaggcacgcattttgcccggatcgctcgcttccgccgccgccgccgctgccatggagaaggagaagaagctctcgttctccatctcctcctccaagcagcggccgcccaagcctccctcacgccccgcggccgccgcggacgacgatgacgctggcccacggtccgcgtccgcccctgcccagcagttcgtcaccgagttcgacccatcccaaaccctagccgcctccggcgcgccgcgcgccgtcatcgcgccgctccccaactccggcaacttcctcacccaccgcccccgcaagccgtcctcgctccccacccccgaagaggaggccgccctcgcagcggaatccggcggcgggggaccctcgttcgtgctcgacacctccaacgcccccgccgacccatcatccaacatcccttacggccttaccctccgcaacggcgccaccgagaccgccgctgccaaggaatcggagaaggcgtcaccaccgacaccgcctccggctcctccagccgcagctgatgccaccccggccggcgatctcatgctgcggcgatacaaggaggacatggctagccttccggaccaccgtggcattgatgagttcaacgagatgcctgtggagggattcggcgcagcgctactggctggatacggctggacagagggtaagggtattggtaggaacaataagaccggggataccaaggttgttgagtacgaccgccgtgctggtacacaggggttaggctacaacccctccgaggttgaccctcgcaagacccgctctggcgactggattgttggcgagaagaaggcgtctgagaatgggtctgcgaagaagagggacagagatagtagagataggatggatgatagtgattctagcgcccggaagaagagatcaggtgagcaaagggctgagaaggagacccgtggaaaggagaggaatggacaggatagccgagaaggcacaagtaatggcaatgatactcgtagcaaggccatccggtggttacagagccatatcagggttcgcgtagttagcgagaagttgagtaagaggctgtacttgatgaagggtaaggtcgtggatgtagtaggaccaacaacatgtgacattatgatggatgatggatcactggcgcagggggttgaacaggatatgcttgaaactgtacttccacggacaaatgggcgagttctcgtgctctatgggaagcagaagggtatgtatgggcacctggttgagaagaattctgtagaggagattggactggtggaggatgcagatacaaaagatatagtgcgaattagatatgaccagatggcagaatacactggagacccagagctccttggctactgattaatttctttttgagcaaatatttgcttaccaggagctcatccactgtgttaggtaatgtccatttcctttttttttctatcacaaacaatagttgcttcgacaatgtaaaatctcaaatgaactgtcagtatggtatgcatttgcttgtatatgtaaggctgctacttaaatgtcagtcctcagtgctaatcgatgatttgggaggtgacctcttgtactaatgtggggctctttgaataaattgtggaatgtttctttac

SEQ ID NO: 18499 - protein, 438 aa, Panicum virgatum
  misc_feature: Ceres CLONE 1797230
  misc_feature (190)..(235): Pfam Name: G-patch Pfam Description: G-patch domain
MEKEKKLSFSISSSKQRPPKPPSRPAAAADDDDAGPRSASAPAQQFVTEFDPSQTLAASGAPRAVIAPLPNSGNFLTHRPRKPSSLPTPEEEAALAAESGGGGPSFVLDTSNAPADPSSNIPYGLTLRNGATETAAAKESEKASPPTPPPAPPAAADATPAGDLMLRRYKEDMASLPDHRGIDEFNEMPVEGFGAALLAGYGWTEGKGIGRNNKTGDTKVVEYDRRAGTQGLGYNPSEVDPRKTRSGDWIVGEKKASENGSAKKRDRDSRDRMDDSDSSARKKRSGEQRAEKETRGKERNGQDSREGTSNGNDTRSKAIRWLQSHIRVRVVSEKLSKRLYLMKGKVVDVVGPTTCDIMMDDGSLAQGVEQDMLETVLPRTNGRVLVLYGKQKGMYGHLVEKNSVEEIGLVEDADTKDIVRIRYDQMAEYTGDPELLGY

SEQ ID NO: 18500 - DNA, 1732 bp, Panicum virgatum
  misc_feature: Ceres CLONE 1797234
  misc_feature: Encodes the peptide sequence at SEQ ID NO. 18501
gttcaattcacatctccctccctccctccagcccggccgcgctctcgatcgatccatccgtgttcttcttcattcctgtataccacacacctagctcgatcagctgttgattcttcctctcctgctgctaattaatttattccgcccacgctcaccaataagctcagctattaggaagctgagtaagaggtggtgcaagatttattccgaaggatacatagagctgagcttcagatagcagtctctgttggcgattgggtgatcgatcgatcgaggatgtgcaccaggggccactggagaccatcggaggacgagaagctgaaagagctcgtcgcgctatacgggccgcacaactggaacgccatcgccgagaagcttcaagggagatcaggtgctgtgatcaagactatgtatgatctcatcagatagatgcagcagcatgtatatgcacgatgcgtgtttgagttttctgttggctgggagctatgttggtctgcttaattctttcctttcggttcgatttttttttttggcgtcgagtttgactttgtgcttaggcatgcgcatgtttagttaaaagaagttaagatctgttagcctgtcatatcagaggtgtgctcatcagccattcctcctcatcgtcgacacacgaaaacgaacgtgctctcttccccctctgccactccaccccgggaaagctgcgaagcatggcgtccgtcaccgcccgcgccccggtcgcggccctgcgcccgtcgtcggcgtcgctcaggtcgtcgtcggccttcctcggccactccagccgcctcggccgcgccgccgcggcgtcgtcgacgaggcgcagcctcaaggccgaggccaagggcgagtggctccccggcctcccctcacccgcctacctcgacggcagcctgccgggcgacaatgggttcgacccgctgggcctggcggaggacccggagaacctgcggtggttcgtgcaggcggagctggtgaacgggcggtgggcgatgctgggcgtggccgggatgctgatcccggaggtgctgaccaaggctgggctcatcaacgcgccgcagtggtacgacgccggcaagtcggagtacttcgcgtcgtcgtccacgctgttcgtcatcgagttcatcctcttccactacgtcgaaatccggcggtggcaggacatcaagaaccccggcagcgtcaaccaggaccccatcttcaagagctacagcctgccgccccacgagtgcggctaccccggcagcgtcttcaaccccctcaacttcgcccccacgctcgaggccaaggagaaggagctcgccaacgggaggctggcgatgctggcgttcctggcgttcctgatccagcacaacgtcaccggcaaggggcccttcgacaacctgctgcaccacctgtccgacccatggcacaacaccatcatccaaaacatctccggttgagtcgatgacggagagcgatcgtcaatttggcggtggtgctagctgatggggatcgattgggagacaaacattgagacgcggtcgagtcgatcgatgtgagttccttcctgtggatcgatcatcagtatgtgatgtgtgcagtgttcagtctggagaggagaattcagggcgtgttgtaatgatgtgtacgcatggtgaggaggagagtgtgaggagtgattggtatgtacattaatgacaggggaggttaagggtagagattgtttgatcagtat

SEQ ID NO: 18501 - protein, 249 aa, Panicum virgatum
  misc_feature: Ceres CLONE 1797234
  misc_feature (59)..(221): Pfam Name: Chloroa_b-bind Pfam Description: Chlorophyll A-B binding protein
MASVTARAPVAALRPSSASLRSSSAFLGHSSRLGRAAAASSTRRSLKAEAKGEWLPGLPSPAYLDGSLPGDNGFDPLGLAEDPENLRWFVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAMLAFLAFLIQHNVTGKGPFDNLLHHLSDPWHNTIIQNISG

SEQ ID NO: 18502 - DNA, 1941 bp, Panicum virgatum
  misc_feature: Ceres CLONE 1797235
  misc_feature: Encodes the peptide sequence at SEQ ID NO. 18503
gcacaaccacacatgcatcctctacaacaaacccaggtgtgtgcttcagcagtaaacattcggttcttggttagcctccattgccattgctctctactcgatctctagcagactcggatccatctgcaagcatggagcagctcacgtactaccttctggcgctccttctccctctcctgcttctcaagctcatcacgaggcgcgatgacggcaatggcctgaggctgccgccgggcccgtggcagctgccggtcatcggcagcctccaccacctgctcggcagcccgctgccgcaccgcgccatggcccgcatcgcgcgccgcctcggcgcgccgccgctcatctacttccggctcggggaggtccccgtggtcgtggcgtcgtccccggccgccgcccgcgaggtcatgaagacgcacgacgccagcttcgccacgcgcccgtggacgcccacgactagggtccgcatggaggacggcgaggggctggtgttcgcgcgctacggcgcgctgtggcggcagctccgcaggatcagcgtcctggagctgctcagcgcccgccgcgtccactcgttccgcgccgtccgggaggaggaggcccgccgcctcgtggccgccgtcgccgccgccgcggccggcgagggcggcgccgccgtcaacgtcagcgagcggatcgccgtgctcgtcacggacacggccgtgcgcgccatgatcggcgaccggttcgagaggcgggaggagttcctggcgaacctcgcggagggggtcaagatcacctccgggttcaacctctgcgacctgttcccgtcgtcgaggctcgccaggcttgtcagcggcacggaacgccgggcacgggaaaatcaccgccggcagtccgagctcatggaccacgccatcaagcagcacgagcagcggagggaggcggccatggtacaatctgcggatggcaccgtggaaaaggaggagaacctgatcgacgtgctccttaggattcagagggaaggcggcctcgaggtgccgctcaccatgggtatgatcaaggccgtcatccttgatcttttcggtgccgggagcgagacatcagcaaccacactccaatgggccatgtcggagctcgcaagaaacccagaggtgatgcacaaggcgcaagccgaggtgcgcgagaagcttcaaggcaagccaatggtggccgaggataaccttgccgacctgaggtacacgaagctcatcatcaaggagaccctgaggctgcacccggtggtgccgctgctggtgccaagggagtgccgggagtcctgcaaggtcatggggtacgacgtccccaggggaaccaccgtgttcgtcaacgtctgggcgatcagcagggacccctggcactggggcgccgacgccgcggcgttccggccggagcggttcgaggccggcacggtggccgacttcaagggcgccgacttcgagttcacgccgttcggggccggccggaggatgtgccctggcatggcgttcgcgcaggcgagcatggagctcgccctcgccgcgctcctctaccatttcgactgggagatgccgggtgggatgctgccgggcgagctggacatgacggaggagatgggcatcgccgtccggaggaagaatgacctttacctgcgtccggttgtccgtgtgccgccacatgtaacaccatagaactactcgtcatggtgaggtcctctgctcttgtgctggatcgaggagaggcgcttattgctaaattagcaggggtctttatgtaaaatattggatcgctattattaattgtgatccaaagtatgaatgtttttataaaataccaatctagtatttacacaaaacactgtagtttggatcatgttaatggtcgtgatccaaaccaggggttagtggaaaagtttgataaggtaatttttataaacccgcgatttgg

SEQ ID NO: 18503 - protein, 517 aa, Panicum virgatum
  misc_feature: Ceres CLONE 1797235
  misc_feature (33)..(506): Pfam Name: p450 Pfam Description: Cytochrome P450
  misc_feature: SWISSPROT Homolog: EC 1.14.13.68 4-hydroxyphenylacetaldehyde oxime monooxygenase
MEQLTYYLLALLLPLLLLKLITRRDDGNGLRLPPGPWQLPVIGSLHHLLGSPLPHRAMARIARRLGAPPLIYFRLGEVPVVVASSPAAAREVMKTHDASFATRPWTPTTRVRMEDGEGLVFARYGALWRQLRRISVLELLSARRVHSFRAVREEEARRLVAAVAAAAAGEGGAAVNVSERIAVLVTDTAVRAMIGDRFERREEFLANLAEGVKITSGFNLCDLFPSSRLARLVSGTERRARENHRRQSELMDHAIKQHEQRREAAMVQSADGTVEKEENLIDVLLRIQREGGLEVPLTMGMIKAVILDLFGAGSETSATTLQWAMSELARNPEVMHKAQAEVREKLQGKPMVAEDNLADLRYTKLIIKETLRLHPVVPLLVPRECRESCKVMGYDVPRGTTVFVNVWAISRDPWHWGADAAAFRPERFEAGTVADFKGADFEFTPFGAGRRMCPGMAFAQASMELALAALLYHFDWEMPGGMLPGELDMTEEMGIAVRRKNDLYLRPVVRVPPHVTP

SEQ ID NO: 18504 - DNA, 1617 bp, Panicum virgatum
  misc_feature: Ceres CLONE 1797241
  misc_feature: Encodes the peptide sequence at SEQ ID NO. 18505
agtgcggactgcccaccccaccccagccaggccactccgccgtttcttcctcccgaaactttctttccccttccccaatcctcccaacccccagagctcggcggcgacggcgcgggcgagtcgagcgcgccgccatgaaggtctccatcaagacgctcaagggctccagcttcgagatcgaggtggacccctccataaaggttgctgatgttaaaaagctcatcgagactacacaagggcagaatgtctacccagctgatcaacagatgcttattcatcaagggaatgttctaaaaaatgagacgacacttgaagagaacaaagttctggagaacaatttcattgttataatgttgtccaagaagggatcatcaagtgctgcttcagctactgctaaggctcccacaagtcaggcctcagttgatagggcgattcctgcctctcctgcaactcaaccaccagcagcagcaccagcacctgttgcgcctgttagtgcacctgccccaactgcagcagctggtccagctcccactgttgcggcaattgcgcctgttagtgcacctgccccaactgcagcagctggtccagctcccactgttgcggcaatcactgaagtggatccttatggtcaagctgtgtcaaaccttgttgctggtgacaatctagaagcaactatacattctattcttgaaatgggcggaggtgcatgggaccgtgacaccgttgtgcgggctcttcgggctgcatataacaacccagagcgtgctgttgaatatttatattctgggattcctgagccggaagaggcccctgctgctgctgctgcaccagctcctgcaagcggccaaccggctgatccagttcaggctccacaatcagcgcaacctgcaattccatcttctggacccaatgctaatcccttggacctgtttcctcaggccctgccgaatgctgcttcaaatgctgctggtggtgaaaatctcgatgttctgcgaaataatacacagttcagaggtttgctttccttggtgcaggctaaccctcaaattttgcagcctttgcttcaagaactagggaaacaaaatccacagattatgcagctgattcaggaaaaccaagccgagtttctgcatttgatcaatgaacccgcagtgggagctgaagggagtttgctagatcagtttgctgatgctgaaatgcctcaaacaatagcagtgacacccgaggagaatgaagctatacagcggcttgaacaaatgggctttgaccgcgatctggttctagaggttttcttcgcctgcaacaaggatgaacagatggctgccaactatctgttggaccatatgaatgactttgacgaagctcagcaatagggtgtcagatggcttgaagtacatggctgatgatgcgacttaattcagaatgcagtatcagtgttttgaaggctgattaccccaatttagggtgtcgtgaagagctattttgagtttctcaatcatcctttttttttctgtttgggattcatgttaagtgcgagatatagctaggtgttacagtgtcgacgggatggttggttaactggatctaatgttataggttaagaatcgagcgtgttct

SEQ ID NO: 18505 - protein, 412 aa, Panicum virgatum
  misc_feature: Ceres CLONE 1797241
  misc_feature (283)..(341): Pfam Name: XPC-binding Pfam Description: XPC-binding domain
  misc_feature (176)..(215): Pfam Name: UBA Pfam Description: UBA/TS-N domain
  misc_feature (364)..(400): Pfam Name: UBA Pfam Description: UBA/TS-N domain
  misc_feature (6)..(79): Pfam Name: ubiquitin Pfam Description: Ubiquitin family
MKVSIKTLKGSSFEIEVDPSIKVADVKKLIETTQGQNVYPADQQMLIHQGNVLKNETTLEENKVLENNFIVIMLSKKGSSSAASATAKAPTSQASVDRAIPASPATQPPAAAPAPVAPVSAPAPTAAAGPAPTVAAIAPVSAPAPTAAAGPAPTVAAITEVDPYGQAVSNLVAGDNLEATIHSILEMGGGAWDRDTVVRALRAAYNNPERAVEYLYSGIPEPEEAPAAAAAPAPASGQPADPVQAPQSAQPAIPSSGPNANPLDLFPQALPNAASNAAGGENLDVLRNNTQFRGLLSLVQANPQILQPLLQELGKQNPQIMQLIQENQAEFLHLINEPAVGAEGSLLDQFADAEMPQTIAVTPEENEAIQRLEQMGFDRDLVLEVFFACNKDEQMAANYLLDHMNDFDEAQQ

SEQ ID NO: 18506 - DNA, 1869 bp, Panicum virgatum
  misc_feature: Ceres CLONE 1797244
  misc_feature: Encodes the peptide sequence at SEQ ID NO. 18507
acgaagccagcgaaaatccagtagagagagagaggggcagaggggagggaggcaggaggcagccggcagccattactcccaccagccagcaccaccaccgctgctgctggggacgcctgcagcaagtacaggcggatatccgcttccattactgtatctcgcggcggcggaccagcggcggcagagggttcgcttcggcggccgcaataaattccgcaccccccccacccccatggcaaggagggccgcctcctcgctcgtctcccgctgcctcctcgccagcagggccgcctcggcaggcgccgcgcccgctgtcccctccgcgctccgcaggccagatgggacgcgcggattgttgccaggggtccttcaaaggttcagcactgcagcagcagcagaggagcccatctcgcccccagtccaagtgaactacacaaagctcctcatcaatggcaactttgttgattccgcatccggcaagaccttcccaacactggaccctcgtacaggggaggtaattgctcatgtggctgaaggtgacgcggaggatgttaaccgtgccgtcgctgcagcacgcaaggcttttgatgaggggccgtggccgaagatgactgcatatgagaggtcccttatcctgctacggtttgctgatttgatcgagaagcacaatgacgagattgctgctttggagacatgggacaatgggaaaccatatgaacaagctgcccaaattgaagtaccgatggtggcccgtcttatgcattactatgctggttgggctgataagatccatgggctcgttgtgccggctgacggaccacaccatgtacaggtcttgcacgagccaattggtgttgcaggtcagatcatcccatggaacttcccactgctgatgttttcctggaaagttggccctgctttggcatgtgggaacactcttgtgctcaagactgccgaacaaactcctctttcggccttgtacatctccaagttgttgcatgaggctggactccctgagggtgtcgtgaatgttgtctctggttttggtcctactgctggtgctgctcttgctagtcacatggatgttgataagcttgcattcactggatctaccgacactggaaaaattgtacttgagttggccgcaaggagcaaccttaagccagtgacactggagttaggaggcaagtctccttttgttatcatggacgatgccgatgttgaccatgctgttgagcttgcacactttgccctgttctttaaccagggacaatgttgctgtgctggatctcgcacgtttgtacatgagcgtatttatgatgagtttgtggagaaggccaaagctcgtgcattgaagcgtgttgttggtgatccattcaagaaaggtgtagaacagggccctcagattgacgatgagcaattcaacaagatcttgcgctacattaggtctggtgtcgacagtggagctacccttatgacaggtggtgataggttgggtgacaaaggtttctacatccagccaacgattttctcagatgtacaggacggcatgaagattgctcaagaggagatattcgggcctgttcagtcgatcttgaaattcaaagatctgaatgaggttatcaagagggcatggactgcagacgttcatttcctctctacatcccaaacaatgtgaagatggcgatgatcggatcgaagacgatgaagaagatgaagatcagctctaataagattcccccaataagcctttggttggtgcctatcttgtgtaatttggttcctcccttttgctttgagatgagactgttatattgtagcagcagaaaaagaagttggaagtgccagtggtcagcttgtttcatttgt

SEQ ID NO: 18507 - protein, 481 aa, Panicum virgatum
  misc_feature: Ceres CLONE 1797244
  misc_feature (76)..(481): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Functional homolog of the protein sequence given in SEQ ID NO 50708
  misc_feature: Useful for making plants with altered carbohydrate content
MARRAASSLVSRCLLASRAASAGAAPAVPSALRRPDGTRGLLPGVLQRFSTAAAAEEPISPPVQVNYTKLLINGNFVDSASGKTFPTLDPRTGEVIAHVAEGDAEDVNRAVAAARKAFDEGPWPKMTAYERSLILLRFADLIEKHNDEIAALETWDNGKPYEQAAQIEVPMVARLMHYYAGWADKIHGLVVPADGPHHVQVLHEPIGVAGQIIPWNFPLLMFSWKVGPALACGNTLVLKTAEQTPLSALYISKLLHEAGLPEGVVNVVSGFGPTAGAALASHMDVDKLAFTGSTDTGKIVLELAARSNLKPVTLELGGKSPFVIMDDADVDHAVELAHFALFFNQGQCCCAGSRTFVHERIYDEFVEKAKARALKRVVGDPFKKGVEQGPQIDDEQFNKILRYIRSGVDSGATLMTGGDRLGDKGFYIQPTIFSDVQDGMKIAQEEIFGPVQSILKFKDLNEVIKRAWTADVHFLSTSQTM

SEQ ID NO: 18508 - DNA, 2162 bp, Panicum virgatum
  misc_feature: Ceres CLONE 1797248
  misc_feature: Encodes the peptide sequence at SEQ ID NO. 18509
gtgtcttgtctctgcctctctctctctctctctctctctctctctctcggtagtgaccctgcaatggccgacgagcccctggatgcgtccccgtcggcgccctccgccgccgcggacgcggacgcggacggagttttctctccctcctcggccgccgccgcccccgccccagcgctccggccgcggcgggaggcgttcgagcacgggctcctgccgatccccaagctgatcttcccggagggcacgcttacgcaaaccctagcccagctgaaggagaggctcgcgccgcggggcccgcgggtgggcgccgcggcgctcgcggaggctctgcagatccccgccgagcaggcggcgctggcgctcgggacgctcgccgcggtgctccccgccgaggaccccgcgctcggcgaggatggcgtgggggaggccgacctccgcgacctgctcctcttcctctacatccagtcctacaagcgcctcgtgccgcgcggccacaaggactcgcccgccgtcgcggacgtgtggccgtccacctccgccttcgacgggtgcctctccgcgctatccccgatccagtttatacgctgcaatagtcgtcggtttatgccttcacaagcagatgaagaagctcatcaattatcatatttgcaaaaacatatggccaacatcctaacacttttggcagattctattgatggagagggcgatgattctatggtattgactgtggagacctttgaacaccttggatttttgttgcagctctctgaaggaactcctttaagccaaggagctagcttttttgcaaattctgatccagacatgcctgctgctcctgtacctgctagtctggttcatgattggatattgcagcatataacttcaacattagaatttatggcagagaagtcctcagcaaaagaaaacagccaacagaatgcatctgatcctgatgtcacaatgtctgatgctgtcacgaatacaagaattcatagcagttcacctactggaacttctgccccaaataattctggatattaccgaaatacaacatttgtggagggtttgtccaaaacttctgttgtcaaacaagcatctgatatgaaagggcattcaattaaggttttgaactgccatgattctgttatctacattttagccccacttaagtatgcaaccgtctatggatgttctgacactaccatcgttcttggtgctattggtaaggttgtaaaagtggagcattgtgaacgagtacaaattattgcagcttcgaaacgaatttgtattgccaattgtcgtgaatgtaccttctacttgggagtaaataaccaaccacttattgtgggggacaaccataaattacaagttgctccattcaatacttattatccacaactgggggagcatttggcacaagttggtgtggatcctaatgtcaacaagtgggacaaacctttcgtattggaagttgttgatccacacgattcattctctcatcctgctggggtttctgatgtccaggccgagtctgccacttgtctagacccagatctatttatgaactttttgattcctagttggttcgagccacaagggcctaccagatacaatccatttaccttgcctgaagtttattgggcatcccaaaggaaaaagcatgcttctctggaagatactcaaaagaatattcgggaactagagattgatgataaccggaagaaagaattggcatgtgcccttcatgctcagttcaaagattggttatatgcttcaggcaatatccgccagctctactgtttgcaaggtgaataagtgcggggttcatctgtaagtgcgtatatgcatgtgcgggattgtcctccaaccattccattccgcgcatccaagacatccaagcggactggttgtgacttggctgtgcagaatgcagatggccgttgagcctatagtgtttgtggagggaagtatgtaaagcatgttgtgtgttatttgtttctaattaaattttgatacttccctccctttgttggtcgtagggtcgctgtaaatcttcggttttttctggcttcgtatttatatccttcataagacttgctgaatagcggttactcaattctttcatctcggcctctcgtggggaataacattttttgaccatc

SEQ ID NO: 18509 - protein, 583 aa, Panicum virgatum
  misc_feature: Ceres CLONE 1797248
  misc_feature (349)..(466): Pfam Name: TBCC Pfam Description: Tubulin binding cofactor C
MADEPLDASPSAPSAAADADADGVFSPSSAAAAPAPALRPRREAFEHGLLPIPKLIFPEGTLTQTLAQLKERLAPRGPRVGAAALAEALQIPAEQAALALGTLAAVLPAEDPALGEDGVGEADLRDLLLFLYIQSYKRLVPRGHKDSPAVADVWPSTSAFDGCLSALSPIQFIRCNSRRFMPSQADEEAHQLSYLQKHMANILTLLADSIDGEGDDSMVLTVETFEHLGFLLQLSEGTPLSQGASFFANSDPDMPAAPVPASLVHDWILQHITSTLEFMAEKSSAKENSQQNASDPDVTMSDAVTNTRIHSSSPTGTSAPNNSGYYRNTTFVEGLSKTSVVKQASDMKGHSIKVLNCHDSVIYILAPLKYATVYGCSDTTIVLGAIGKVVKVEHCERVQIIAASKRICIANCRECTFYLGVNNQPLIVGDNHKLQVAPFNTYYPQLGEHLAQVGVDPNVNKWDKPFVLEVVDPHDSFSHPAGVSDVQAESATCLDPDLFMNFLIPSWFEPQGPTRYNPFTLPEVYWASQRKKHASLEDTQKNIRELEIDDNRKKELACALHAQFKDWLYASGNIRQLYCLQGE

SEQ ID NO: 18510 - DNA, 705 bp, Panicum virgatum
  misc_feature: Ceres CLONE 1797253
  misc_feature: Encodes the peptide sequence at SEQ ID NO. 18511
gacccacccttgctgctcgatctccccgcagccgcgacagcgcgacggcagccggcactgatcgatgatgacgccggcggcggcggcagggccgcggcagcgccgcctccggccagccggacccggcgaccgcctctgctcccgttgcgccctcgtcgtcttcctgctcgccgcctgtgcctcccccggctccgggcgggtggtgaccagcctccccggcttcgacgggcccctccccttccacctcgaaacagggtacgtggaggtggacgcgcagaacggcgccgagctcttctactacttcgtcaagtccgagtccggcgccgccgcgcctttcctcctatggctcacgggcggcgaccgctgctccgtcttcagcggcctcgccttcgagatcggtcccgtcaggttcgtcgcagagccctacgacggcacgttgccgcgcctgcagtacaaccaaaactcgtgggccaaggtgtcacatatcctatttgtcgattcgccggttggggctgggttttccttttctagagaacctaaaggctatgatgttggagacatctcatccacactacaactatatgacttcctcatcaagtggtttaatgaccaccctcagttcctcacgaatcctttctatattggtggagactcctacgccggaaaaattgcgccatttcttgcgcaaattatttcagaaggtat

SEQ ID NO: 18511 - protein, 213 aa, Panicum virgatum
  misc_feature: Ceres CLONE 1797253
  misc_feature (51)..(213): Pfam Name: Peptidase_S10 Pfam Description: Serine carboxypeptidase
  misc_feature: SWISSPROT Homolog: EC 2.3.1.91 Sinapoylglucose--choline O-sinapoyltransferase
MMTPAAAAGPRQRRLRPAGPGDRLCSRCALVVFLLAACASPGSGRVVTSLPGFDGPLPFHLETGYVEVDAQNGAELFYYFVKSESGAAAPFLLWLTGGDRCSVFSGLAFEIGPVRFVAEPYDGTLPRLQYNQNSWAKVSHILFVDSPVGAGFSFSREPKGYDVGDISSTLQLYDFLIKWFNDHPQFLTNPFYIGGDSYAGKIAPFLAQIISEG

SEQ ID NO: 18512 - DNA, 610 bp, Panicum virgatum
  misc_feature: Ceres CLONE 1797253-R
  misc_feature: Encodes the peptide sequence at SEQ ID NO. 18513
acccaggcctgggtcaggtcgctcaacttctccatcgttgacgactggagggcgtggcatctcggcggccaatccgccggattcacgataagctattcaaacaacatgacattcgcgacgatcaagggtgctgggcacacggcgccagagtacgagccggagaggtgttttgccatgttcagacgctggatactcaaccgcccactttaagtacccactcactcgtcccatacatcctcccccacccccccaccccccgcccgcccccccgcgcgcgcgcgctcccacccactccctcgctcgcgcgcgctcccgcccgctcgctctctctcgctctctctttctttctttttttcattttttcgctcattcgcgctcgaaatacttctctcccgcacactccatccccatcggtacccatagatacacatactatatatatatatactatatatatatatatatatatatatatatatatatatatatatatatatatatatatatatatatatatatgtatatatatatatgatgcgtccgtacatcgtacgcgaatggtatacatgtgtgattctcaagcaataacatttgcgtcagtttcaaactc

SEQ ID NO: 18513 - protein, 69 aa, Panicum virgatum
  misc_feature: Ceres CLONE 1797253-R
  misc_feature: SWISSPROT Homolog: EC 2.3.1.91 Sinapoylglucose--choline O-sinapoyltransferase
  misc_feature: Functional homolog of the protein sequence given in SEQ ID NO 50513
  misc_feature: Useful for biocontainment applications
  misc_feature: Useful for making plants with modulated biomass
  misc_feature: Useful for making plants with modulated flowering time
TQAWVRSLNFSIVDDWRAWHLGGQSAGFTISYSNNMTFATIKGAGHTAPEYEPERCFAMFRRWILNRPL

SEQ ID NO: 18514 - DNA, 1703 bp, Panicum virgatum
  misc_feature: Ceres CLONE 1797276
  misc_feature: Encodes the peptide sequence at SEQ ID NO. 18515
atcccatccgcctcctccccctcctccctccgccttaaccctccctcccctccaccaccgccgcttcatcccctcccccccgaggcggccgacgctcccatgcccgccggcgcccggcccgacaagcccgaaccggaccgcgcggcctagcggtgctgtttttttcttctttttctggctagccagcccgcgagggaagcgatggcgaagccgaccccggtggcctcggcggaggaggcggcggcgctgcggcgccggctgaggcgtctggtggccgcggtggcggccgggagcgccgacgcggaggcctttgacgaggcggccgaggcgctcgccaagctcagggacggcgagctcggcccccgcaaggaccgcgctgttgccgctggcggcggggtggacaagggcggcacggaggctgccgcggtcccggagcagttcctgtgccccatctcctcggagatcatgagggatcccgtcgtcctcgcctccggccagacatatgaccgtcgcttcattcaagaatggttaagtgctggaaaccgaacatgtccacagacccagcaagtcctttcaaatacaattctcatcccaaaccatcttgtgagaagcatgatctcacagtggtgcacggataatgggatcactctgccaccagttgagaaccaagaagaagatctggtcacaaataatgagcggaagacatttagtaaaatatttgaaaggattgcatcatcgtcaaacctatctgagcagagggaagctattaaagatctcaggctgctgactaagtgcaacagttcactgagagcagccattggagagaaaccagattcaatctcacagatgatttccactgtatctaacccagagctagagaacaatgccgaggttctggaagatatggtgacaactattcttaatctttcaattcatgagagcaacaagaagatcattggagatgacccattagcaatccccttcctcataaggaccttacagtcaggaaccatggaggcccgcagcaatgctgcagctgccatcttcagtttgtctgctcttaacagcaacaaggcaaagattggtgaactaggcgcgatgagacatctggtggatctcctcgaacacggcagcatgatagcgaagaaagatgcagcatcagctatcttcaacctctgcatgctgcacgagaacaaatcaagggccaccaagagcggggtcatcgacgtgaccctgaaggccattgctgacgactctcttgtggacgagtccctggccatccttgccctgctgtcaggtgaccacgagacggtggaggagattggcgagaccggcggtgtggcctccatgctccgcgttataaaggaggaccagtgcaagcgcaacaaggagaacgcggtggcggtgctgtttgcggtctgcatgtacgaccgcaccaagctgcgggagatcgcggaggatgagaacctgaacggctccctcgcctggcttgcgcagaatggcacctcgagggcgcggaggaaggccgcagggatcctcgacaagatgaagagggccgtgcaccacacccactactcttgctagtgccctgcccgcgccgcccgccatggttgtgtagttatgggaataagggggtgctggttgcttcgctgtgtatataaattcggctgcatatatagctacttttggtcttttggtttggt

SEQ ID NO: 18515 - protein, 460 aa, Panicum virgatum
  misc_feature: Ceres CLONE 1797276
  misc_feature (75)..(149): Pfam Name: U-box Pfam Description: U-box domain
  misc_feature (287)..(327): Pfam Name: Arm Pfam Description: Armadillo/beta-catenin-like repeat
MAKPTPVASAEEAAALRRRLRRLVAAVAAGSADAEAFDEAAEALAKLRDGELGPRKDRAVAAGGGVDKGGTEAAAVPEQFLCPISSEIMRDPVVLASGQTYDRRFIQEWLSAGNRTCPQTQQVLSNTILIPNHLVRSMISQWCTDNGITLPPVENQEEDLVTNNERKTFSKIFERIASSSNLSEQREAIKDLRLLTKCNSSLRAAIGEKPDSISQMISTVSNPELENNAEVLEDMVTTILNLSIHESNKKIIGDDPLAIPFLIRTLQSGTMEARSNAAAAIFSLSALNSNKAKIGELGAMRHLVDLLEHGSMIAKKDAASAIFNLCMLHENKSRATKSGVIDVTLKAIADDSLVDESLAILALLSGDHETVEEIGETGGVASMLRVIKEDQCKRNKENAVAVLFAVCMYDRTKLREIAEDENLNGSLAWLAQNGTSRARRKAAGILDKMKRAVHHTHYSC

SEQ ID NO: 18516 - DNA, 1620 bp, Panicum virgatum
  misc_feature: Ceres CLONE 1797286
  misc_feature: Encodes the peptide sequence at SEQ ID NO. 18517
gagaccagatcactccacctccactgttagcttccctctcttgctcatggagccgcccgacacccgctgccgcggcacggacgacctcatcagcggcctccccgacgagatcctgcactgcatcctcctcctcctcccatcctccgcagccgccgcgcgcaccagcctcctctcccgccgctggcgccacgtctgggcccacattcccgagctcgtcttcagctgcgtcgatccgcaggacgatcctgtgccggcctcctcggtcttccatgactccgtcgacgccgccctcaacgcctactccgccccgaccctccgacgcctcgagatccacatggacatacacgccagcctcgtccccgcccaccgtatcgcccggtggctgcgcttcgcctcccggcgcctcgccggaaggttagatctctacctcccagcgctaggggacgaggagggtagtcaggggttcgatctacctgtctgtgagagggcgacagagatcaagctctttctccgaccaaaaattgtgctccggctgccactagccggttccttcgcggcgctgaccaatctacggataatcttgtccaccatgaatggtggcgagctgggacgtctcgtctcgtcgcggtgcccatgccttcggaagcttttcgtactagtcacgctggccgacgactgcgatgtctccatacgctccgaatctgtggtgtctctcttctactacgcaaacacgggcaagctagagatacacaccccatttctggaaaagatctgtctctagtcgctgaggcctacatcgtcgccccaaatctaaagaaggttgcttggcgcgacgacccctatgatcccagccgccaccagcttgctgtggtcaatcgccatctgcaacagctttggatcaagcaaacttccatgctacggatgaggctatttgacactgtcaatgagctgaggctggatctttcaatttctcagggagttgaaggataccagagcttcctaaaggacacagacaaggttcctgcatgtgaaacattgtgtatagaatcatggacgaatccccatgcttttgcaccaaccatgttgcatctccttgggcgatggagatgtacaaggaagttgaaattatatgttgatcagaagatagagcgttgcaggatgtcgggctgtccatgtcgtctgccagagagttacagggctgacaacattacctttgattcacttgaggagatagaaatcaataacttcagaggttcacgtgaacaggagaatttggtaaagtttctgctatctagatgcaatgcagaaacactaaaatttttggaaattatcatgccgtgccagtttgtttcttcaaagatcaagggggtatgcgaggaaatccgcagcatttgtcatccaaacagcaatgtcaaattcaatgtgatggcgacatggggctggagccatttctgttttaaaatgatatctttttttttactccagctaagaggattccctctagtaatgtacttgcagtgctgagtagcctttagtcttacaactgtagtcatgtaagccttggaatagtgctgagttcattagcaccaaactctactattgaggttgtgtttagttcgc

SEQ ID NO: 18517 - protein, 244 aa, Panicum virgatum
  misc_feature: Ceres CLONE 1797286
  misc_feature (13)..(61): Pfam Name: F-box Pfam Description: F-box domain
MEPPDTRCRGTDDLISGLPDEILHCILLLLPSSAAAARTSLLSRRWRHVWAHIPELVFSCVDPQDDPVPASSVFHDSVDAALNAYSAPTLRRLEIHMDIHASLVPAHRIARWLRFASRRLAGRLDLYLPALGDEEGSQGFDLPVCERATEIKLFLRPKIVLRLPLAGSFAALTNLRIILSTMNGGELGRLVSSRCPCLRKLFVLVTLADDCDVSIRSESVVSLFYYANTGKLEIHTPFLEKICL

SEQ ID NO: 18518 - DNA, 1909 bp, Panicum virgatum
  misc_feature: Ceres CLONE 1797307
  misc_feature: Encodes the peptide sequence at SEQ ID NO. 18519
aaacgcagcagtagcagcacggccgtcgtcctccgtttcctcctcgccgcaccggggggcaatccgcaagccattctctcctcctcgattcccctcgtcgcgggatcgccggatctcccttgcacaccgcggccggagaagaggaggagaggggcagcctcattcatcggatcggcgtgcctgtgctgtctgtggtttcgattttccttttttcccccttatttttccaggtcgataagatttgggggcgatcgccatgggattcgggatggggaataacgaggcgagctcgtcgtcgtcgcggctggaccccgccccgctcctgccgcaccatggcagcgcgggcggcgagatcggcctgtcgtcgcagcccaagacgttcgccaacgtcttcatcgcggtggtcggcgccggcgtgctggggctgccgtacaccttctcgcacaccgggtgggcggcggggtcgctgctgctcttcgtcgtcgccgcgctcaccttctactgcatgatgctgctcgtcgcgtgccgccgccgcctcgccgacgagcacccgaagatcgcctcgttcggggacctgggggacgccgtgttcggcgcgcacgggcggtccgccgtggacgtgatgctggtgctcagccaagtgagcttctgcatcgggtacctcatcttcatctccaacaccatggcgcacctctacccgatattcgcgccgtcggcctccgccctcctctcccccaaggcgctattcatctgggcgatgctgccgttccagctcgagctcaattccatcaagacgctcacgctgctcgcgccgctcagcatcttcgccaacgtcgtggacctcggcgccatgggggttgtccttggccaggacgtcgctgcctggctcgccgagcccccacccgtggtcgcgttcggcggccctgccgcgctcctctacgggctcggcgtctccgtgtacgcgttcgagggagtcggcatggtgctgccgctggaggcggaggcggcgaacaagaggaagttcggcgtcacgctcgggctgtccatggcgttcatcgccgtcatgtacgggctgttcggcgtgatggggtacgtcgcgttcggcgacgccacaagggacatcatcaccaccaacctcggcgccgggtggttgtcggccgccgtgcagctgaggctgtgcatcaacctcttcttcacgatgccggtgatgatgaaccccgtgtacgaggtcgccgagcgcctgctccacggcaagcgctactgctggtggctccggtggctgctcgtcgtcgtcgtcgggctcgccgctatgtacgtgcccaacttcaccgacttcctggcgctcgtcgggagcagcgtctgcgtcgtcctcgggttcgtgctgccggcctcgttccacctcaaggtgttcggcgccgagatgggctggcccggggtgctctccgacgtcctcctggtcgtgctcgggctcgcgctcgccgtgttcgggacgtacacatcgctgctgcaaatcttccactcgtccagcgtttgatctccccaccatggctccatttgctatctgccgagtaaattcatcctcgggcggattaatttcaggtacgttggtcgcgcctctgttcagagaagtggaacaggggaggaacggccgcccatctcagctgatttgggcgtggatttgcagcggtcgtcgcattcttccagggcagactacgttattgatgttgttcgattgggttgtatagcatgggaagaatataatctctctgcttttgccgcggcagattgcagttactccatgtagcaatgtaataggaatgtttgcatactagatgatcctcctgctgtgcacgatggattcgatgaaagggcaacattctcaggtcatggaagcttatctgtttattgt

SEQ ID NO: 18519 - protein, 425 aa, Panicum virgatum
  misc_feature: Ceres CLONE 1797307
  misc_feature (34)..(417): Pfam Name: Aa_trans Pfam Description: Transmembrane amino acid transporter protein
  misc_feature: Functional homolog of the protein sequence given in SEQ ID NO 50549
  misc_feature: Useful for making plants with modulated nitrogen use efficiency
MGFGMGNNEASSSSSRLDPAPLLPHHGSAGGEIGLSSQPKTFANVFIAVVGAGVLGLPYTFSHTGWAAGSLLLFVVAALTFYCMMLLVACRRRLADEHPKIASFGDLGDAVFGAHGRSAVDVMLVLSQVSFCIGYLIFISNTMAHLYPIFAPSASALLSPKALFIWAMLPFQLELNSIKTLTLLAPLSIFANVVDLGAMGVVLGQDVAAWLAEPPPVVAFGGPAALLYGLGVSVYAFEGVGMVLPLEAEAANKRKFGVTLGLSMAFIAVMYGLFGVMGYVAFGDATRDIITTNLGAGWLSAAVQLRLCINLFFTMPVMMNPVYEVAERLLHGKRYCWWLRWLLVVVVGLAAMYVPNFTDFLALVGSSVCVVLGFVLPASFHLKVFGAEMGWPGVLSDVLLVVLGLALAVFGTYTSLLQIFHSSSV

SEQ ID NO: 18520 - DNA, 2528 bp, Panicum virgatum
  misc_feature: Ceres CLONE 1797316
  misc_feature: Encodes the peptide sequence at SEQ ID NO. 18521
gacttgtagtgtgttcttctccgcccaacccaatccctatccatctccattcattggggtcggccatggcgccaaccgccgcctccgtcttcctctttctctccccgccgcggagccggagccacctgcactccaaccctaggcccaggcccaccgccaccgccgcctcctccctctccgaccagctcgagcctctctcccgcacgctcctccatgacaagcccacccccgcctccaccgccgaccgccccaccccgcagcccacctgggtgaacccctcccgccccaagcccaccgtcctctccctccgccgccaccgccgccgctcccagtccgcccacccttcctccgccccgctccagccgctcctccgcgccatccgcgcgctgcccgacgacgccgacctcgccgacaccctccacgccttcttccccgcgggctctccgccctccccctctgacgcgctcctcctcctcaactacctccacccgtcctggcccaagtcgctctccctcctcgcctggctgcgcgcgctccccgacggcgccttcccgctcgacaccatcttcttcaacgtcgctctcaagtcgctccgcgccgcgcgccagtggccgcacgccgagcgcctcgcgctcgacatgctccgcgccggcgtccccctcgacaacatcacctactccaccctcatcaccgccgcgcgccgctgccgccagttcaccaaggccatcgagtggttcgagcgcatgtacgccgccgacggcgtcctccccgacgaggtcacctactccgcggtgctcgacgtctacgcgcagctcggcatgaaggaggaggtgctcgcgctcttcgaccgtgccaggggcagcggctggaagcccgaccacgtcgccttcgccgtcctcgccaagatgttcggggaggccggcgactacgagggcatccgcttcgtcttccacgagatgcgggaggtcggcatcaagcccaacatcttcgtctacaacgccctgctcgaggcgctcggaaagaccggcaagcccggcctcgcgcgcaacctgttcgacgaaatgactgcccagggcgtccagcccaatgcgcgcacgctcaccgccctcgccaagatctacgggagggcgcgctggggccgcgacgcgctccaactctgggagcagatgagggacatgaagctgcccgccaataacatcctctgcaacacgctgctgagcatgtgcgctgacgtcgggctggtcgccgaggctgagcagctgttcaacgagatgaaggacccagagtgccgtgacgtccccaagccggacaagtggagctacaccgccatgatcaacatctatgggagcaacggggacaccgaccgtgcactccagctgtttgatgagatgctaaagggcgggatagagcccaacatcatgagctacaccatcgtcatccagtgcctcggcaaggcgcagaggatacagcaggcagtggaggtgcttgaggcggggctggagaagggtctcaagcccgatgatcggctctgtgggtgcttgctctctgttgtcgctctgagcagcggggaggagacggaaatggtgctttcttccctggaaaaggtcaaccagaacctggtcaagcttatcagaatgctcggtgaggaccagctgggtgttgaggatctcacaaaggagttaaaggacgtgttgaacgctgcagcccctgaagtacgccggccttactgcaactgtttgatcgacatatgccagaaccatggcttccctcctcggagggcaagacaagtcttccagcttgcccagacctacggtttgtactccaagattcatagcagaaaggatgaagagtggtcactggatctgcgatccctttcggttggtgcagccaagacagcattcgatgattggatgcggaacatctcagagcgcttgctgcagcacgaggatttgccagagtccttcagcgtgtatactgggtccagcacccacaagtttgcacaggggctggcaagtgctttcgcggctcatcttgagcaaatggcggtgccattccatccaagcgagtctcaagtcggcagcttcatcagttcaagggatgatctggtctcatggttgcagattagcagttcgtcagtggccattgctggatgatgcatatagttgcaatggcttactgcataatgccacaagttccaaagttgggggttgaatgagcaaactgagtgatattaagttcatgatcccatatagtttgttgacatatatagtttgtaggaagaggactgaaacacataaggaacttatctcttccatgcattgcaaaggtagcacgagtgggcactctgaaaacgtcagctgattattctgtatctgatgaaatttgaatgtcacttgttaaataccattatagtagtggaggagtatatttttattattttatttttccctttcttgcacattatgtgcagaggtttggctgataatgtactgcctttgaactgtgaaaattggaagggattcatctcc

SEQ ID NO: 18521 - protein, 695 aa, Panicum virgatum
  misc_feature: Ceres CLONE 1797316
  misc_feature (417)..(451): Pfam Name: PPR Pfam Description: PPR repeat
  misc_feature (308)..(342): Pfam Name: PPR Pfam Description: PPR repeat
  misc_feature (238)..(272): Pfam Name: PPR Pfam Description: PPR repeat
  misc_feature (452)..(486): Pfam Name: PPR Pfam Description: PPR repeat
  misc_feature (273)..(307): Pfam Name: PPR Pfam Description: PPR repeat
MAPTAASVFLFLSPPRSRSHLHSNPRPRPTATAASSLSDQLEPLSRTLLHDKPTPASTADRPTPQPTWVNPSRPKPTVLSLRRHRRRSQSAHPSSAPLQPLLRAIRALPDDADLADTLHAFFPAGSPPSPSDALLLLNYLHPSWPKSLSLLAWLRALPDGAFPLDTIFFNVALKSLRAARQWPHAERLALDMLRAGVPLDNITYSTLITAARRCRQFTKAIEWFERMYAADGVLPDEVTYSAVLDVYAQLGMKEEVLALFDRARGSGWKPDHVAFAVLAKMFGEAGDYEGIRFVFHEMREVGIKPNIFVYNALLEALGKTGKPGLARNLFDEMTAQGVQPNARTLTALAKIYGRARWGRDALQLWEQMRDMKLPANNILCNTLLSMCADVGLVAEAEQLFNEMKDPECRDVPKPDKWSYTAMINIYGSNGDTDRALQLFDEMLKGGIEPNIMSYTIVIQCLGKAQRIQQAVEVLEAGLEKGLKPDDRLCGCLLSVVALSSGEETEMVLSSLEKVNQNLVKLIRMLGEDQLGVEDLTKELKDVLNAAAPEVRRPYCNCLIDICQNHGFPPRRARQVFQLAQTYGLYSKIHSRKDEEWSLDLRSLSVGAAKTAFDDWMRNISERLLQHEDLPESFSVYTGSSTHKFAQGLASAFAAHLEQMAVPFHPSESQVGSFISSRDDLVSWLQISSSSVAIAG

SEQ ID NO: 18522 - DNA, 2213 bp, Panicum virgatum
  misc_feature: Ceres CLONE 1797322
  misc_feature: Encodes the peptide sequence at SEQ ID NO. 18523
atcccacccacccaccagcccgcccgccccgcctccatccacagcggccacgcccgctcccctcccctctccctcctcctcctcctcctcctccccttccccctccccgtctccgccccggacgcggcgtgcccgtccgtcggcctccgactccctccccaccgcccccgatccggagccgagtcggccttgctcaggcggtagagagagcccgagccgcggcgggagggagggtggcctcctcttagcttcccacccgccggaggccagccgccccatgggccggtcgcccgcgcgcgctacgtaccagctcatcgaccgccggaaagggcttgggtaactctttgttgaaagaacctctcttgtacatgtaacattgcatgcaatttctgttaaagatgagttctctgaataaagttgtttcaaatagtggggatacatgttcagtgttacctagtaaagccacatcattaaatcccaatgccgcagaattcgtaccttcgtttattaaaccatctgttggaagtagcacagttccagaggtagctaagtcagattttagggtgtcttctggaaaaacaatcctagataggtccgagtcttcaaagtctaataactcggatgatgaggcgcaccagttttggcgcaagcagcttccagatgacattattccagacttctcttcgtttgagaaaattgaacaagggcctgaagaattgtcccttgctggattatccttgaatgcgccgcccttttatgggacaacttccagccgtttctcaagagaacatcaagagttatcttctccagctaccaagggcctggaactggaacatactaatctactgtacgaagataactatttgggttcaagcaactgggaacaaaattatatttgtgatcttcatattgcgaatgggaaccaagaccttcgctatgagtctgaaagcgctgcagtcttttctgacagttttgctagcgagtatgctgccacatctgatggtgttgttgacccccttgagtacttatcatctcagttccctggattttcagcagagagccttgcagagctatactatgcaaatggatgtgacttcaaccataccattgaaattctcacccagctagagatgcaagttgattctacacccaatcatgcaatgaatttgacccccagtcccagagcaccaaactttagcatgggggattttcctgctctgccaacagctgaagaccagaatggtttcagtaaggggaatgtggatgtccttggcatcttcaatgggcgtggttcatccaccatatcaggtggagctggtgattttgtttcagctgttcgcaaacttgcatcccaaaattcaggccactggaagtttaagaaaggtcctgaatatggaaatggtgtttcgtctcattctgtaccaaaacagtacagtactagcaccaaacaatcatctgggaacaaatttcaaagtgtcagcagtgcaagagttgctccatggctcgagactggtgatgcagtggcaaatatgtactctgaatcaaggggggaagcttgtgattttgctcgggtcagaaatgcttgctttgagcaggctagacaggcttacttggttggcaacaaagctctggccaaggaactgagcatgaagggtcaagcgtacaatgcacaaatgaaagcagctcatgagaaagccagagaagctatttatcgacaaaggaatcctgtttcgcaacggggaagtgatggtctgattgatttacatggactgcatgtgagtgaagcaatccacaacctaaaggttgagcttgctgccatgaagagcgcagcaagggctgcgggggagagggtgcaggtcatggtatgtgtcgggacaggccaccacaccaagggctcgcgcaccgcaaggttgcccatcgccgtggaacagttcctcctggacgaaggcctccactacacgcagcctcaaccgggtcttctccgcgtcatggtgtactaacatctcttattaggtaagacaccacggaggaaaaaaaaggacagcccaaaaaaacgtgaaaagagatgtacgaaaaacacaaaaaaagcgtcgttggacacgcgctgtaatttccttgtagctgtatattaaaagaggcagcaggagaatagcctgacaacagaatacagtgtaaaattatacatagcttcattcaattcacattccattccc

SEQ ID NO: 18523 - protein, 533 aa, Panicum virgatum
  misc_feature: Ceres CLONE 1797322
  misc_feature (453)..(533): Pfam Name: Smr Pfam Description: Smr domain
  misc_feature (20)..(37): Pfam Name: PAM2 Pfam Description: Ataxin-2 C-terminal region
MSSLNKVVSNSGDTCSVLPSKATSLNPNAAEFVPSFIKPSVGSSTVPEVAKSDFRVSSGKTILDRSESSKSNNSDDEAHQFWRKQLPDDIIPDFSSFEKIEQGPEELSLAGLSLNAPPFYGTTSSRFSREHQELSSPATKGLELEHTNLLYEDNYLGSSNWEQNYICDLHIANGNQDLRYESESAAVFSDSFASEYAATSDGVVDPLEYLSSQFPGFSAESLAELYYANGCDFNHTIEILTQLEMQVDSTPNHAMNLTPSPRAPNFSMGDFPALPTAEDQNGFSKGNVDVLGIFNGRGSSTISGGAGDFVSAVRKLASQNSGHWKFKKGPEYGNGVSSHSVPKQYSTSTKQSSGNKFQSVSSARVAPWLETGDAVANMYSESRGEACDFARVRNACFEQARQAYLVGNKALAKELSMKGQAYNAQMKAAHEKAREAIYRQRNPVSQRGSDGLIDLHGLHVSEAIHNLKVELAAMKSAARAAGERVQVMVCVGTGHHTKGSRTARLPIAVEQFLLDEGLHYTQPQPGLLRVMVY

SEQ ID NO: 18524 - DNA, 541 bp, Panicum virgatum
  misc_feature: Ceres CLONE 1797329
  misc_feature: Encodes the peptide sequence at SEQ ID NO. 18525
acccgcgcgcgccgggcgtcaagagcacagaagaggcagcaggtagagagggaggggagcgaccgagctcgtcgggtagcggaggacgatgaccagcaacggtgcggccggcgtggcggtggcgggaccaggcggcgccaaggccgccgcagcgctgcggctgccgcactacctcgtcatggtcggggtggcggccgccgtcgtgctcgcctgcctcaggtacgcgccgccggccgccgccggggggtacggcttcctggccgtcgcgccgcgggcgggggccgccgggcgcctcgcccacgcgactgccggtgatgcccggcgggatccccctacggcggcggcgccgtcgcccgtggtgatcttcaacttcggggactccaactccgacacgggcggcatggcggcggtcaacggcatgaacctcaacctgccggagggccgcaccttcttccgccgccccaccggcaggctctccgacggccgcctcgtcatcgacttcatctgtgagagcctgcacacgccgtacctgagcccctac

SEQ ID NO: 18525 - protein, 150 aa, Panicum virgatum
  misc_feature: Ceres CLONE 1797329
  misc_feature: SWISSPROT Homolog: EC 3.2.1.51 Alpha-L-fucosidase
MTSNGAAGVAVAGPGGAKAAAALRLPHYLVMVGVAAAVVLACLRYAPPAAAGGYGFLAVAPRAGAAGRLAHATAGDARRDPPTAAAPSPVVIFNFGDSNSDTGGMAAVNGMNLNLPEGRTFFRRPTGRLSDGRLVIDFICESLHTPYLSP

SEQ ID NO: 18526 - DNA, 2605 bp, Panicum virgatum
  misc_feature: Ceres CLONE 1797359
  misc_feature: Encodes the peptide sequence at SEQ ID NO. 18527
accgggtggtggttcgcctccgggttggccgagccgcgaaagcgaccgcccctcctccccttcctcttctcctcctcctcctccctcccctcctgccaagaacgaactcactcctcctacccctccgcatagggaaggctccccgccctctcctcccgggagactcctgaggattatccgttcacccctccgcggaggccaactaggataacagctaggagttgaggagaatggcggttggcggaactcagccgaccctcaggaagtaccttggtgctctcaaggacacaacaactgtgagcttggcaaaagtgaatagtgattataaggatttggacattgcaattgttaaggccacgaaccatgttgagcgtccatcaaaggagaagtacataagagaaatttttctttctatttctgctgcaaggccacgagcagatgtagcttactgcattcatgcccttgctagacgcctttcgaagactcgcaactgggcggttgcactgaagacattgattgtcatacaccgtgctcttcgagaagttgatctcacttttcgtgaagagcttatcaattatggcagatctaggtcccatatgctcaacatggcctactttaaggatgactccagtgcagaagcttgggattattctgcgtgggtgcggatttatgctttatatctagaggagaggctcgaatgtttccgagtgctgaagtatgatgtagaaacagatccaccgagaagtcgggatcttgagactgctgctttgcttgatcatctgccaccattacagcagctcctttttcggcttcttgcttgccagccacaaggagcatcatcttacaatataataatccagcatgcactttctatggttgctttagagagtgttaagatctacacagctattagcgacgggacaatcaatctggttgacaagttctttgagatgcaaagaagcgatgctgttagagcactggatatatacaaaagagcaactaaccaggctgaaagactctcagaattctatgaagtgtgtaaaactatacacattgggcgcggtgagaagttcttaaaaatcgaacagcctccagcatcattcttacagactatggaggagtatgtaagagatgctcctacgatggcaaaggaaaaggcagtgctggcgatagaatacaaaaaagagccagaggaggaagaaaaaccagcctcacctcctccagctccagagccacaagcacaaccagaacccgagccggaacctgaacctgtcattgaggaaccaccagtagctgaaccagatttgctgggtctgaatgaacctagccctgctgcgactgcgatagaagagcagaatgctttggcgctagcaatcgttccgatagatgatgttcctaaagctgctccagcctttgaaaatggaatcacaggctgggaactagcccttgtcactgcaccgagctcgactgaaactgctgtgacctcaagcaaaaaattggctggtggtttggacctgctgaccctggacagcttgtacgacgacgcgaacgggagagcgagccagccggcgagctacaacccctgggaggcgccccccgggccgatgctgcagacgatggcgccggcgacgcaggacccgttctacgcgtcgggcgggtacgcggcgccccacgcggtgcagatgaccgccatggcgcagcagcagcaggccttcatgctgcagcagcagatgatgatggcggcgccggcggccgccgtccaccacccgatgcagatgcaggtgcaacagaaccccgcgaacccgttcggcaaccccttcgcccccgccggcgcgcacccctacggcgccgccgccggcatgccgctccacgccgggcccggcaacgcctacacggggctcatctagccaccggatggatggatccgcccctctgggggacggacggccggcttggggcaccgacaacgacgggctgagccggaccaggccgccgccgcacctggccggggcgccgctgaagcatcgcatctcacggcacaacagcaagggcgccgatggcgacaccgtaccggcggccgccgccgcgactcccccgtccacctacgccgccgtcgcgtccctggtctggacgtccggcgttcgcgccaagaacgccctcgacgacgccgccgccgacgcctacctcatgttcgccgcggactaccgcgcgcgcctgcgcccgccgctgtcggccgcgttcttcggcaactgtgccaaggcgtgctacgcgaggacggcagtaggcgggctccgcgacgccccaggcggcgaggccctcgcgcgcgccgcggcggcggtgcgggaggcggtccgggagcagctcgcggacccgctgggcgacgccgagcggtggacggagcgccgccgggcgctgccgccgggcagggtcctgcaggtcggggcgtccaaaacgccattgtctgaaatcaggatttggggaaattcagagttttgtgtgctccttatttaggtctacctgatgcagttttgtacctgaacatctattgtaatgtacttgcgagttatctgtttctgaaatgctatatgataattgaattcaagcg

SEQ ID NO: 18527 - protein, 558 aa, Panicum virgatum
  misc_feature: Ceres CLONE 1797359
  misc_feature (32)..(302): Pfam Name: ANTH Pfam Description: ANTH domain
MAVGGTQPTLRKYLGALKDTTTVSLAKVNSDYKDLDIAIVKATNHVERPSKEKYIREIFLSISAARPRADVAYCIHALARRLSKTRNWAVALKTLIVIHRALREVDLTFREELINYGRSRSHMLNMAYFKDDSSAEAWDYSAWVRIYALYLEERLECFRVLKYDVETDPPRSRDLETAALLDHLPPLQQLLFRLLACQPQGASSYNIIIQHALSMVALESVKIYTAISDGTINLVDKFFEMQRSDAVRALDIYKRATNQAERLSEFYEVCKTIHIGRGEKFLKIEQPPASFLQTMEEYVRDAPTMAKEKAVLAIEYKKEPEEEEKPASPPPAPEPQAQPEPEPEPEPVIEEPPVAEPDLLGLNEPSPAATAIEEQNALALAIVPIDDVPKAAPAFENGITGWELALVTAPSSTETAVTSSKKLAGGLDLLTLDSLYDDANGRASQPASYNPWEAPPGPMLQTMAPATQDPFYASGGYAAPHAVQMTAMAQQQQAFMLQQQMMMAAPAAAVHHPMQMQVQQNPANPFGNPFAPAGAHPYGAAAGMPLHAGPGNAYTGLI

SEQ ID NO: 18528 - DNA, 2279 bp, Panicum virgatum
  misc_feature: Ceres CLONE 1797362
  misc_feature: Encodes the peptide sequence at SEQ ID NO. 18529
aggcccctcctcctcctcatctttctctgcatacacacatacataccgatatacgtatatgcttattctccgccgcctccgtctcccgctgccacgcccacttcccgtctcctcctcctcctcctggtggtggtcgtcgacaagccaacggagacccgccatggcgtcatcctcttccgccgcggtcgtcgccgagggctcggcggcccgccgcttctggatcgccgcctccacgcgggaggccgccttcgccgcgtacacacccttcctcctctccctcgccgccggcaacctgcgcctcgacgccttccgccattacatcgcgcaggacgcgcacttcctccacgccttcgcgcgcgcctacgagatggccgaggactgcgccgacgacgacgacgaccgggccaccatcgccgccctcaggaaggccatcctccaagagctcagcctccacgcctccgtcctcaaggagtggggtgttgatcctaccaaggagatccctccaagtgcagcaacagccaagtacactgatttcctacttgcaactgcagctggaaaagttgatggtgcaaaaggttctgacaaaatggtcacaccattcgagaagactaaaattgctgcatacactgttggggccatgactccatgcatgaggctttatgcgtatctaggcaaagaactcgtggttttccttaaacaagatgaaaatcacccatacaagaaatggattaacacatatgcatccaatgattttgagggtaatgcactccaaatagaagagttgctggacaaactgagtatctcattaactggtgaggagcttgagattattgccaagctctaccagcaagctatgaaacttgaagtggagttcttttctgctcagcttgtagaccagcctgtcgtagctccacttttaagatattatgatccaaaatataaactcttggtcttttctgattttgatttgacatgcactgttgttgattcgtctgccattttggcggagattgcaattttgtcattccaaaagacaagtcaaagtgggattgataataccctcgaccgtacgaaatcagcagacctgagaaattcgtggaacatgctctctaagcaatacatggaagagtacgaggaatgcatggaaagactacttcctccagaagaattaaagtcactagattatgatcaactgtacaaaggcttggaggtgctagcagagtttgagaagcttgcaaattctagggttgttgactctggtgttcttaggggaatgaatttagaagatatcaggaaagctggggagcggcttattcttcaagatggctgtaaaaatttctttcagaagattggaaaaacaagggagaacctcaatttggatatccatatcctttcctattgctggtgcgcagaactaatacggtcggccttttcatcagttggttgtctagatggtctgaacatacattccaacgagtttgtctttgaggggtctgtttcaactggtcagattgagaggaaaatgcagtctccactagacaaagttgaaaagtttaagagcatcaaaagtggcatggacagtacagctccatcactatctgtgtatattggagactcagttggagatttgctctgcctattggaggcagatattggtatcgtcgttgggtcaagcacaagcttgcggagagtgggcaaacagtttggtgtttcttttgtgccgttgttccctggtctagtagagaagcagaggcagctgacggagcaagagaaatccaggttcaagtcacgttctggggtcctttatacggtttccagctggtcagagatacacgctttcattctgggaagtgattttagctgatggaggtgctgtttcttttctctgggtgtttttttctcgttgagaagtgagaacttttgccaattgattgatgcacatgatacgtgaatccccaatttggtcattttatgaaagccacatgccaattctggcccgccgcacctgtatgtatgagcgagtaccgatatctgcagcttgtgctttgtaatggctttacccgcgatcaatgttcattgattcgtccatattcagtttgtgattaatttctggagtggttgctgatggcattatacagcagcgacggctccggtatatataacagctagacatcgagtggtgtatacaacagtatacacccaagtccaagtgtagcagcaaaactgcatgtagaggtgcttgttttcagttggcaataaatggaatggatttatttgcc

SEQ ID NO: 18529 - protein, 567 aa, Panicum virgatum
  misc_feature: Ceres CLONE 1797362
  misc_feature (22)..(245): Pfam Name: TENA_THI-4 Pfam Description: TENA/THI-4/PQQC family
  misc_feature: SWISSPROT Homolog: EC 3.5.99.2 Thiaminase
MASSSSAAVVAEGSAARRFWIAASTREAAFAAYTPFLLSLAAGNLRLDAFRHYIAQDAHFLHAFARAYEMAEDCADDDDDRATIAALRKAILQELSLHASVLKEWGVDPTKEIPPSAATAKYTDFLLATAAGKVDGAKGSDKMVTPFEKTKIAAYTVGAMTPCMRLYAYLGKELVVFLKQDENHPYKKWINTYASNDFEGNALQIEELLDKLSISLTGEELEIIAKLYQQAMKLEVEFFSAQLVDQPVVAPLLRYYDPKYKLLVFSDFDLTCTVVDSSAILAEIAILSFQKTSQSGIDNTLDRTKSADLRNSWNMLSKQYMEEYEECMERLLPPEELKSLDYDQLYKGLEVLAEFEKLANSRVVDSGVLRGMNLEDIRKAGERLILQDGCKNFFQKIGKTRENLNLDIHILSYCWCAELIRSAFSSVGCLDGLNIHSNEFVFEGSVSTGQIERKMQSPLDKVEKFKSIKSGMDSTAPSLSVYIGDSVGDLLCLLEADIGIVVGSSTSLRRVGKQFGVSFVPLFPGLVEKQRQLTEQEKSRFKSRSGVLYTVSSWSEIHAFILGSDFS

SEQ ID NO: 18530 - DNA, 1809 bp, Panicum virgatum
  misc_feature: Ceres CLONE 1797379
  misc_feature: Encodes the peptide sequence at SEQ ID NO. 18531
gatggcggcgacggcgacgaaccggcgcgtgatcctgaaggactacgtggaggggtacccgcgcgaggagcacatggagctgctcccgggcgccgaggtgcccctccgcctggccggcgacaagccccccgggtccgtcctcgtccggaacctctacctctcctgcgacccttacatgcggcccaagatgtcgcgcccgctgcgggagtcctacacggctgccttcgtcccgggctccgtcatcaccggctacggcgtcgcccgcgtgctcgactcctccgacccgcgcctcgcccccggggacctcgtctggggcatcacgggctgggaggactacagcgtcgtccggccccccaccaccgcgttcctcgccaagatctcccaccacggcggcgtgccgctctcctactacacgggcatcctcggcatgccggggctcaccgcgtacgtggggttccacgagatctgcgcgcccaaggccggcgaggccgtgttcgtctccgcggcgtccggcgccgtgggccagctggtgggccagttcgcgcggctcgccgggtgccgcgtcgtcggcagcgccgggtccgcggagaaggtggagctcctgcgcaccaggttcgggttccacgacgcgttcaactacaaggaggagcccgacctcgccgccgcgctccggcggtgcttcccggaagggatcgacatctacttcgagaacgtgggcggcgcgatgctggacgccgtgctgctcaacatgcgcgcacacggccggatcgccgtgtgcgggctcatctcgcagtacaacctcaaggacggggagaaggacgccgtgcgcaacctctccgccgtcgtcgccaagcggctccggctgcaggggttcatcgagcccgaccacaagcacctgtaccccaagtacgaggcgtgggtgctcccctacatccgcgacggcacgctcgcctacgtcgaggacgtcgccgaggggctcgagagcgcgcccagggcgctcatcgggctcttccacgggcgcaacgtcggcaagcagctcgtccgcgtcgccgacgacgcggaagccggcgcctgattggatcggatccgtcgatgtaccactactccgtttccgatttgctttccatgacatgatgaataaattgtgccatcgatgctggcttcagaaatgtggccgcctttgagcaaattagacggccgattttgggggaagcaaggaacgatggaatttggcggtgggcctctgaactctgaatgctctgcttcgtcttcggtggggactctgggagtatggtggttcggtactgcagctaaactgtctgtcatcgaaatgcccatttgatttgagcatggagaagggaggggaagggtgcttgcaattttgaacaaatggcgttctcatgtcatatggactacacaatcaacaattctctacaaatttcttcactctttgatctgaagtatcaaattacaatcctatatttttgtttccctagcaccgcgcaggaatccggcttacctgatgacatgagaaaaatgagaaacattgctcatgtgacttgctgcacacaccaacggttatcttgattgtaataatgctccatgattcgacatctttgaaaaggaacggcggaaaatggcacaatctgtttatctcagccagaacagaatgtttatatatattacctaaaaaaaagaatgtttatatatatgatgtgaatttttgggacacatcagtgataaatcggataaaaaaggcagcggttcatcctcagtttctcaattgtataaaaaagaattcagtttctc

SEQ ID NO: 18531 - protein, 357 aa, Panicum virgatum
  misc_feature: Ceres CLONE 1797379
  misc_feature (160)..(313): Pfam Name: ADH_zinc_N Pfam Description: Zinc-binding dehydrogenase
  misc_feature: SWISSPROT Homolog: EC 1.6.5.5 NADPH:quinone reductase
  misc_feature: Functional homolog of the protein sequence given in SEQ ID NO 50741
  misc_feature: Useful for biocontainment applications
  misc_feature: Useful for making plants with modulated nitrogen use efficiency
MAATATNRRVILKDYVEGYPREEHMELLPGAEVPLRLAGDKPPGSVLVRNLYLSCDPYMRPKMSRPLRESYTAAFVPGSVITGYGVARVLDSSDPRLAPGDLVWGITGWEDYSVVRPPTTAFLAKISHHGGVPLSYYTGILGMPGLTAYVGFHEICAPKAGEAVFVSAASGAVGQLVGQFARLAGCRVVGSAGSAEKVELLRTRFGFHDAFNYKEEPDLAAALRRCFPEGIDIYFENVGGAMLDAVLLNMRAHGRIAVCGLISQYNLKDGEKDAVRNLSAVVAKRLRLQGFIEPDHKHLYPKYEAWVLPYIRDGTLAYVEDVAEGLESAPRALIGLFHGRNVGKQLVRVADDAEAGA

SEQ ID NO: 18532 - DNA, 701 bp, Panicum virgatum
  misc_feature: Ceres CLONE 1797380
  misc_feature: Encodes the peptide sequence at SEQ ID NO. 18533
ctcgtcctcgtccagctccgtaaccaccggacagagcagagcacgcgccatgaggaccaccaccaccaccaggaccgcgctgccgctcctggcgctggctgcggcgctctgcctcagcctcgcgctgctgctccccggcgcggccgcggcgaacaaggcccggccccggccgcggcagggtgactacctgaagcgcctgcgccggtcgccggcgtccgcgcgccagtcgtggcaggccgagtcgtcgctggcggtcgcgctgccgtcgccgccgacggccagagcgcagcggcacgcggcgccggtcgtggccgggcgcaaggaggacgaccgcgtggaccggctgccggggcagcccgagggcgtggacttcgcgcagtacgccgggtacgtgacggtggacgcggcggccgggcgcgcgctgttctactacctcgccgaggccgccggcaacgtgccggcggcgtcgcggccgctgctcctgtggctgaacggcgggcccgggtgctcgtcgctggggtacggcgccatggaggagctgggcccgttccgcgtgaagagcgacggcaagacgctgtaccggaacccgtacgcgtggaacaacgcggcgaacgtgctgttcctggagagccccgccggcgtggggttctcctactccaacacgacggcggactacagccggttcggcgataacaagaccg

SEQ ID NO: 18533 - protein, 217 aa, Panicum virgatum
  misc_feature: Ceres CLONE 1797380
  misc_feature (100)..(217): Pfam Name: Peptidase_S10 Pfam Description: Serine carboxypeptidase
  misc_feature: SWISSPROT Homolog: EC 3.4.16.6 Carboxypeptidase D
MRTTTTTRTALPLLALAAALCLSLALLLPGAAAANKARPRPRQGDYLKRLRRSPASARQSWQAESSLAVALPSPPTARAQRHAAPVVAGRKEDDRVDRLPGQPEGVDFAQYAGYVTVDAAAGRALFYYLAEAAGNVPAASRPLLLWLNGGPGCSSLGYGAMEELGPFRVKSDGKTLYRNPYAWNNAANVLFLESPAGVGFSYSNTTADYSRFGDNKT

SEQ ID NO: 18534 - DNA, 659 bp, Panicum virgatum
  misc_feature: Ceres CLONE 1797380-R
  misc_feature: Encodes the peptide sequence at SEQ ID NO. 18535
ctccacgccaacgtcacccgcctcgaccacccctggtcagcctgcagtgaggtcttgaggcgctggacagacagcgccacaacggtcttgcctatcatcacggagctcctgaacaacaacatcagggtctgggtgtacagcggtgacaccgatgggagagtgccggtcacttccagcagatactctgtcaaccagctccagctcccagttgctgcaaaatggaggccatggttcagcagcactcagggaactggagaggtgggtggctacgttgtggagtacaagggcaaggcgaagggcagcctcagcctggcaaccgtgagaggagccggccatgaggtccccagctaccagccgaagcgagcgctggtgctcgttcagagtttccttgcaggcaaaccgctccctgactgcaagaagtgcgaacagtcttagcattctgaagtataaagagtgcatcagcagcaacacgatatgtatccattccattcagcatgagagaagaaagcgaaaacgaatcatgttagacgatagaaatatacccacctcctagatcatgtaactgcaggtctgcaaagacttatatagtcacatagagaaatctctacacaaatgaaacctatcaaatctgaaaagtaaccaccagaaagttacgatac

SEQ ID NO: 18535 - protein, 144 aa, Panicum virgatum
  misc_feature: Ceres CLONE 1797380-R
  misc_feature (1)..(132): Pfam Name: Peptidase_S10 Pfam Description: Serine carboxypeptidase
  misc_feature: SWISSPROT Homolog: EC 3.4.16.6 Carboxypeptidase D
LHANVTRLDHPWSACSEVLRRWTDSATTVLPIITELLNNNIRVWVYSGDTDGRVPVTSSRYSVNQLQLPVAAKWRPWFSSTQGTGEVGGYVVEYKGKAKGSLSLATVRGAGHEVPSYQPKRALVLVQSFLAGKPLPDCKKCEQS

SEQ ID NO: 18536 - DNA, 1409 bp, Panicum virgatum
  misc_feature: Ceres CLONE 1797381
  misc_feature: Encodes the peptide sequence at SEQ ID NO. 18537
acagaaattagaattccttcctcctctctctctctccgagtccgctccaatgccgttgcctctctcctccacctcatcataaacgcctccggctccgacggcctcccggacccaaaccctagccgcgcactcgccgaccacgccgagctcgccggaacccgcccgacccgagcacaattccgctcgggtcgcagccgatccggcggctcccctcccggacagcccggggccgtgcccccccccgcgaatgctagcctgatcgcgtccccacggtcgatgggttcgccggggtccgccaatggcagacgcggcgagtacgtgaggatcccggaggaggtggaggcggcggccaagggggaggccgacgccgcgacggccctcaaggcggccgccgcggcggagtgcccgagggtgctccggtggcgcgcgatccggtggtgggccaaggtcgccgtgctcgggatcttcctcgcgggggccggagctgcggcggtcgtcttcctcggcccgctcgtcattaagaaggttgttgcacctattctttactgggaatcgacaactttcagcagatcagctattgctctaatatgttttcgcgcaattgccttgttcccaagtgttttgttaccttcttcaccattcatgtggcttgcggggatgacttttggatatctttatgggtttttgataatccaagcggggatgagcataggcatgtcattgccttattttataggctctgcattccactgtaggatacatagatggttggagaagtggccaaagaaagcagcttttgtaagacttgctggcgaaggagattggcatcatcaatttagggctgttgctttgctcagaatttctccatttccatatatagtttttaattatgcttctgtggctacaaatgtcaaatattgcccatacatagctggttcaatggctggaaccatacatgaaactttccttgcaatatacagtgggaagcttcttcaaagcttggctgtagcaactagcaaggggtccttcttgtcagtggatcagattatctacaatggaatcgacttcacaatcgccgcagcttccacagctgcaatcactatctatgcaaagaaagcgctacaaaagctccaagcagaggatgagatattctgagcgcaagaggcctgtgctccggatcaaactagtttccattcaggtgtactatatataaacacttgctactaatctggtttcctgtgtcgactacctgactacaaccatctgaggggatgagggtgctgcagcaactgtaaagaaaatagagaaccaaaaaacacttacgttttctgttcttttttcttgttttgttttctgtagagagaactatcaacttcatcaatgtattgctttacgcgatgtaaattccc

SEQ ID NO: 18537 - protein, 292 aa, Panicum virgatum
  misc_feature: Ceres CLONE 1797381
  misc_feature (117)..(238): Pfam Name: SNARE_assoc Pfam Description: SNARE associated Golgi protein
MGSPGSANGRRGEYVRIPEEVEAAAKGEADAATALKAAAAAECPRVLRWRAIRWWAKVAVLGIFLAGAGAAAVVFLGPLVIKKVVAPILYWESTTFSRSAIALICFRAIALFPSVLLPSSPFMWLAGMTFGYLYGFLIIQAGMSIGMSLPYFIGSAFHCRIHRWLEKWPKKAAFVRLAGEGDWHHQFRAVALLRISPFPYIVFNYASVATNVKYCPYIAGSMAGTIHETFLAIYSGKLLQSLAVATSKGSFLSVDQIIYNGIDFTIAAASTAAITIYAKKALQKLQAEDEIF

SEQ ID NO: 18538 - DNA, 710 bp, Panicum virgatum
  misc_feature: Ceres CLONE 1797403
  misc_feature: Encodes the peptide sequence at SEQ ID NO. 18539
attaattttccgcgctgcgcttgtagacatctatccagcagagcgcagcaggatggtgtacgcgctcctgctggtcgccttggcggccgtcgccgccgcggcggtgctccgccactacctcccactacctccccaagggcagcttcggctggcccctcatcggcgagaccatcggcttcctccacgcgcacccgtccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcgagtgcagctaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcgcgctccctcatcgcgtcctggcgcggccgcgagaccatcagcttctgcgaggaggcgaggaagttcccctacaaggtgatcatggagcaggtgctgggcctgccgccggacggcccggtggccctccggatcctggaagagtaccagatcttcatgaaggggatcatctccctccctatcaccctccccgggacagcattttccaaggccgtc

SEQ ID NO: 18539 - protein, 93 aa, Panicum virgatum
  misc_feature: Ceres CLONE 1797403
  misc_feature: SWISSPROT Homolog: EC 1.14.13.93 (+)-abscisic acid 8'-hydroxylase
MFLALVASTGLKASYVASVDESARSLIASWRGRETISFCEEARKFPYKVIMEQVLGLPPDGPVALRILEEYQIFMKGIISLPITLPGTAFSKA

SEQ ID NO: 18540 - DNA, 591 bp, Panicum virgatum
  misc_feature: Ceres CLONE 1797403-R
  misc_feature: Encodes the peptide sequence at SEQ ID NO. 18541
gaacccgagcagtttcagcctcgcagatgggaggggctgaaccagccggctggcaagagcttcgcgccgttcggaggtggactgcggctctgccctggatcggagattgtcaaagtgaaggctgctttcttcctgcaccaccttgtgctcaactacaggtggaggatgggtgaagaggacgctcccatgctgcaccagtacgtggaattcaagaagggcctgcccatacagctcgagccggtcagctgatgctcatcaagcctttgcctcgctcgctcttcgtcaagactccaagagagatgaaataagttgagacgtcggacccccgccagccagccagtcctgaatcgcgatttacaagtcacaaaaaaacaaaaaataaataaaataaaaatagctgtctacgtttatgtaattttattttttacgcgtaatttactgttattatgatgcataggcatcatggtttatgtatcacccgagatgggggacacgtacggtacggggtttggcacgagtcatgcaggtctcaaacctgaacctccagttgtagcactcgccatatctatcatatcctcccgttggttttcc

SEQ ID NO: 18541 - protein, 82 aa, Panicum virgatum
  misc_feature: Ceres CLONE 1797403-R
  misc_feature: SWISSPROT Homolog: EC 1.14.13.93 (+)-abscisic acid 8'-hydroxylase
  misc_feature: Functional homolog of the protein sequence given in SEQ ID NO 50272
  misc_feature: Useful for making plants with modulated oxidative stress sensitivity
EPEQFQPRRWEGLNQPAGKSFAPFGGGLRLCPGSEIVKVKAAFFLHHLVLNYRWRMGEEDAPMLHQYVEFKKGLPIQLEPVS

SEQ ID NO: 18542 - DNA, 696 bp, Panicum virgatum
  misc_feature: Ceres CLONE 1797411
  misc_feature: Encodes the peptide sequence at SEQ ID NO. 18543
agctgcaggatcggaaaccaaaggccctcctccatccagatccagctgcatgctcaattgctcatccaatccagcacatcatcttgatccacggtagattggtagatggggtctctgagaggaggaggaggcggcggcggcggcggcatggacgatgaggaggcgaggaatccgcagctggtggatgcggacgaggcatgcgccctcctcagcatggccacgcaccagtatctcgatgtcaggatgtgggaggactttgacaagggccatgtcgccggtgctcggaatgttccctactacctctccgtcactccacatgggaaggagaagaatccccactttgtggagcaggtgtccgcgctctatcccaaggaccaacacctgattgtgggctgccgctccggcattcggtccaagctcgccactgcagacctcctcagcgcgggcttcaagaatgtgaggaacctagaaggcgggtatctctccttgctccgaagcgccaaccagcagcaccaccaccagcaggctgctgcttaacccatccattaattatcctagtattatttaaccattcatgcactacaaaatactactccatccgtttcaaattataagtcatttcaaaaattttggagagtcaaatcatctcaaagtttgaccaaaattatagagagaaatataaagatttatgacatc

SEQ ID NO: 18543 - protein, 143 aa, Panicum virgatum
  misc_feature: Ceres CLONE 1797411
  misc_feature (27)..(131): Pfam Name: Rhodanese Pfam Description: Rhodanese-like domain
  misc_feature: SWISSPROT Homolog: EC 2.8.1.1 Thiosulfate sulfurtransferase
MGSLRGGGGGGGGGMDDEEARNPQLVDADEACALLSMATHQYLDVRMWEDFDKGHVAGARNVPYYLSVTPHGKEKNPHFVEQVSALYPKDQHLIVGCRSGIRSKLATADLLSAGFKNVRNLEGGYLSLLRSANQQHHHQQAAA

SEQ ID NO: 18544 - DNA, 658 bp, Panicum virgatum
  misc_feature: Ceres CLONE 1797411-R
  misc_feature: Encodes the peptide sequence at SEQ ID NO. 18545
ccatccattcaccccgcgtagcgcaggagagccgcggcggcggagatgtccaaggtctacaccctcgaggaggtcgccaagcacaactccaaggacgattgctggctcatcatcggcggcaaggtgtacgatgtgacaaagtttttggaagaccacccaggaggtgatgatgttctgctgtcctcaactgccaaggacgcaactgatgattttgaagatgtcgggcacagcaccactgcccgtgcgatgatggatgagtacctgttgggtgaaatcgactcatcaacgatccctgctaggacgaagtatgtcccccccaagcaaccgcactacaaccaggacaagaccccggagttcattatcaagatcctccagttcttggttcccctggcaatcctgggcttggctgttgctgttaggatctacaccaagtcagagtctgcttagctttgttgcccttgcccccttggggattataagagtcaaacttgttgaataagttagcaagagttctgtgaggttttacatgtgtaacatgtcatgaattcgtcgaatgatctgagatattgtgggttctgtggttcttggatatccattttgtgcttaaagtaggattggaattcgtcgtactacactatttgctatctcagttgttggc

SEQ ID NO: 18545 - protein, 133 aa, Panicum virgatum; identical to SEQ ID NO: 14686
  misc_feature: Ceres CLONE 1797411-R
  misc_feature (4)..(78): Pfam Name: Cyt-b5 Pfam Description: Cytochrome b5-like Heme/Steroid binding domain

SEQ ID NO: 18546 - DNA, 1673 bp, Panicum virgatum
  misc_feature: Ceres CLONE 1797421
  misc_feature: Encodes the peptide sequence at SEQ ID NO. 18547
aaaacggaaccaaacctagagagctccccgtctccctccccgccccgcttcccggcttcccctcctctcaccacgccgattcctcgcaccatctcctcccctctaccatcccgccgccgccaccgacggccaatccgcggggccccgccccgaatccgcgccgcccgcgcccagatctcccccctccgcgcctccggatgtcatgagccgcccccatttgcccaaggacccggccttcccgcgcaccaatgggtccttggacggcggagcccgcggcgtcggcgagatcgaggaggtgggcgcggcggccaccgttgccgtggagcagtcgccctcgcagtcctcgtccccgacggcgtcgtcgccggcggcggcgatgtcgccgtgcgggcagtacatgctgcaccgggtgcgcaaactggacaccctcgcgggcgtcgccatcaagtacggcgtcgaggtagcggacattaagaggctgaatggcctctcaactgacctccagatgtttgcacacaagacactgcggattccgctccaagggaggcatcctccgtcatcttaccaggagaatggttcattcgagagtgaagaaagggaatgtactccacgacgcattcatgatgatatcttggattctatattgaagacaccaaaacccaaagtttcgccagccatgagtcttctgcagggatactatggccttgcaccacctccaaagagagatccaacaggtgaaggcactgagatggcagtctatagaaaaggaaaatctgcgtttttggatgttgagccatggctggagccaccaaattccgacccgttccctcttcagaataggaaaactagaagcttggcgataggttcttctcttattgatggtgatactgatgagaatggtgatagtgaaaggttgataaggcggcgtcagaaagctgatggtgagttgttacctagggaggaaaatggtggtgacttcctagcaagcgctgggaaaggattggcgctgaggccgaagtcgagtagtcgaccagaaatgaacaagagtcagcagaacctttttgcaatggcagagcctttgttcagcaatggtctgcaaactgtaaggaaatcatccagcactcctgagttccaagagccagagagcaacaccagttcgtccatatggtcagcgagcaagtggagcataaatacagatgcttttactcttcctctccccttcccccgctttgacaacatcccaaagccaattgctgcttggagaaacaaggcggctcgcgattaataatgtgctatatcctggccatgtgcattattttcccttaagtccaggggggccagaaagtgtccatgaaggagcttacagcttaggttgacaccagtcttcacagctgcggaagcaaagcaggaccttggttggttcctgctacttggaacatactgaagatctgatgcatccatgttcacagatgtttctagattaggtttacatggttctcatgttatattggacatgttgcaccaagagtagcagcgttaatattcttgatataaattatagatgttagatgacatagaggagacttcgatatttgaggggatattcttttgtacacaatgagataatgtagaggatcaaagggcggttatatatgtattgtatgtatgatccc

SEQ ID NO: 18547 - protein, 360 aa, Panicum virgatum
  misc_feature: Ceres CLONE 1797421
  misc_feature (68)..(111): Pfam Name: LysM Pfam Description: LysM domain
MSRPHLPKDPAFPRTNGSLDGGARGVGEIEEVGAAATVAVEQSPSQSSSPTASSPAAAMSPCGQYMLHRVRKLDTLAGVAIKYGVEVADIKRLNGLSTDLQMFAHKTLRIPLQGRHPPSSYQENGSFESEERECTPRRIHDDILDSILKTPKPKVSPAMSLLQGYYGLAPPPKRDPTGEGTEMAVYRKGKSAFLDVEPWLEPPNSDPFPLQNRKTRSLAIGSSLIDGDTDENGDSERLIRRRQKADGELLPREENGGDFLASAGKGLALRPKSSSRPEMNKSQQNLFAMAEPLFSNGLQTVRKSSSTPEFQEPESNTSSSIWSASKWSINTDAFTLPLPFPRFDNIPKPIAAWRNKAARD

SEQ ID NO: 18548 - DNA, 2697 bp, Panicum virgatum
  misc_feature: Ceres CLONE 1797432
  misc_feature: Encodes the peptide sequence at SEQ ID NO. 18549
gaaaaattaaaaaacggttgctagcatgcggagattcccctgatatttctcgctattttttttccttttggtttatttacctgctgtgccatttcttgttgcgccccgccccctgaaacctcgcgttttgtcagttgcacccctctggatcgccgcctcctgctcttctcgttcacttgcttcccgttccgagtgccgcccgccacccgggcacccggcgaaagcttcgtcagcatccaccgccgcttcgcgtcccctccccgcgggcgcgaggtgcacgctcgcttcgtaggaagcgcgcggaggaggccggccgagaaggagccgcggcgcggggagcagaggcggcgtacgcgcgcgcgcacggtgtgcgtgtgcgccgtacgcgtacgtgcgtgagagcagcagcaggaggaggagcgcatggggtcgaggcggcggcggcaccaccaccaccacggcccgtggctggtgcccgcagtggcgccggccgccgcggcgttcgcggcggcggggctgctgctcgtcgtcgtcgcgttccactgcttcctgtcgccgccgctcggcgacggtggcggcggcgcgcgtgtcgtccggcgcccgaacccgccgttcctgttgaagaagccggcggaggttgccaggagtgtaatcggcgccgtggatttcactgttcctagcggcgggagcaagcacgggcaggagctctgggagtcgaaggcgacgggcaacttcttcggctgcagcaacgcgaccaagcatttcgccgatgccaaggctgtgacgaaattggaccgttacctgatgatcgcgacgagcggcggactgaatcagcagcgaacagggatcatagatgctgttgttgcagcccgcatactgaatgcaacacttgtcattccaaagctggatgaagaatccttctggaatgacgcgagtgacttcgcacagatatttgatgtggattccttcatatactcactctcaaacgatgtaaaggtcatacgacaattacctgatatgaatgggaaaaagctttcaccatataagatgcgtattcctaggaagtgtactccaaaatgctatgagaacagagtgctacctgctcttctgaaaaaacatgttgttcaattaacaaaatttgactatcgagtgtccaataggctagagactgatcttcaaaaacttaggtgtagagtcaattatcatgcactacagttcacagatccaatcctaagaatgggcgaattgcttgtccaaagaatgaaggagaaaagtggacgcttcattgctcttcacctgagatttgagcctgacatgctcgcgttctctggttgctattatgggggtggagacatcgagagaagagaactcggtgagattcgtaagaggtggaaaaccctgcatgcaagcaaccctgacagagaacggcggcacggtaagtgccctctgacaccagaggaagtcggcctcatgcttagggcactgggatttgggaaggacgtacacctatatgttgcatccggagatgtatatggaggcgaggaaacattggcacctctcaaagcactctttccaaactttcactcaaaggagactctagcaagcaaggaggagttggcacctttcttaccatattcatctcgcatggctgctcttgattttattgtgtgtgataggagcgatgttttcgtgacaaacaacaatggcaacatggccagaatgttggctggtcgaaggagatattttgggcacaggaggaccataaggcccaatgctaagaaactatactcattatttctgaatcgaaccagtatgagttgggacacatttgcatccaaagttctgacattccaaaagggattcatgggggagcccaatgagattaaaccaggaagaggcgaattccatgagcatcctatggattgcatttgtgcaaaagccaacggtaaaattgggcagagcaggcatcatcaaattaaacgtgctggaaaaggtgcggagaaccattctagtgatggagacctcgactggagggatttggactatggagagcatacaccattgggcagggattcatctaatgaatctgaatcagatgatattcgtgttggtggatcagacattcctgaattggaggacatgatgtcggactagatacttaaaaatagatatttctgtataggtttgtttttcttttcaaagggcttggtgataaactattgtgtttatagaagctgttgcataggttatcatttctcctgtttatttcttggagacttatagaagagaataagagtttttaactggcccggcaaagaagatagggcaggaagagcttcctgcagaaaaagcagagaggccttcagctcactatgagctaaacaactgtacagtgtttgattggtcctcaagtaatgccgattggtcattataaaaaaaagtaatgctgattggtaaactagaagacgtttttccttcacggtttttctttcatatagtttgtacggtaaatagatgctacaaaagacccttctttaagcttttacagagtagtgttataattagaatttgctgggggtttagtatttattcttggtttccttttcttttacaataagagtatgttaccgattttgcgccgccatcgaaatttgtatatataacttgaagcatgagaatgaaagagattttgtaccg

SEQ ID NO: 18549 - protein, 576 aa, Panicum virgatum
  misc_feature: Ceres CLONE 1797432
  misc_feature: Functional homolog of the protein sequence given in SEQ ID NO 50810
  misc_feature: Useful for making plants with modulated nitrogen use efficiency
MGSRRRRHHHHHGPWLVPAVAPAAAAFAAAGLLLVVVAFHCFLSPPLGDGGGGARVVRRPNPPFLLKKPAEVARSVIGAVDFTVPSGGSKHGQELWESKATGNFFGCSNATKHFADAKAVTKLDRYLMIATSGGLNQQRTGIIDAVVAARILNATLVIPKLDEESFWNDASDFAQIFDVDSFIYSLSNDVKVIRQLPDMNGKKLSPYKMRIPRKCTPKCYENRVLPALLKKHVVQLTKFDYRVSNRLETDLQKLRCRVNYHALQFTDPILRMGELLVQRMKEKSGRFIALHLRFEPDMLAFSGCYYGGGDIERRELGEIRKRWKTLHASNPDRERRHGKCPLTPEEVGLMLRALGFGKDVHLYVASGDVYGGEETLAPLKALFPNFHSKETLASKEELAPFLPYSSRMAALDFIVCDRSDVFVTNNNGNMARMLAGRRRYFGHRRTIRPNAKKLYSLFLNRTSMSWDTFASKVLTFQKGFMGEPNEIKPGRGEFHEHPMDCICAKANGKIGQSRHHQIKRAGKGAENHSSDGDLDWRDLDYGEHTPLGRDSSNESESDDIRVGGSDIPELEDMMSD

SEQ ID NO: 18550 - DNA, 543 bp, Panicum virgatum
  misc_feature: Ceres CLONE 1797462
  misc_feature: Encodes the peptide sequence at SEQ ID NO. 18551
gccgcatatttacggggcggggccgcgggggccaaggacaatccaaaaattgacttcggggggcagagggattcgttccccttccttccgcgcccgcgcccgcgccgcgtgagccgaaccctcccgagctcccgcggccgggatggacgcccccgcagcggcgaccgccgggccctcctcctcctccgaagccgcagccgctgggccctcctctgccgccgctccagccgcagccgcccgggcctcctctggcgccgagcttcccgcggcggccgcccaggcgccgccgccggtggctccgcgtgtgcagcttctcgaggagcccgtgctgggcggcggcggcgccggcggcgggggcgggagcggcgtcgcgcggacctgccgccaccacgcgtccggccgcaaccacaaggcgctcggcctgctatgctccaagttcgtggcgctgtacgaccgggaggacgtggagacgattgggctggacgatgcggccaagcagctcggcgtcgagcgccgccggatctacgacatcatcaacgtgct

SEQ ID NO: 18551 - protein, 133 aa, Panicum virgatum
  misc_feature: Ceres CLONE 1797462
  misc_feature (87)..(133): Pfam Name: E2F_TDP Pfam Description: E2F/DP family winged-helix DNA-binding domain
MDAPAAATAGPSSSSEAAAAGPSSAAAPAAAARASSGAELPAAAAQAPPPVAPRVQLLEEPVLGGGGAGGGGGSGVARTCRHHASGRNHKALGLLCSKFVALYDREDVETIGLDDAAKQLGVERRRIYDIINV

SEQ ID NO: 18552 - DNA, 729 bp, Panicum virgatum
  misc_feature: Ceres CLONE 1797473
  misc_feature: Encodes the peptide sequence at SEQ ID NO. 18553
aacaacaacggtgtggatgcatgctggtggtaatggagcagacatctcggtgatgagcggcgcgcagctgttcatgaaggaggacctcaagatcacggacacgcagatcgagatcctggccggcgtcatcagcatctactcgctcttcggctcgctcgccgccggcctcacctccgactggctcggccgccgctacaccatggtgctcgcggccgccatcttcttcacgggcgcgctcctcatgggcctcgccccggactacgcgctgctcatggtcggccgcttcgtcgccggcatcggcgtcggcttcgcgctcatgatcgcgcccgtctacaccgccgaggtcgcgcccacctcggcgcgcggattcctcacctccttcccggaggtgttcaacaacttcggcatcctcctcggctacgtctccaacttcgccttcgcgcgcctccccgtccacctcagctggcgcgccatgttcctggtcggcgccgtgccgcccgtcttcctgggcgtcgccgtcctcgccatgccggagtcgccccggtggctcgtcatgcggggccgcatcgacgacgcgcgccgcgtcctgctgaagacctccgactcgcccgccgaggccgaggagcgcctgctcgacatcaagaaggtggtcggcatccccgagggcgtgtccgacgccgacgacgtggccgccatcgtccgcgccggcagcaagagctcccgcggcga

SEQ ID NO: 18553 - protein, 242 aa, Panicum virgatum
  misc_feature: Ceres CLONE 1797473
  misc_feature (2)..(242): Pfam Name: Sugar_tr Pfam Description: Sugar (and other) transporter
TTTVWMHAGGNGADISVMSGAQLFMKEDLKITDTQIEILAGVISIYSLFGSLAAGLTSDWLGRRYTMVLAAAIFFTGALLMGLAPDYALLMVGRFVAGIGVGFALMIAPVYTAEVAPTSARGFLTSFPEVFNNFGILLGYVSNFAFARLPVHLSWRAMFLVGAVPPVFLGVAVLAMPESPRWLVMRGRIDDARRVLLKTSDSPAEAEERLLDIKKVVGIPEGVSDADDVAAIVRAGSKSSRG

SEQ ID NO: 18554 - DNA, 2594 bp, Panicum virgatum
  misc_feature: Ceres CLONE 1797475
  misc_feature: Encodes the peptide sequence at SEQ ID NO. 18555
gaaacatcaaacaaagaccaacaattgtagctcgtgcaactgcaagcaaccatgctgaccctcgttttcctgctcgtctccagcttcagcctccaaacaactggcgctatcgacaccctcaccttgggccggtctctcctatggaaccagactctggtctccaagggcggcaacttcgagctcggcctcttctcccccggcaagtccaagaagtactacgtcggcatctggtttaagaaggtctccaagcaaacggttgtatgggtggccaaccgagagcgcccgatcctcgtgccgtcggcctctcgcttcacgctgagcgaccgcggcgagctccttgtccaggcggcgccatcaaacaccttgctgtggtcgtccaacgcgtccacctcgtccccgggcaccaccgtcgccacgctccaggacaacggcaacctcgtggtgcggggcaacgcgacggcgtcggaaacagtgacgtggcagagcttcgaccaccccacggacacgtggctccccggcgccaggctcggctacgaccgggcccgcggcgtgcacagcttcctcacgtcgtggaccgactccgagaacccggcgcccggcgcgttctccatggtgatcgacccgcgcgggcaggccaagttcgacctgctcgccggcggcgtacaccagtactggaccaccggcctgtgggacggcgaggtgttcgagaacgtgccggagatgcggtcgggctacttcgtgggcgtcccctacgcgccgaacgccagcgtgaacttcttcagctaccacgaccggaagcccatgggcatcggcaacttcgtgctccacgtgaatgggcagatgcggcggcggcagtggatcgagggcggggactgggtcctcttctgcacggagccccgcgacgcgtgcgacgtcttcggatcctgcgggcccttcgccgtgtgcagcaacaccaccagccccgcgtgcgagtgccccgcggccttcgcgccccgatcccagggggagtgggcgctggggaacacggcgtccgggtgcgcgaggcgggcagtgctggcgtgctccaacgacgggttcctgaagatgccgtacgccgtgcagctcccgaacggctcggcggtggaggcggccggagctcggagcgacaaggcgtgtgcggccgcctgccggcgagactgctcctgcaccgcgtacctctacgacgggaccaagtgctcggtgtggaacggcgagctcgtcaacctgaggaaactcccgacgaacgaccagggcgttgcggcggcggcggcgcttcacctccgtgtcgcggcgtcggaggtgccgccgtctgcgccggcgcattcgtggaggaagtcgatggtgatcctcggcagctcggtgtcagccgtggtcctgctcctggcgtgcctcataatcggcgtcgcggtggcggtggtgttgcggaagcggcggggaaaggggaaggtgaccgcggtgcagagctcgctgctgctgctcgactaccaggccgtgaaagcggcgacgcgggatttcacggagaagctcgggagcggcagcttcgggtcggtgtacaagggggctctccccgacaagacgcccgtggcggtcaagaagctcgacggcttgcggcagggcgagaagcagttccgcgccgaggtggtcaccctgggcatgatccaccacatcaacctggtccgcctccgtggcttctgctccgaggggaacaagagggcgctcgtgtacgactacatgcccaacggctcgctggacgcgtacctgttcacgaacagcccgggctccaaggtcctgagctggggccagaggttcggcgtcgcggttggcgtggccagggggctggcttacctgcacgagaagtgccgggagtgcatcatacactgcgacatcaagcccgagaacatcctgctcgacgaggagctgggtgccaagctcgcggacttcggcatggccaagctcgtcggccacgaattcagccgcgtcctgaccaccatgcgcggcacgatgggctacctcgcgccggagtggctcaccggcgcgccggtcaccgccaaggccgacgtgtacagcttcggcctgctgctgttcgagctcgtctcgggccgccgcaacaacggctcctcggaggagggcggccgctccgccgtgtacttcccggtgcacgccgcggtcaagctgcacgcgggcgacgtcgtcggcctgctggacgagaagctggccgggaatgccaacgtggaggagcttgagagggtctgcaaggtcgcgtgctggtgcatccaagatgaagaaggtgaccggccgaccatggggctcgtcgtgcagcagcttgaaggtattgctgacgtgggactgccgctgatcccgtcaaggcttcatatgctggctacggtgaatgggtgcgtcggtgcggttgcggacatgtcatagtagttccactgtattagcgtgatttttcctttgttttaagtgtgacttaccaggtaccagtcatatgtagtactgtagaaactagaaagcattgcaggattagagatcctccgcaacactagctgtcaaatgaatgatttttaaactttgtc

SEQ ID NO: 18555 - protein, 796 aa, Panicum virgatum
  misc_feature: Ceres CLONE 1797475
  misc_feature (492)..(764): Pfam Name: Pkinase Pfam Description: Protein kinase domain
  misc_feature (66)..(181): Pfam Name: B_lectin Pfam Description: D-mannose binding lectin
  misc_feature (337)..(398): Pfam Name: PAN_2 Pfam Description: PAN-like domain
  misc_feature (195)..(320): Pfam Name: S_locus_glycop Pfam Description: S-locus glycoprotein family
  misc_feature: SWISSPROT Homolog: EC 2.7.11.1 Non-specific serine/threonine protein kinase
MLTLVFLLVSSFSLQTTGAIDTLTLGRSLLWNQTLVSKGGNFELGLFSPGKSKKYYVGIWFKKVSKQTVVWVANRERPILVPSASRFTLSDRGELLVQAAPSNTLLWSSNASTSSPGTTVATLQDNGNLVVRGNATASETVTWQSFDHPTDTWLPGARLGYDRARGVHSFLTSWTDSENPAPGAFSMVIDPRGQAKFDLLAGGVHQYWTTGLWDGEVFENVPEMRSGYFVGVPYAPNASVNFFSYHDRKPMGIGNFVLHVNGQMRRRQWIEGGDWVLFCTEPRDACDVFGSCGPFAVCSNTTSPACECPAAFAPRSQGEWALGNTASGCARRAVLACSNDGFLKMPYAVQLPNGSAVEAAGARSDKACAAACRRDCSCTAYLYDGTKCSVWNGELVNLRKLPTNDQGVAAAAALHLRVAASEVPPSAPAHSWRKSMVILGSSVSAVVLLLACLIIGVAVAVVLRKRRGKGKVTAVQSSLLLLDYQAVKAATRDFTEKLGSGSFGSVYKGALPDKTPVAVKKLDGLRQGEKQFRAEVVTLGMIHHINLVRLRGFCSEGNKRALVYDYMPNGSLDAYLFTNSPGSKVLSWGQRFGVAVGVARGLAYLHEKCRECIIHCDIKPENILLDEELGAKLADFGMAKLVGHEFSRVLTTMRGTMGYLAPEWLTGAPVTAKADVYSFGLLLFELVSGRRNNGSSEEGGRSAVYFPVHAAVKLHAGDVVGLLDEKLAGNANVEELERVCKVACWCIQDEEGDRPTMGLVVQQLEGIADVGLPLIPSRLHMLATVNGCVGAVADMS

SEQ ID NO: 18556 - DNA, 2612 bp, Panicum virgatum
  misc_feature: Ceres CLONE 1797476
  misc_feature: Encodes the peptide sequence at SEQ ID NO. 18557
gacatgtcattgttaggccgaaaatcaaaagggagaagaaggaaaaggcagggggagaagaggggaaagtaccaagccagctaggaagcgaggaagcagagatgccaaccgcaaggtgctgcgacctctgctcatgagctaatcgtggcgacgacagcgcagaagccccgtcaaggtcaaggccgcctatggatggggatcagaggaggcaagccgccgccgtggtcaccgtcgcacgggcggcgcgcgcgcgggacagccgggcgcggcgcctgatcgcctggctgcagcttctcttccgggcgttcgttcagaggtacggcacgctcgcgagctgggacgcggcggggcgccccgtgcttgtcgtcgccgcggcattcttcctccagcggaccctgcggcgccggtacctgtcatggaaggagtcgtcgcggctgcggcggacggccgcggccgtcaccgtgcaggcggccgtcagggccatggcggctcgccgcgagctctcgctccggaagcagatcagagcagccacgcgcatccaggcgcaatggcgtgcgtaccgggcagtgtggagctacctgatgacgaagagagcagccctgatctgccagcgtgcttggaggcagggcattgcgagaagggagctcaggaagctcagactggagattcttgagagagagatgcaggatgagatgtgcaggctgcgtgagatggtggacgtactccagcaggccgtcaatgacgccgaaacgagggccctcaacgagagggaggcggcgaagaaggcgattacggagtcggaagcggccccggtgatcaaggataccgtggtgatggtcgaggacaccgagaaggttaactcgttgaacgcagaagttgaccggctgaaggatctgctgggagctgaaatgaaggaaacgtttgccgcgaagaaggcgcttgctgaagctgaattgaggaatgagaaactggctaggttgcttggagttgaggaggttaagaacaaacggctgcaagattccctgaaaaggatggagaagaaggcttccaatctagatgaagaaaacaaaatgcttcgacaggctgttgcatcaattcctactatcaagtcaccattgactgaaaaccgtgaaacgcctaatattcaggaaagtcctgataatgagaaaacaccaaatggtgcagtgaagcccatcatagtagatagggagggtactatccatgagaagagtgctgaacaacctagctcaaatggccatgaagctgagaagcaacagcaagatcttctgatcaagtgtctatctgaagatctgggcttctcgatcggcaggcctattgctgcctacctcatctaccgatgtctggtccattggaaatcatttgaagaggagaggaccccagtctttgatcggattattcagaagattactgctgcccttgagggtcgagacaacaatgacacattagcatattggctgtccaattcatgcacactgctggttcttctccaaaggacactgaaaatcaacggggtagctgctttggctcgtcagaggcgaagagcatcgcctcttaaggttccacaggaaaaccaagatgctagtcatcctgaccgtacagtttctgatggacggtttatcagcgggctagctgaagtttaccaggttgaggccaaatatccagctattgcattcaagcagcagctcagagcattgttggagaaggtctatgggataatcaggcacaatctgaagaaggaactgtccccacttctcagcctgtgtattcaggcaccaagaacatttgttgtcagtccaaggggatcatgttctcaaggaacagatttggcacagcaggcttccatggcacattggcagagcatcatcaaaatcctcacaaattctctcaatatcttgaaatcaaattatgtgccggcattcctgatttgcaagttgttcactcaagttttttcttttatcaatgtgcaactttttaacagtctcctgctacggcgcgagtgctgttcgttcagtaatggagaatatgtcaaagctggacttgatgagctagagcactggtgcttttggctgactgaagagtatgctggctctgcctgggatgagctgaagcatattaggcaagcagtcacactcttgatactcgaagagaagcacagcaggagtctcacagagatcacagacgacttttgcccagtgctgagcatgcagcaactgtaccggatcagtacgatgtattgtgatgacaagtatggaaccctgggcattccacaagaagtcatctcaagcatgcggaccaagatgatcgaggcctctagcagtccatccgcgcacgacgatatcaactcgttcttgttagacgatgacttcagcataccgttctccgttgacgacattgccaagctgatggtgcacgtggacatggcagacatggacctcccgccactgattcaggagagcaacggctcgaaactgggacactgaaatgagcggcgaactgatcgacaatacacttcttcttttttcgtgttgcagtgatgtacatagcgagtgatatacgatataccacagttttgagatttgagttctgattgc

SEQ ID NO: 18557 - protein, 770 aa, Panicum virgatum
  misc_feature: Ceres CLONE 1797476
  misc_feature (588)..(695): Pfam Name: DIL Pfam Description: DIL domain
MDGDQRRQAAAVVTVARAARARDSRARRLIAWLQLLFRAFVQRYGTLASWDAAGRPVLVVAAAFFLQRTLRRRYLSWKESSRLRRTAAAVTVQAAVRAMAARRELSLRKQIRAATRIQAQWRAYRAVWSYLMTKRAALICQRAWRQGIARRELRKLRLEILEREMQDEMCRLREMVDVLQQAVNDAETRALNEREAAKKAITESEAAPVIKDTVVMVEDTEKVNSLNAEVDRLKDLLGAEMKETFAAKKALAEAELRNEKLARLLGVEEVKNKRLQDSLKRMEKKASNLDEENKMLRQAVASIPTIKSPLTENRETPNIQESPDNEKTPNGAVKPIIVDREGTIHEKSAEQPSSNGHEAEKQQQDLLIKCLSEDLGFSIGRPIAAYLIYRCLVHWKSFEEERTPVFDRIIQKITAALEGRDNNDTLAYWLSNSCTLLVLLQRTLKINGVAALARQRRRASPLKVPQENQDASHPDRTVSDGRFISGLAEVYQVEAKYPAIAFKQQLRALLEKVYGIIRHNLKKELSPLLSLCIQAPRTFVVSPRGSCSQGTDLAQQASMAHWQSIIKILTNSLNILKSNYVPAFLICKLFTQVFSFINVQLFNSLLLRRECCSFSNGEYVKAGLDELEHWCFWLTEEYAGSAWDELKHIRQAVTLLILEEKHSRSLTEITDDFCPVLSMQQLYRISTMYCDDKYGTLGIPQEVISSMRTKMIEASSSPSAHDDINSFLLDDDFSIPFSVDDIAKLMVHVDMADMDLPPLIQESNGSKLGH

SEQ ID NO: 18558 - DNA, 2408 bp, Panicum virgatum
  misc_feature: Ceres CLONE 1797479
  misc_feature: Encodes the peptide sequence at SEQ ID NO. 18559
atcggccgctttgcttcgctctctcctctccccgctccgctttccgccgcggcgcacggccagcgaattccaattccggccgcacaagccagggagggagccaagcccaagccaagcatattcacccgccgagcgcgtggatctggcggcgcgcagccgcagcagcagaggcggcggctcgcgagaaggagcctcctccgccggtcggtcggtgggggcgggtcgtctataaatggcgaccgaggggagcggcagcggcgtcgcgggagcggcaggaggggaggagccggcgccctctgcttccaacggggaccgcacgaggagtagccccccggccgcggggtcatcctccgcagtagatgacagaggcctccatagagcgagtaccatgccaggggtgattaagaatgatgaaataaccaatgaaactgcaggcccatcaaatttggaaaggtccagaactgagcgtcgccggcaaagcaatccagctgatgatcctgctaaacagttatttgatgaaaggattccaataaaaaagaagctcaaaatgctaaatcggattgctacagtaaaggatgatggaactgtggttgttgatgtaccaagtggtttggaaccagctgcagcttgtgggacagaggatggttatactgaagttgctgttgacgaatcattggatggaacagacataccatacaggcctcctatgcaaattgttatacttattgtgggtacacgaggagatgtgcaaccatttgttgctataggaaaacgcttacaggattatgggcaccgtgtgcgattggcaactcatgccaactttaaggagtttgtactaacagctggcctggagttttacccgcttggtggagatcccaaagtacttgctgaatacatggtgaagaataaaggattcctaccttcgggaccatcagaaattgctattcaaagaaaacagattaaagaaataatattttctttgctgcccgcatgcaaggatcctgatcctgacactggcattcctttcaaagtagatgcaattattgcgaacccacctgcttatggacatacgcatgtggcggaagcactaaaagtaccaattcatatattctttaccatgccatggacgccaactagtgaatttcctcatcctctttctcgtgtcaagcaatctgccggatatcgactttcatatcaaattgtggactcaatgatttggcttggaataagagatatgataaatgaatttagaaagaaaaagttgaagctgcgccctgtaacatacctaagtggcgcacagggttctggcaatgacattcctcatggatacatttggagtcctcatctagtccccaaaccaaaagtgcagattggggcccccaagattgatgttgttggattttgcttccttgatctggcttccaattatgtgcctcctgaaccacttgtgaaatggcttgaagctggtgacaagcccatatatgttggttttggtagccttccagttcaagagccacaaaagatgactgaaattattgtcaaagcactggaaattactggacagagaggtatcattaacaaaggctggggtggccttgggaccttggcagaaccaaaagattttgtatatctactggacaactgccctcacgactggctttttctgcagtgtaaggcagtggtgcatcatggtggtgctggaactacagctgctggtcttaaagcggcatgtcctacaactattgtacctttcttcggtgaccaacctttctggggcgatcgggtgcacgcaagagggctagggcctccaccaattccagttgatcaatttggtttgcagaaattggttgatgctataaagttcatgcttgaaccagcggtgaaagagaaggctgtggagctgtctaaagccatggaatctgaagacggggtggcaggtgctgttagggcattcctcagacacctgccttcaaaaactgaggaacagagtcccccacaatcatcaagcttcctggagttcctaggcccagtaagtaaatgtttgggctgctcatagtgcactacacatcgatcatgatatacaattcgtcgtttgaggaagagaggggttattgtatctcatggaatgtgctcttatgtcagtatgtgcttaaaaaatgttacgcccaatgtaagaagccgggccctcccagagtgtgcgttgtgcagttcttttcttgtttccccctttttacccctctaggtatttgatgtgtaaagagtgcttgtctgatgtggttagcatgcggcgtgcgtaattttgatgtgaaagtttgacgtgcagcaaacgaggatctcacatctgcatggccaatccattttgtatatgacaaactgaagaggttctttttagtttaattgcttgtagc

SEQ ID NO: 18559 - protein, 607 aa, Panicum virgatum
  misc_feature: Ceres CLONE 1797479
  misc_feature (161)..(305): Pfam Name: Glyco_transf_28 Pfam Description: Glycosyltransferase family 28 N-terminal domain
  misc_feature: SWISSPROT Homolog: EC 2.4.1.173 Sterol 3-beta-glucosyltransferase
MATEGSGSGVAGAAGGEEPAPSASNGDRTRSSPPAAGSSSAVDDRGLHRASTMPGVIKNDEITNETAGPSNLERSRTERRRQSNPADDPAKQLFDERIPIKKKLKMLNRIATVKDDGTVVVDVPSGLEPAAACGTEDGYTEVAVDESLDGTDIPYRPPMQIVILIVGTRGDVQPFVAIGKRLQDYGHRVRLATHANFKEFVLTAGLEFYPLGGDPKVLAEYMVKNKGFLPSGPSEIAIQRKQIKEIIFSLLPACKDPDPDTGIPFKVDAIIANPPAYGHTHVAEALKVPIHIFFTMPWTPTSEFPHPLSRVKQSAGYRLSYQIVDSMIWLGIRDMINEFRKKKLKLRPVTYLSGAQGSGNDIPHGYIWSPHLVPKPKVQIGAPKIDVVGFCFLDLASNYVPPEPLVKWLEAGDKPIYVGFGSLPVQEPQKMTEIIVKALEITGQRGIINKGWGGLGTLAEPKDFVYLLDNCPHDWLFLQCKAVVHHGGAGTTAAGLKAACPTTIVPFFGDQPFWGDRVHARGLGPPPIPVDQFGLQKLVDAIKFMLEPAVKEKAVELSKAMESEDGVAGAVRAFLRHLPSKTEEQSPPQSSSFLEFLGPVSKCLGCS

SEQ ID NO: 18560 - DNA, 1741 bp, Panicum virgatum
  misc_feature: Ceres CLONE 1797480
  misc_feature: Encodes the peptide sequence at SEQ ID NO. 18561
acacctcccttctcgttccgacccggccgccgccacatctccaaaccctagctagggttttgcccagccatccccttctcgctccctcgcccccatggatcccttctccaaaaagcgcaaggccgaggagaacggcgccgccaccgcctcccccgccggcggggccgccgcgctgggcctcacccgcgacgacgtcctccgcctcctcgagccgctctcccgggaccagctcgccgacatcgcggccgcggccgccctcgtctcggcgcacgcgctcgacgccgtgcgcgccgccgccgaccgggacccggccctccgcaagctattcgtgcgggggctcgggtgggagaccacctccgactcgctccgcgccatattctccgcctacggcgacctcgaggaggccgtggtcatcaccgacaagaatactgggcggtccaagggctacggcttcgtcacgttccgccacgccgactccgccgtcctcgcgctcaaggagccctccaagaagatcgacggccgcatgaccgtcacgcagcttgctgccgccggcgcggccggagggccttccggtggggccgcgggcagcggtggtgctcctgtggcggatgtctcccttcgaaaaatctttgtcggcaacgtccctgccgacatgtcgtccgagcgcctccttgcgcacttcgcttcttatggcgagatcgaggaggggccgctgggttttgataagcagacgggcaagttccgtggctttgccctctttgtgtacaagacgcctgagggtgcgcaggcctcgttagtggactcggttaaggtaattgataaccaccagcttgtatgcaagctcgcaatagaggggaagaaggggaagcaggggcaatcacaacaatctggggctgccaaccagcagcagcagcagatgatgcagggtggtccacaggaaatgcagggagggcttgggcttgggcctgggccacagatgggagcgcagtatggtggccctgggagtggtctgtcttcattcggtgcatttggtggtgttggcggcgggtttgggggtccaaacccttatggaaacatgccatcttccatgggtggagggggtgctggtgatttaggctcaatgggaggccaggtgcctaccggtttgggtggtgctggggctggcgcatttgggcctggtggaatgggtggtggctcgtttggtggatcatctcagtttggtgctggtgggatgggggcttatggtggccttggaatgggtggaggttccatgtaccgcatgcaacagggtggaggtgggctgcctgcaggtgcctttgaaggagggaactacccccttccagggtcgggtttccgtggccaggaccctcaaggtgggatgtcacctgggccaggtggcagggctcctcctatgtatcccaatgtgccgccttatttctaaggtgtgtgacaactcttgggagcatatgctttgcaatggttgtgctgaattcacatggatgtcttgcatattctggctagtggctacttctgatctggattctggaatgagtttgcactaccagtgttcgatgttggataaatcaagctagtttagtgtttcttgacaatgcttcacatgtacttctttatgactgctttgcagttttcagtttacatagataagtgaagttgcactcaactgtactgtgtcttgtttattgtagtattatcatatgagatccctttgttattattggcc

SEQ ID NO: 18561 - protein, 448 aa, Panicum virgatum
  misc_feature: Ceres CLONE 1797480
  misc_feature (77)..(147): Pfam Name: RRM_1 Pfam Description: RNA recognition motif. (a.k.a. RRM, RBD, or RNP domain)
  misc_feature (178)..(248): Pfam Name: RRM_1 Pfam Description: RNA recognition motif. (a.k.a. RRM, RBD, or RNP domain)
MDPFSKKRKAEENGAATASPAGGAAALGLTRDDVLRLLEPLSRDQLADIAAAAALVSAHALDAVRAAADRDPALRKLFVRGLGWETTSDSLRAIFSAYGDLEEAVVITDKNTGRSKGYGFVTFRHADSAVLALKEPSKKIDGRMTVTQLAAAGAAGGPSGGAAGSGGAPVADVSLRKIFVGNVPADMSSERLLAHFASYGEIEEGPLGFDKQTGKFRGFALFVYKTPEGAQASLVDSVKVIDNHQLVCKLAIEGKKGKQGQSQQSGAANQQQQQMMQGGPQEMQGGLGLGPGPQMGAQYGGPGSGLSSFGAFGGVGGGFGGPNPYGNMPSSMGGGGAGDLGSMGGQVPTGLGGAGAGAFGPGGMGGGSFGGSSQFGAGGMGAYGGLGMGGGSMYRMQQGGGGLPAGAFEGGNYPLPGSGFRGQDPQGGMSPGPGGRAPPMYPNVPPYF

SEQ ID NO: 18562 - DNA, 751 bp, Panicum virgatum
  misc_feature: Ceres CLONE 1797482
  misc_feature: Encodes the peptide sequence at SEQ ID NO. 18563
aacgctcacaggctcacagcaccgcacacacagaaaaccaccagcagcgcctcggttttacggctctgccctcccccaccccgcgcgctccaagaagccatgaagctggaggtgatgcccaagcagagggtcctggaggcggagcagagggaggaggccatggagatgagcggcctggagctgtggaagcacgagaagccccccaggatctaccccatgccgtcgccgatcccgccgccgccggcgtgcgacgagacggcgctcgtgccgccgctcaacttcgccatggtcgacgacggcatcttccgctccggcttcccggagacctccaacttccggttcctcaagtcgctcaacctccgctccatcgtgtacctgtgcccggagccgtacccggagacgaacacggagttcctcgaggagaacgggatcaagctccaccagtttggaatcgaggggcgcaaggtaacgaatcaatcaacaaccttgtttcaatggattttgctgctgcttcgcggttgcggttgttgttggttattggcaattcgtggaggcctagaattactgtggatggttaaaaatacgattgctttcggtaacatccatgatgcgcggtttgtttgccccgaaccaacgttgctgatcatgtcgtcttgtgcatcgatatcctaatttaagtactagcagttgcacttttcactgttgatttttggggataattttagtgctttactcattgaaattcatttgt

SEQ ID NO: 18563 - protein, 190 aa, Panicum virgatum
  misc_feature: Ceres CLONE 1797482
  misc_feature (55)..(190): Pfam Name: Y_phosphatase2 Pfam Description: Tyrosine phosphatase family
  misc_feature: SWISSPROT Homolog: EC 3.1.3.48 Protein-tyrosine-phosphatase
MKLEVMPKQRVLEAEQREEAMEMSGLELWKHEKPPRIYPMPSPIPPPPACDETALVPPLNFAMVDDGIFRSGFPETSNFRFLKSLNLRSIVYLCPEPYPETNTEFLEENGIKLHQFGIEGRKVTNQSTTLFQWILLLLRGCGCCWLLAIRGGLELLWMVKNTIAFGNIHDARFVCPEPTLLIMSSCASIS

SEQ ID NO: 18564 - DNA, 684 bp, Panicum virgatum
  misc_feature: Ceres CLONE 1797482-R
atgtcatacagcatacataaattgatgtgtgaagtgtgccgatttatccgtgtgagtttgtgagaaaaactgcatgatatatctgtaacttcagcactgacgtctgaagatggtgaatgcagaacaagaaaggggcatagaaggagggtcatagtttttctctatgctgatgatgcctaggaatagatacactgacgcattgcatggtggtagcacaatgtgcatccatacatatcgctatccagtgtattgttttgttgctgatgagaggaatctaccggcatgggttgggatgcagtgtttcgagaaaataagatttctccagatgaatccaagcatggacaataaattgaattctatttactagaatagaaataaagcattgtacccatgttctgcatctgatctcgctatcgtgtaaaattgtaaatgtctgtataaatatacatgtaggtgtagctggaattgctttcccatgttttttgtctgctgccctgaatcacatgccttggaatttcatatgtattttcaccctcatttcctcatttagaatatccttatgttatatcagttatgcacaaattgatatgtaggacttgtacaacttcaacaacttgttatgaaaaatgatttggaggggaatatatactagctgaaaaatgtctgtaagctgtatttatggct

SEQ ID NO: 18565 - DNA, 1750 bp, Panicum virgatum
  misc_feature: Ceres CLONE 1797488
  misc_feature: Encodes the peptide sequence at SEQ ID NO. 18566
actctccatcagacactcccattctaccgatcgcaaggaaaaatggaagcttcaaccctgctatggttcctctacgtctcactcgcctcctgccttctctataagttcttcctttcaaccatgacgagctccggtctggcgaggcggccgccgggcccggcgcatctgccgctcctcggcaacatcctcgacctccacggggagctgcaccacgccctcgccaggcttgcaaagacgcacggccctgttatgtccctgaggctcggcgccaccgacgccgtcgtggcctccaccgccgcggcggcgcgcgacgtgctgcagaggtacgaccacgtcctggcggcgcggtcggtgacggacgccgggcgcgcgcaggggcaccacgagctctccgtcatctggctcccgagcaccagcccgctgtggaagcggctccgcgccgtgggcaccagccacctcttctcggcgcgcgggctggacgcgacgcgcgccgcgcgggaggagaaggcgagggatctggtcgcctgcctgggccgccacgccggcgaggccgtgggcgtggggcgcgtcgtgttctcgtgcgtgctcaacgtcgtgtccaacgtgctcttctccgaagacgtggccgacctgagctcggaccgcgcgcaggagctggagatgctggtcagggaccatgtggaggaggcctgcaagcccaacctctcggacctcttccccgtgctcaccaagttcgacctgcagggccggcgccggcgcagcgccgagtttatcggcaggttctacaacttcttcgacgatatcatcgcgcgacgcatcaacgccggcggcggcggcggcaagaaggaggatttcttagacgttctgcttcagcttcactcggtggatcagctcagcctgcaaactatcaagtcctttcttttggatctctttgccgccggaacggacacgaacgcgatcaccgtcgagtggacgatggccgagctgctccgccacccggccgtgatgtccaaggtccgcgccgagctgcgggacgcgctgggctcgaagactcaccctgacgagtccgacctcgacaggctgccctacctccgcgccgtggtgatggagtcgttgcggctgcacccgccgagcccgatgctgatgccgcacctggccatggccgacggcgcggaggtgggcggcttcgcggtgccgagcggcaccaaggtgatcatcaacctgtgggcggtcatgcgtgacccggcggtgtggccggagcccgacgcgttcgtgccggagcggttcgtgggcgcgggcgacgcgtacttccgcgggaaggaccggctggagttcatgccgttcggggccggtcggagggcgtgccccggcacgcccatggccacccgggtggtgccgctgctcctggcatccatgctgcacgccttcgagtggaggctgcccgaggggatgcagcccggggacgtggacgtccgggaccggttcagcacgtcgctcagcatggtcacgccgctcaaggccgtgccggtgccggtgccggcgcgcccgtgacgctccgctcccaatcgatgcgaggatatacgtgccagctctacgtgtactgcattaaagcaagttcaataagtttggcttatagccaaaccatctcatttggagactggctttgcaggcttgcagccaagttatacaatagcttgtgtctttaatttgcatattgttctattgaatcagaaccacttttttactcatc

SEQ ID NO: 18566 - protein, 502 aa, Panicum virgatum
  misc_feature: Ceres CLONE 1797488
  misc_feature (36)..(495): Pfam Name: p450 Pfam Description: Cytochrome P450
  misc_feature: SWISSPROT Homolog: EC 1.14.13.71 N-methylcoclaurine 3'-monooxygenase
MEASTLLWFLYVSLASCLLYKFFLSTMTSSGLARRPPGPAHLPLLGNILDLHGELHHALARLAKTHGPVMSLRLGATDAVVASTAAAARDVLQRYDHVLAARSVTDAGRAQGHHELSVIWLPSTSPLWKRLRAVGTSHLFSARGLDATRAAREEKARDLVACLGRHAGEAVGVGRVVFSCVLNVVSNVLFSEDVADLSSDRAQELEMLVRDHVEEACKPNLSDLFPVLTKFDLQGRRRRSAEFIGRFYNFFDDIIARRINAGGGGGKKEDFLDVLLQLHSVDQLSLQTIKSFLLDLFAAGTDTNAITVEWTMAELLRHPAVMSKVRAELRDALGSKTHPDESDLDRLPYLRAVVMESLRLHPPSPMLMPHLAMADGAEVGGFAVPSGTKVIINLWAVMRDPAVWPEPDAFVPERFVGAGDAYFRGKDRLEFMPFGAGRRACPGTPMATRVVPLLLASMLHAFEWRLPEGMQPGDVDVRDRFSTSLSMVTPLKAVPVPVPARP

SEQ ID NO: 18567 - DNA, 765 bp, Panicum virgatum
  misc_feature: Ceres CLONE 1797497
  misc_feature: Encodes the peptide sequence at SEQ ID NO. 18568
taagccgagcaacgcagagaaaggcgtcttcgtactcgcctctctccgcgactcgaagctttcccccgaaccccattccccccacctgctcaacccccccccccccattccccaccgccgccgccgccccacccttccgtcgacaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggcaaggaggatgctgccaacaacttcgcccgtggtcactacaccattggcaaggagattgttgacctgtgccttgaccgcatcaggaagcttgctgacaactgtactggtctccagggcttccttgtcttcaacgctgttggtggaggaacaggctctggccttggttccctcctccttgagcgcctgtctggtgactatggcaagaagtccaagctcgggttcactgtgtacccatctccccaggtctccacttcagtggatgagccatacaacagtgtcctgtccacccactccctcctggagcacactgatgttgctgtcctgctcgacaat

SEQ ID NO: 18568 - protein, 205 aa, Panicum virgatum
  misc_feature: Ceres CLONE 1797497
  misc_feature (49)..(205): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSGDYGKKSKLGFTVYPSPQVSTSVDEPYNSVLSTHSLLEHTDVAVLLD

SEQ ID NO: 18569 - DNA, 710 bp, Panicum virgatum
  misc_feature: Ceres CLONE 1797500
  misc_feature: Encodes the peptide sequence at SEQ ID NO. 18570
agcgtggtgcagtgtagcaggtgcccgcccgctttccgctgccctcccggctcttcttcctcttccttccttccttccttccacgccacaccccggccactgctggtttctcattggcgagcccagccgaggtcctcgtgggcggccatggcagcagcgagtaggaggaggggcttctccttgccggcggcggcgtgcctggtggttgtcctgctgcggtgcctgtcggcgtccgccgagcccctgccgcagtactacaatgccatcttcagcttcggcgactccttctccgacacgggcaacttcgtgatcatcaactccggcaagctgcccaacatgcccaagttcccgccgccgtacgcgcgctgctccaacggccgcctcgtcatcgacttcctggccgaggcgttcggtctcccgctgctccctccgtcggcgaacaagggcaccaacttcagccagggcgccaacttcgcggtgatgggcgcgacggcgctggacctcaagtacttcagggacaacaacgtgtggagcatcccgcccttcaacacctccatgaacgtgcagctgcagtggttcgacgaggtcaagcagaccatctgctcggacccgcaggagtgccgcgccttcttctccaagtccctgttcgtgttcggcgagttcggcggcaacgactacagcttcgcgtggaaggcggagtggcccctgga

SEQ ID NO: 18570 - protein, 187 aa, Panicum virgatum
  misc_feature: Ceres CLONE 1797500
  misc_feature: SWISSPROT Homolog: EC 3.2.1.51 Alpha-L-fucosidase
MAAASRRRGFSLPAAACLVVVLLRCLSASAEPLPQYYNAIFSFGDSFSDTGNFVIINSGKLPNMPKFPPPYARCSNGRLVIDFLAEAFGLPLLPPSANKGTNFSQGANFAVMGATALDLKYFRDNNVWSIPPFNTSMNVQLQWFDEVKQTICSDPQECRAFFSKSLFVFGEFGGNDYSFAWKAEWPL

SEQ ID NO: 18571 - DNA, 667 bp, Panicum virgatum
  misc_feature: Ceres CLONE 1797500-R
atcgaatcgagctcacctaccagcaggggaccgggaagggttcttgcccggcactggcacagcctgtgtccgtacgccgcatcgactgctctcgctctccccatccatcgctactagctgctcccatcctgtcctgtgctaacagagcaaaacgctgggtgtggtgtgttgcgtgcagggtacaagcgcggcgccctccgcgcgtgctgcggcggcggcgggccgtacaactacaacatgagcgcctcctgcggtctcccggggtcgacgacgtgcgaggaccccgacgcgcacgtgagctgggacggcatccacctcacggaggcgccctaccgcttcatcgccaacacctggctcaagggcccctacgcgcacccgccgctcgccaccgtcgtccgcgaggacatggtcgactgatcatggccatcagtccagccaggtggtagcgcggtgtcagtgtgcctgctgcctgcaagaagagatagtgagtgtgaagagagagagtgctaatataacggatgtgagtgcattccatttgttcatgtatattttgggataagtaagtgagatcgatcgatcggttaggttttttttttttcctttctgctttctccttgttttatttattatcacctgcaatcgagcgagtgtaatactctactactct

SEQ ID NO: 18572 - DNA, 2373 bp, Panicum virgatum
  misc_feature: Ceres CLONE 1797524
  misc_feature: Encodes the peptide sequence at SEQ ID NO. 18573
gagtatcactcactcatcaggaagactagaactccagcacgtctcccacaaatcctcagcctctccggctctccctcccaataaccgcagcccgcaggttcaccgttcacgctgacgcttccactcaccccaagccggggggccaccggccgccgtccgcgggtgagggcgacccttcccatcctgggctcccggccaacttctcctttcacctccacggcaacctgacgcaggaaactccatgtgatccccggcccgatccggccgctccgccccctggatgggatctatccctggagcgcgctagcatgatccgcccccgccgccccgcgcatctcgctctgcacgtcccgagaaggtagcaagaggagcacacgaggcgccgccgtccttttcctgcttttcccccatccagtcgcgccaatccgtcgccgggagattgccgaatttcacgtgcctcgcccgtcttttcattaggatcgatcagttgccattccaaaaccgtggatgccatattctgccccccgagaaatcccaaggttcctgacttccgcttagcttttccccccttgatcgagctgttctgaactcttcgatgccccgccacttctccccgcttctctgagcattttgcttcggttctcgagtataaaaatcccgccttttgttgccttcgtgtctcctcccggttcgagtccccggatccacgattctagattggcgaattgggagttggggtcatggaggcagccgcggcggtggcaatggcggagcaggtggcggcggacctccgagagaagtgtgagacgccaccggcgctgctgcgcgaggtggcgtcggcgatggcccacgagatgggcgcgggactggagaaggaaggcgggagcagggtcaagatgcttctctcctacgttgacaagctccccacagggagagaggaaggatcgttctatggattggacctaggaggaacaaacttccgcgtcttgagggtgcagttgggtgggaatgagaagcatgtcgttaaccgtgagtccagagaagtcagtattcctccacagttgatgtcagggagctcctcggagctttttggtttcattgcttctgaactggccaaatttgttgccgatgaggagaacagcgctaacatatcaaatggaaagaagcgagaactagggttcacattttcattcccagtgaagcaacgttcagttgcttcgggtaccctagtcaagtggacaaaggcattttccattgatgatgctgtaggtgaagatgtagtggctgaattgcaaacagctatggagaagcaaggtctggatatgcacgtagctgcattgattaatgatgctgttggaactctggctggagcaagatactatgacaaagatgttgttgctggtgtcatatttggaactggcactaatgcagcatatgttgagaaggcaaacgccattccaaaatgggaaggcgagttgcccaattcgggggatatggtcatcaacatggaatggggtaacttctgttcatcccatcttcctatcactgaatatgatcaagaattggataaggagagcctgaatccgggagagcagatctacgagaagttaatgtcaggaatgtatttaggtgaaattgtaaggagggtgctccttaaaatatcattgcactcctcaattttcggcaatattgatcacgccaagctcaaaacccatttcctcctgcggactccacatatttctgcaatgcaccatgatgaaacacctgatctgaagattgtggctgaaatactggaagaaaatctagagataacaggcacatccttggagacgcgaaaattggttgtcgaaatctgtgacatcgtggcaagaagggcagcccggctggctgctgcagggcttgcagggatcctcaaaaagctcgggagagattgcaacgcccaggagcaacgatcagtcattgccattgacggaggattgttcgagcactacaccagattccgcgaatgcttggagagcacactgggcgagttgctgggagaggaggcgtccaagtcagtggccgtcaagcacgcagatgacggttcaggaataggtgctgccctcatagcagcttcgcagtctcagtacagaaacgttgtgtgatatagtaatagctagcaaaagtgtttgccatacatgtagggaagattaactagctagtagctcgaatttcttccccgcaacttaacagtccagcatgtggttcacaatgctgagctggaagcaatctgtaaccgaaacgaagtttgacgaagtgactatacatagttccaataacagcagagttgcagagatctccaaatcatgcaatctcgcacttttgaacttttag

SEQ ID NO: 18573 - protein, 467 aa, Panicum virgatum
  misc_feature: Ceres CLONE 1797524
  misc_feature (217)..(462): Pfam Name: Hexokinase_2 Pfam Description: Hexokinase
  misc_feature (10)..(215): Pfam Name: Hexokinase_1 Pfam Description: Hexokinase
  misc_feature: SWISSPROT Homolog: EC 2.7.1.1 Hexokinase
MEAAAAVAMAEQVAADLREKCETPPALLREVASAMAHEMGAGLEKEGGSRVKMLLSYVDKLPTGREEGSFYGLDLGGTNFRVLRVQLGGNEKHVVNRESREVSIPPQLMSGSSSELFGFIASELAKFVADEENSANISNGKKRELGFTFSFPVKQRSVASGTLVKWTKAFSIDDAVGEDVVAELQTAMEKQGLDMHVAALINDAVGTLAGARYYDKDVVAGVIFGTGTNAAYVEKANAIPKWEGELPNSGDMVINMEWGNFCSSHLPITEYDQELDKESLNPGEQIYEKLMSGMYLGEIVRRVLLKISLHSSIFGNIDHAKLKTHFLLRTPHISAMHHDETPDLKIVAEILEENLEITGTSLETRKLVVEICDIVARRAARLAAAGLAGILKKLGRDCNAQEQRSVIAIDGGLFEHYTRFRECLESTLGELLGEEASKSVAVKHADDGSGIGAALIAASQSQYRNVV

SEQ ID NO: 18574 - DNA, 2448 bp, Panicum virgatum
  misc_feature: Ceres CLONE 1797528
  misc_feature: Encodes the peptide sequence at SEQ ID NO. 18575
gtggatagaagaagagcgcggcgaggcgagcaagcggctcttgcggcccgcaggctccggcgctcgtccacctctcatggccaccgccaccgcctcccgcctcgccgtcctcgcgccgcggccgttgccgcccgcaccggggcgacggcggccgcggcacgcccccgctcccggcggcgcccctgcccgccgtcgcgctctctctgccgccccgcgcggccgcgtcctctgcctcgcggcccccgcgcccgccgcggcctccaccaccgacgccggccaggaccgcctccagaaggtgcccatttcgaatatcaggaacttctgcatcatcgcgcacatcgaccatggcaagtcgacgctggcggataagttgctcgagctcacgggcacggtgcagaagagggagatgaaggagcagttcctggataacatggacctggagagggagcgagggatcaccatcaagttgcaggcagctcggatgcgttacatcatgaatgaagagccttactgcctgaatttaatcgatacaccaggccatgtcgatttctcatatgaggtgtcccgttctcttgctgcttgtgagggtgcacttctggtcgttgatgcttctcagggtgttgaagctcagacgttagcaaatgtgtatcttgcattggaaaacaaccttgaaatcataccggttctaaacaaaatagatcttcctggtgctgaacctgaccgcgtcgcacaggaaattgaagagataattggtttggactgcagtgatgcaattcggtgttcagcaaaggaaggtgtaggcatcattgaaatactagatgccctcgtgaccaaaatccccccaccaaaagatacagcaaaagatcctctcagggctcttatatttgacagctattatgatccatacagaggtgtaattgtgtacttccgtgttattgatggcagtataaagaaaggggacaagatatgttttatggccaatggaaaggaatacgttgctgatgaaattggtgtgttatccccaaatcagatgcaagtggacgaactatatgctggcaaggttggttatctctctgcttctatacgatcagtagcagatgccagggttggtgatacaattactcactattcaaaaaaagcagcttctgctttaccaggatattcagaagccactccaatggttttctgtggcttgtttccgatagatgcagatcagttcgaggagttgcgtgaagcactggaaaaacttcagctaaatgatgctgccctaaagttcgaaccggaatcttctagtgccatggggtttggcttcagatgtgggttccttggtcttcttcatatggaaattgttcaggaaaggcttgagagggagtacaatttgaatttaataattactgcaccgagtgtggtttaccatgtgatctgtgcagatggtgaaactgtcgaatgttctaatccgtctttgcttccggaacctgggaaacggaggtctattgaagaaccatatgtaaagattgagatgcttacacctaaggattatattggcccaataatggagctggctcaagacagaaggggcaagttcaaggaaatgaacttcatcacagaaagcagggccaaaattatttatgagctaccgctagcagagatggttggtgatttctttgaccaactgaaatctcgaagcaaaggatatgctagtatggaatattcacttgtcgggtacagggaaagtcagctagtaaagttggatatacaaatcaatggtgatcctgtggaggcgttgtcgacaattgtacacagagataaggcatactctgttggcagggcactgacacaaaaactcaaagaacttatacctcgacaaatgtttagagttcctattcaagcatgtattggcacaaaggtcattgcaagcgaagccctgtcggccatcaggaaggatgtcctgtcaaaatgctatggtggtgacataacgagaaaaaagaaattgctgaagaaacaggctgaaggaaagaagcgaatgaaagcaatcggaagggttgatgttccccaagaagcattcatggctgtgttgaagctggaaaaagaggtgctatgaagtagctcgtgtaatctttctgaagcctcctttctgctgtaaggatctcagcttggaagcgacatgcgattacactcaaaagagtctgagaggttgctttcaacttgccatgcctcagactaaaggagccaattgactatagatcagtggaaagcagctaacctgaaattcactgatattgcttcgaacatcaggttatgaagcctaaaaaagcacgcgggacacaattttggcagacacatgtacaaaactcttgttgtaaaaaggtcattacgtacttcaattacttgtaatgctatactatggcatgttccacagtagattatatattcgcaaattgatatagc

SEQ ID NO: 18575 - protein, 674 aa, Panicum virgatum
  misc_feature: Ceres CLONE 1797528
  misc_feature (562)..(670): Pfam Name: LepA_C Pfam Description: GTP-binding protein LepA C-terminus
  misc_feature (77)..(256): Pfam Name: GTP_EFTU Pfam Description: Elongation factor Tu GTP binding domain
  misc_feature (472)..(561): Pfam Name: EFG_C Pfam Description: Elongation factor G C-terminus
  misc_feature (279)..(349): Pfam Name: GTP_EFTU_D2 Pfam Description: Elongation factor Tu domain 2
  misc_feature: SWISSPROT Homolog: EC 2.7.7.4 Sulfate adenylyltransferase
MATATASRLAVLAPRPLPPAPGRRRPRHAPAPGGAPARRRALSAAPRGRVLCLAAPAPAAASTTDAGQDRLQKVPISNIRNFCIIAHIDHGKSTLADKLLELTGTVQKREMKEQFLDNMDLERERGITIKLQAARMRYIMNEEPYCLNLIDTPGHVDFSYEVSRSLAACEGALLVVDASQGVEAQTLANVYLALENNLEIIPVLNKIDLPGAEPDRVAQEIEEIIGLDCSDAIRCSAKEGVGIIEILDALVTKIPPPKDTAKDPLRALIFDSYYDPYRGVIVYFRVIDGSIKKGDKICFMANGKEYVADEIGVLSPNQMQVDELYAGKVGYLSASIRSVADARVGDTITHYSKKAASALPGYSEATPMVFCGLFPIDADQFEELREALEKLQLNDAALKFEPESSSAMGFGFRCGFLGLLHMEIVQERLEREYNLNLIITAPSVVYHVICADGETVECSNPSLLPEPGKRRSIEEPYVKIEMLTPKDYIGPIMELAQDRRGKFKEMNFITESRAKIIYELPLAEMVGDFFDQLKSRSKGYASMEYSLVGYRESQLVKLDIQINGDPVEALSTIVHRDKAYSVGRALTQKLKELIPRQMFRVPIQACIGTKVIASEALSAIRKDVLSKCYGGDITRKKKLLKKQAEGKKRMKAIGRVDVPQEAFMAVLKLEKEVL

SEQ ID NO: 18576 - DNA, 1742 bp, Panicum virgatum
  misc_feature: Ceres CLONE 1797530
  misc_feature: Encodes the peptide sequence at SEQ ID NO. 18577
tggcctgaaatcgagccgcccctgaggcctgagctgagagttgacggacatggcgtcaacgccgggcaggtctctcctcgtcctcgtctccgtcgtcacggtggtcctcgtcctcgtctccgccgtggagtgctacgacggccgccgtgctgccgcagcgcgctcggccgtggcgcgccgctcccgcattgggatgggcacgcggcacgtgcgccaccgccacaccgcgacgccgccgcaccggtacgtcctcgcggagatgagaaacgcgaccggcggcggcagcgccaagaaccgcagctccccggcagcgtcaaacaacgccacctcgccgaagccggcgcctccggccgagccgagcaagcgccaccgcagccacaggcaccgcgtccgcaactggatcattggcttcgtggtgggctccctcgccggcgtcatctcggggctagtcctgtccgtgctgttccgtctgttcctcaactgcgtccgcgggcggtacggttcgcggtccggcgtcacgatcttcaccccgaagctgatcaggcgcgccgagcacctggcgttcctggagaaagacgacgggctggcgtcactggcggtgatcggccgcggcgggtgcggcgaggtgtacaaggcgcagctccccgcggagcgtgagggcgtggagccccggtacatcgccatcaagaagatcaagaagcagagcgccgacacgcccaacaacctgagcgacgaggagagccggcagctggacaagtggtcgcggcagatccagtcggagatccgtaccgtcggccacatccgccaccggaacctcctgccgctggcggcgcacgtgccccgccccgactgccactacctggtttacgagtacatgaagaacggcagcctgcaccacgcgctccagggcggcggcgccggcagcggcgtcgcggggctgtcgtggccggcgcgcctccgcgtggcggtgggcgtggcggcggggctggagtacctgcacgtctcccaccacccgcagatcatccaccgcgacctgaagccggccaacatcctcctcgacgacgacctggagccgcgcatcaccgacttcgggctggccaaggcgatgcccgacgcgcagacgcacgtgacggcatcccacgtcgccggcacgctggggtacatcgcgccggagtaccaccagacgttcaagttcacggccaggtgcgacgtgtacagcttcggggtgatcctggcggtgctggcgacggggaaggagccgtcggacccgttcttcacgcagacggacgaggtggtcgggctggtcaagtggctccgccgcgtgatgctggccgggaagcacgccgaggccatcgacccggccatcgccggcgccgagaacgaggagcagatcgtgctggtgctgcgcatcgccgtgttctgcaccgccgacgaccccaaggagcggcccagcgccaaggaggtccgctgcatgctgtcgcagatcaggattcatcaggagcttgtgtgaattagagtgtcgtttatcgtggaatattgctagctagtgctgggtcaagtcagtgtgctatactgtgaggtggggccggcaaattaggaccgggtattgataccaggaatccaggataagaccagactgcgtgcgcgcgctggatattccttgatgcacgcgagttgctagctttaggatggatacctgtaatttttcacgtggtcatttgaacatttgctcccgagattcc

SEQ ID NO: 18577 - protein, 486 aa, Panicum virgatum
  misc_feature: Ceres CLONE 1797530
  misc_feature (179)..(476): Pfam Name: Pkinase Pfam Description: Protein kinase domain
  misc_feature: SWISSPROT Homolog: EC 2.7.11.1 Non-specific serine/threonine protein kinase
MASTPGRSLLVLVSVVTVVLVLVSAVECYDGRRAAAARSAVARRSRIGMGTRHVRHRHTATPPHRYVLAEMRNATGGGSAKNRSSPAASNNATSPKPAPPAEPSKRHRSHRHRVRNWIIGFVVGSLAGVISGLVLSVLFRLFLNCVRGRYGSRSGVTIFTPKLIRRAEHLAFLEKDDGLASLAVIGRGGCGEVYKAQLPAEREGVEPRYIAIKKIKKQSADTPNNLSDEESRQLDKWSRQIQSEIRTVGHIRHRNLLPLAAHVPRPDCHYLVYEYMKNGSLHHALQGGGAGSGVAGLSWPARLRVAVGVAAGLEYLHVSHHPQIIHRDLKPANILLDDDLEPRITDFGLAKAMPDAQTHVTASHVAGTLGYIAPEYHQTFKFTARCDVYSFGVILAVLATGKEPSDPFFTQTDEVVGLVKWLRRVMLAGKHAEAIDPAIAGAENEEQIVLVLRIAVFCTADDPKERPSAKEVRCMLSQIRIHQELV

SEQ ID NO: 18578 - DNA, 2386 bp, Panicum virgatum
  misc_feature: Ceres CLONE 1797534
  misc_feature: Encodes the peptide sequence at SEQ ID NO. 18579
gcagtagtgctgcgcacgtcaggagctctcccccctccccactgcatccgatattctggtgagttctcgtggactcgcagtgactgcgcctcgaattggcggcgggatcggtgctcgtgatggatgtgggcttggttctagatccgcttgtttgcgcgtgctcgtagttgcagcccggcttcccccgatttacttttgcggtttctgagcagtttttatcggctgagttcaccgatttcctaagaaaaatatcagtacaggttttggcctcgatttctagtgtgtacttcgtgcgctctacatcaatcgtggtccgatttttcatttttttttgctgttgttcatccagtataagttcattgggcttaaccctcgattcggtctgtcaggtttatgtgctaaaattgcgccttagttccttccaaatctgcagttggtttcagcaattttaccgttcctgttcgtatccgtttctgactttctgtagtgcatcgtgccaaatcgattgcacggtacgagttcggaacactcccttttgtttccagtgctttccccattaaggatttgtccgatctaactatccttcaaatttcctctctccatagtcttaatccctgcacttccccccttcgattgctgcagattgcagccatgggaacccgcagcgtcgccctggtgctcctcgcggccgttctgctccaaaccctcctccccacctcggcggcggagggtttggtgcgggtctcgctgaagaagcagcccatcgaccagaacagccgcgtcgcggagcgcctctccgcggaggagaggcagcgccttctccgtggcgccaactcgctgggctcgagcgatgagggcgacatcatcgcgcttaagaactacatgaacgcgcagtactttggggagattggcgtcggcacgccagcgcagaagttcaccgtcatctttgacaccggcagctccaatctctgggtgccgtcctccaagtgctacttctcgatcgcttgctacgtccactcgcgctacaagtcagggcagtcgagcacttacaagaagaacggaaaacctgctgacattcactatggaactggtgcaattgctggttttttcagtgaggatggtgttaccttaggtgatctggttgtgaaagatcaggaatttattgaagctacaaaggagccaggccttactttcatggttgcaaaatttgatggtattcttggtcttggctttcaggaaatatctgttggcaatgcagtaccagtgtagtataacatgataaaacaaggtctcatcagcgaccctgttttctctttctggttcaaccgacatgctggtgaaggagaaggtggtgaacttgtgtttggtggaatggatcctaaccactacaagggtaaccacacatatgtcccagtcactcagaagggatattggcagtttaacatgggcgatgtcctggttgatgggaagtccactggtttttgcgctggtggttgtgctgcaatcgcggattctggaacttccttgcttgctggccccacagccataattactgaaatcaatgaaaagattggtgctactggtgtggtgagccaggagtgcaagacagttgtctctcaatatggacaacagatcctagatctgttgctggctgagacacaaccagcaaagatctgttctcaggttggtctgtgcacttttgatggcacccatggtgttagtgctggaattcggagcgtagtggacgatgaagctgggaaatctaatggtggtctccgaagcgatccaatgtgcaatgcctgtgagatggctgttgtatggatgcagaaccaactcgcgcagaacaagaccaaggagctcatcctgaactacattaatcagctgtgcgaccgtctccctagtcccatgggagaatcatctgtggactgtgccagtcttaagtccatgcctgacattgcgttcaccattggcggcaagaagttctcgctgaaacctgagcagtacattctgaaggtcggtgaaggacctgctgctcagtgcatcagtggattcacagctatggatatcccgcctcctcgtggccccctctggattttgggtgatgttttcatgggagcgtaccacactgtcttcgactacggcaagctgagggttggcttcgcggagtctgcctgagcgtaccacacactgttaacgcatgcgccaggagaaaactttaccctgttttaacttgcgtatttatccggccggcgatgtgtgtacatatgctacttgttcagtgatgctttcccaagactcatgataacgcccgtctgttttatcctggcaagaatatttctggatgtatttgccatcttcttggactgaattgtctctgtggacccgc

SEQ ID NO: 18579 - protein, 205 aa, Panicum virgatum
  misc_feature: Ceres CLONE 1797534
  misc_feature (81)..(205): Pfam Name: Asp Pfam Description: Eukaryotic aspartyl protease
  misc_feature: SWISSPROT Homolog: EC 3.4.23.40 Phytepsin
MGTRSVALVLLAAVLLQTLLPTSAAEGLVRVSLKKQPIDQNSRVAERLSAEERQRLLRGANSLGSSDEGDIIALKNYMNAQYFGEIGVGTPAQKFTVIFDTGSSNLWVPSSKCYFSIACYVHSRYKSGQSSTYKKNGKPADIHYGTGAIAGFFSEDGVTLGDLVVKDQEFIEATKEPGLTFMVAKFDGILGLGFQEISVGNAVPV

SEQ ID NO: 18580 - DNA, 1894 bp, Panicum virgatum
  misc_feature: Ceres CLONE 1797540
  misc_feature: Encodes the peptide sequence at SEQ ID NO. 18581
aaaataccagtcctattcttaggcagcgcgatccatctccagaggaagaacgagtcctggcctcatgttgcagggaaaactctaactgccacagactgattcccctctctttttctcctcccccttggaggattctgagcacatcagttgtgtgtcttggtgtcctccaaacacaagcacccgctctgttgcccttcacctctccttcctctcccccctgccagggagagaggaagacaggggcacgaagtggcacagagtagtcgcttgtgaaccattcgacctgttgctgctgctgtcgtcatccccggcgaatcaacaaggatggagaggaagcccaccatcctgatgaacaggtatgagcttggccggatgctcgggcagggcaccttcgccaaggtgtaccatgcccggaaccttgcgtccaaccagagtgtggccattaaggtcattgacaaggagaaggtgctgcgtgttggcatgatcgaccagatcaagcgggagatctccatcatgcgccttgttcgccaccccaacatcgtccagctgcacgaggtcatggccagcaagagcaagatatactttgcaatggagtatgtccggggtggtgagctctttgcccgggttgccaggggccggctgaaggaggacgccgcgaggaagtactttcatcagttgattggggctgttgatttctgccacagccgaggcgtcttccaccgggacctgaagccggagaacctcctcgtggatgagaacggtaacctcaaggtgtcagactttggtctgagtgccctcaaggagtgcgagaagaaggatgggttgttgcacacaacatgcggcacacctgcatatgttgcacctgagataatcaacaagaagggctacgacggagcaaaggcagacatatggtcttgcggtgtcatactgtttgttcttcttgccggctatctcccattccaggacacaaatctaatggagatgtaccgcaagattagcagagctgacgtcaagtaccctcagtggttctcttctgatctccggaggttcatgtccaggctccttgatccaaatccaaacaccaggatcaccatcgagaagctggttgagcacctgtggttcaagaaggggtacaaaccagcagtgatgctggcacagtcacacggttcaaacagcctcaaggatgttcaagttgctttcagcaccgaccacaaggacaatgaagccaacaaggtgcgacaacaagacagctctttgaagccaacaagtttgaatgcatttgacatcatctcgcactccaaaggatttgatctgtcaggcctgttcgggaacgaccaagagcagaaggcaagttcacggttcatgacccaaaagccagcatcagcaatagtgtcaaaattagagcagattgccgagacagagcgcttcatggtgaagaaacaggatggactggtgaaactgcaggggtccaaagaagggaggaaagggcagcttgcaatcgacgcagagatcttcgaggtgacaccagccttttatgttgtcgaggtgaagaagtcggcaggggacacattggagtacgaaaagttctgcaacaaggacctaagaccttcactccgagacatctgctggagcagtcaatcagaggaaaagcttccttcactggctgagtcatcacattagagccattctcttagtcagtcgtaagatatgtccttagcccaatctcttcagagatgcaactacaatctgcctccctttctcttttttcccctttctcaaagggctgagaccttgctcccttgagcatcaggccgtagagctctttgtgatcctttttgccagttttcttcttgtagtagcaattgttgaacatggaactcctgtttctttcacc

SEQ ID NO: 18581 - protein, 451 aa, Panicum virgatum
  misc_feature: Ceres CLONE 1797540
  misc_feature (12)..(266): Pfam Name: Pkinase Pfam Description: Protein kinase domain
  misc_feature (312)..(372): Pfam Name: NAF Pfam Description: NAF domain
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
MERKPTILMNRYELGRMLGQGTFAKVYHARNLASNQSVAIKVIDKEKVLRVGMIDQIKREISIMRLVRHPNIVQLHEVMASKSKIYFAMEYVRGGELFARVARGRLKEDAARKYFHQLIGAVDFCHSRGVFHRDLKPENLLVDENGNLKVSDFGLSALKECEKKDGLLHTTCGTPAYVAPEIINKKGYDGAKADIWSCGVILFVLLAGYLPFQDTNLMEMYRKISRADVKYPQWFSSDLRRFMSRLLDPNPNTRITIEKLVEHLWFKKGYKPAVMLAQSHGSNSLKDVQVAFSTDHKDNEANKVRQQDSSLKPTSLNAFDIISHSKGFDLSGLFGNDQEQKASSRFMTQKPASAIVSKLEQIAETERFMVKKQDGLVKLQGSKEGRKGQLAIDAEIFEVTPAFYVVEVKKSAGDTLEYEKFCNKDLRPSLRDICWSSQSEEKLPSLAESSH

SEQ ID NO: 18582 - DNA, 720 bp, Panicum virgatum
  misc_feature: Ceres CLONE 1797542
  misc_feature: Encodes the peptide sequence at SEQ ID NO. 18583
atcctcacatcctccacagagcttcacgcattgcacggggagcagaggagcaacctccgagtagtggcggcgcggagaaagctagcgcccaaacccaatccacctagctagctagcgagataggcatggcgcgctgggccattgcgatccacggcggcgcgggcgtggacccgaacctgccggagagccgccaggacgaggccaagcgcgtgctggcgcggtgcctgcaggccggcgtggacatgctgcgcgcgggggcctcggcgctcgacgtcgtcgaggccgtggtgcgcgagctcgagaccgaccccttcttcaactccggccgcgggtccgcgctcacccgccgcggcaccgtcgagatggaggctagcatcatggacggccgcggccgccgctgcggcgccgtgtccggcgtctccaccgtcaagaaccccgtctccctggcgcgccgcgtcatggacaagtcgccgcactcgtacctcgccttcgaaggcgccgaggagttcgcccgcgagcaggtacggtggccgcccgccgccccaactaatcccaccggattaatctcccgtgctcgttgctgtttccagcatgaatcgtgcatggcctctctagttaccatgcagaaccaccactactaattaaggaaatattaatcatgtttaaatagaaaaataattctagcttttccgacctggcgtaatggccggacagaagaga

SEQ ID NO: 18583 - protein, 171 aa, Panicum virgatum
  misc_feature: Ceres CLONE 1797542
  misc_feature (2)..(163): Pfam Name: Asparaginase_2 Pfam Description: Asparaginase
  misc_feature: SWISSPROT Homolog: EC 3.5.1.1 Asparaginase
MARWAIAIHGGAGVDPNLPESRQDEAKRVLARCLQAGVDMLRAGASALDVVEAVVRELETDPFFNSGRGSALTRRGTVEMEASIMDGRGRRCGAVSGVSTVKNPVSLARRVMDKSPHSYLAFEGAEEFAREQVRWPPAAPTNPTGLISRARCCFQHESCMASLVTMQNHHY

SEQ ID NO: 18584 - DNA, 717 bp, Panicum virgatum
  misc_feature: Ceres CLONE 1797542-R
  misc_feature: Encodes the peptide sequence at SEQ ID NO. 18585
ccgcaggcatcctgttcgactaccgcatcccgctggccgggacggacacgtgcagcgcgctggcgggggcggacaaccacaagggcatggtgatgaacggcctccccatcagcatctacgcgccggagacggtggggtgcgcggcggtggactcgagtggcttcaccgcggcggccacctccacgggcgggctcatgaacaagatgacgggccgcatcggcgactcgccgctcatcggctccggcacctacgcctgcggcgcctgcgccgtgtcgtgcacgggggagggcgaggccatcatccgctccacgctggcgcgcgacgtggccaccgtgatggagtacaagggcctgccgctgcaggaggccgtcgactactgcgtcaaggagcgcctcgacgagggcttcgcgggcctcatcgccgtctccagcaccggcgaggtcgcctacgggttcaactgcaccggcatgttcaggggatgcgccaccgaggacggcttcatggaggtcggcatctgggagtgagctagcgagcggagctggtcgtgcgtgcatacgtggccatcttgcgattgccacgtgggtaatcttccttctcggtcagggtcgtgggtattggctttagtggtaatgattggagctgggattaataatgatcgtgattgtgatggtattgccctgggaaataaaattgtgaaaagttgtatggctcctgatg

SEQ ID NO: 18585 - protein, 173 aa, Panicum virgatum
  misc_feature: Ceres CLONE 1797542-R
  misc_feature (1)..(173): Pfam Name: Asparaginase_2 Pfam Description: Asparaginase
  misc_feature: SWISSPROT Homolog: EC 3.5.1.1 Asparaginase
AGILFDYRIPLAGTDTCSALAGADNHKGMVMNGLPISIYAPETVGCAAVDSSGFTAAATSTGGLMNKMTGRIGDSPLIGSGTYACGACAVSCTGEGEAIIRSTLARDVATVMEYKGLPLQEAVDYCVKERLDEGFAGLIAVSSTGEVAYGFNCTGMFRGCATEDGFMEVGIWE

SEQ ID NO: 18586 - DNA, 2171 bp, Panicum virgatum
  misc_feature: Ceres CLONE 1797581
  misc_feature: Encodes the peptide sequence at SEQ ID NO. 18587
acaaacccacctcgctcgcctcactccccgcgcgctcccagcgcacctccaccccccacccgcccctttccattctcgtcaccccctccgcgcccgggactccagcggctggcaaagctctgcttcccctttggtccgtccctgcgatcccgattcgaattctccgacctcccggccggcgacccgtatatataaggtcgttgatcttctggtggtgacctcgccggcggcggcgtagtacgtacgtgctccatggctcgcggcgacggcgagctcgagctcacggtgggcgtccgcggcgccgggggccgcggcggcgcggcggacgcgcccgcgccgatcagcctcggcaggctcatcctcgccggcacggtcgccggcggcgtgcagtacggctgggcgctgcagctctccctcctcacgccctacgtgcagactctggggctttcacacgcccttacttcattcatgtggctatgcggccctattgctggcttagtggttcaacctctcgtcggtctgtacagtgacaggtgcaccgcgagatgggggcgacggaggccatttattctgactggatgtctgctcatctgtcttgccgttgtgatcgttggattctcatcagacattggagctgctctgggcgacacaaagaaagagtgcagcctctaccatggtcctcgttggcatgctgcaatcgtctatgttctggggttctggttacttgacttctccaacaataccgtgcaaggtccagctcgtgccctaatggctgatctgtcaggtcgtcatggccctagtgcagctaattcaatcttctgttcttggatggcattgggaaatatcctagggtactcctctggttccacaaacaattggcacaagtggtttcccttcctgaaaacaagagcctgctgtgaagcctgtgcaaacctgaaaggtgcatttctggtggctgtggtgttcctgatcttctgcttgactataaccctgatcttcgccaaggaagtaccatacaaaggaaatcaaaacctcccaacaaaagcaaacggtgaggttgaagctgaagctaccggtccgcttgccgtgttcaagggcttcaagaacttgccccctgggatgccgtccgtgcttcttgtaactggtcttacttggctctcgtggttcccgttcatcctctacgacaccgactggatgggccgtgagatctaccacggcgacccaaagggtaccactgctcagatcgcagcgttcgacgaaggtgtcagagttggctcgttcgggctgctactcaactcgatcgttctagggttcagctccttcctgatcgagccgatgtgccggaaggtcgggccgaggctggtgtgggtgtcgagcaacttcatggtctgcatcgccatggcggccaccgcgctcatcagcttctggtcgctcaaggactaccacggatacgtgcaggacgccatcacggcgagcacgagcatcaaggccgtgtgcctggtcctgttcgcgttcctcggtgtccccctcgctatcctgtacagcgtccccttcgccgtgacggcgcagctggcggccaccaaaggcggcgggcaagggctctgcaccggcgtcctgaacatctccattgtcatccctcaggtgatcatcgctctaggcgctggcccgtgggacgcgctgttcgggaaggggaacatcccggcgttcggcgtggcgtccggcttcgcgctcatcggcggcatcgtgggcctgttcatcctgcccaggatctcgaagcgccagttccgggccgtcagcgggggcggccactgagcccggccccgcctggccgccgccggccgaccggatcaggccggccggcgcgcaagaagaagagtttgtatgttgaacagaataagaacgggaaaccatcgtgcttgttgtgtccggtagataggcaggcgtgggcaagtggtggagaaaggtaacgcgagcatccagcaccagctggtaccaaggtctggtctctgctagctagctagtgtaaggagcgagtaggtcagttaaaaagctggtgcgtcgtgagggctccgtcgaccggcagcggtcgcgcttgctcctgttgtcgatcatgcatgtgtgtagctcatctcagcggactgatcagggagaaaaaaggtattcgatcgacc

SEQ ID NO: 18587 - protein, 519 aa, Panicum virgatum
  misc_feature: Ceres CLONE 1797581
  misc_feature (35)..(518): Pfam Name: Sugar_tr Pfam Description: Sugar (and other) transporter
  misc_feature: Functional homolog of the protein sequence given in SEQ ID NO 50772
  misc_feature: Useful for making plants with modulated heat sensitivity
MARGDGELELTVGVRGAGGRGGAADAPAPISLGRLILAGTVAGGVQYGWALQLSLLTPYVQTLGLSHALTSFMWLCGPIAGLVVQPLVGLYSDRCTARWGRRRPFILTGCLLICLAVVIVGFSSDIGAALGDTKKECSLYHGPRWHAAIVYVLGFWLLDFSNNTVQGPARALMADLSGRHGPSAANSIFCSWMALGNILGYSSGSTNNWHKWFPFLKTRACCEACANLKGAFLVAVVFLIFCLTITLIFAKEVPYKGNQNLPTKANGEVEAEATGPLAVFKGFKNLPPGMPSVLLVTGLTWLSWFPFILYDTDWMGREIYHGDPKGTTAQIAAFDEGVRVGSFGLLLNSIVLGFSSFLIEPMCRKVGPRLVWVSSNFMVCIAMAATALISFWSLKDYHGYVQDAITASTSIKAVCLVLFAFLGVPLAILYSVPFAVTAQLAATKGGGQGLCTGVLNISIVIPQVIIALGAGPWDALFGKGNIPAFGVASGFALIGGIVGLFILPRISKRQFRAVSGGGH

SEQ ID NO: 18588 - DNA, 748 bp, Panicum virgatum
  misc_feature: Ceres CLONE 1797582
  misc_feature: Encodes the peptide sequence at SEQ ID NO. 18589
atcgatcatccatcgcaaacagcaagcaagcgtcgtagccaccgagccagccagccagccgcccctcgcctcgccccgagaaaaccagcgagcctaaacctctcgcaatggccgccggtaatggcatcgtggtggtgttcgacttcgacaagaccatcatcgacgtcgacagcgacaactgggtggtggacagcctgggcctcacggaggagttcgaacgcctgctccccaccatgccgtggaacaccctcatggacaccatgatgggggagctccacgcgcgcgggaggaccctgggcgacttcgccgcggcgctgctcacggcgcccatcgacccgcgcgtgccggccgccatccgcgcggccgccgcgctcgggtgcgacctgcgcgtcctcaacgacgccaacgccttcttcatcgagaccgtgctggagcaccacggcctccgcggctgcttcaccgaggtcaacaccaacccgagccgcgtcgacgccggcggccgcctccgcatcgagccctaccacgacttcctccgcggggcgccgcacgggtgcggcgtcggcacctgcccgcccaacatgtgcaagggccaggtgctggaccgcatcctccgcgaggccgccgccgggggcaggaagccgcgcgtcatctacctgggcgacggccgcggcgactactgcccggcgctgcggctggcgcggggaggacttcgtgatgccgcgccgcggggtaccccgtgtgggacctc

SEQ ID NO: 18589 - protein, 213 aa, Panicum virgatum
  misc_feature: Ceres CLONE 1797582
  misc_feature (7)..(210): Pfam Name: Put_Phosphatase Pfam Description: Putative Phosphatase
  misc_feature: SWISSPROT Homolog: EC 3.1.3.74 Pyridoxal phosphatase
MAAGNGIVVVFDFDKTIIDVDSDNWVVDSLGLTEEFERLLPTMPWNTLMDTMMGELHARGRTLGDFAAALLTAPIDPRVPAAIRAAAALGCDLRVLNDANAFFIETVLEHHGLRGCFTEVNTNPSRVDAGGRLRIEPYHDFLRGAPHGCGVGTCPPNMCKGQVLDRILREAAAGGRKPRVIYLGDGRGDYCPALRLARGGLRDAAPRGTPCGT

SEQ ID NO: 18590 - DNA, 347 bp, Panicum virgatum
  misc_feature: Ceres CLONE 1797582-R
ccgctggactccaagttcgagtccagcataccggccgccgcgcaggagggcgccatgcccatcatgccgctcggcgtcaagacctgactcgaccattccagaccggccggaagagattgccggttcgggttcgttcgtggcgatcgcgagctcgatcgaacaactgcgaggcacggccgattaattactagtgtctagctggagtacttattgactataatttttgtgcgtggcgtggcgtggcgtggcgtatccctgatcgagcctgtcaccgctgaattggcggcggctcactgtatctttcctaccaacaaagataaaattaatggatggaattccacgacgac

SEQ ID NO: 18591 - DNA, 1624 bp, Panicum virgatum
  misc_feature: Ceres CLONE 1797588
  misc_feature: Encodes the peptide sequence at SEQ ID NO. 18592
tcagctccctttttcgccgcactactaggtgtctaggtgtttctcagcctgcttggaggtggaggtcagggctctccgcaatatcgccgcccagttgattcaagaaaccacgccgggccgatgagcaggaagagcggcggcgcgcggttgcaatgcgcggatacgaaggatcggggctgctgcttcctagccctcccgcctgtagcacctgccggtgtggatggcgatggcgggttcaacctctcatggaccctccaccagtccttccacccgccggccggcctgttcgccagcgtgggccagcaggtgggggttggattccccgggacctcctctagctccccgtcgccagagactccaagggacccgtatgtctcgccggaggttgtcgagacgcctctgccgggggaaggtgtggggttgagggataaagggaagaagaaagccgtgaagctcaagattaaggttgggaatcaccacctcaagaggctgatcagtggggcaattgcgggcacggtgtcgaggactgccgtcgcacctttggagacgattaggactcatttgatggttgggagcaatgggaattcgacgacagaggtattccagtctatcatgaagcatgaagggtggactgggttgttccgtggtaactttgttaatgtcatccgggtagccccaagcaaggcaaacgagctttttgcctttgatactgctaataagttcttgacccccaaatctggggaggaacagaagatcccagtccctccttcattagtggcaagggcatttgctggtgtcagctcaacactgtgtacataccctctggaattgattaagacacgattaactatacagagaggtgtgtatgacaacttccttcatgcgttcgtcaaaatcgtccgtgatgaagggccgactgagctctacagaggcttaactccaagtctcattggagtagtgccatatgctgcaaccaactactttgcctatgacacccttaagaaagtttacaagaagatgtttaagacgaacgaaattggaaatgttccaaccctgctcatcggctctgcagcaggagctatatcaagcactgctacattccctcttgaggtcgctcgcaagcacatgcaagttggagctgtcggtggtaggaaggtttacaagaacatgcttcacgccctcctgagcattcttgaggatgaaggtgttgggggactttacagaggactggggccgagctgcatgaagttggtgcctgccgctgggatttcttttatgtgctatgaggctggcaagaagatactgatcgaagaagaggatgagtgaagtgcatgcagatgcacaacctcattagagctcagttttgtgacattctgacagcggtcgtctttggttatttctttgaattgactggtgctggaactggatgaaagtcacgactgagatgctgctgcaagcagcaggaattcttgatccgtttttgtattcagtttgatcagataagtttaccactgtgttcccagattttcatatacttgatgagtagaaagcatggctttctaaaacaaattgaaatgccgttggcaatcataatccacaagtggacggaatttcacttggctgc

SEQ ID NO: 18592 - protein, 401 aa, Panicum virgatum
  misc_feature: Ceres CLONE 1797588
  misc_feature (307)..(399): Pfam Name: Mito_carr Pfam Description: Mitochondrial carrier protein
  misc_feature (213)..(301): Pfam Name: Mito_carr Pfam Description: Mitochondrial carrier protein
  misc_feature (119)..(206): Pfam Name: Mito_carr Pfam Description: Mitochondrial carrier protein
MSRKSGGARLQCADTKDRGCCFLALPPVAPAGVDGDGGFNLSWTLHQSFHPPAGLFASVGQQVGVGFPGTSSSSPSPETPRDPYVSPEVVETPLPGEGVGLRDKGKKKAVKLKIKVGNHHLKRLISGAIAGTVSRTAVAPLETIRTHLMVGSNGNSTTEVFQSIMKHEGWTGLFRGNFVNVIRVAPSKANELFAFDTANKFLTPKSGEEQKIPVPPSLVARAFAGVSSTLCTYPLELIKTRLTIQRGVYDNFLHAFVKIVRDEGPTELYRGLTPSLIGVVPYAATNYFAYDTLKKVYKKMFKTNEIGNVPTLLIGSAAGAISSTATFPLEVARKHMQVGAVGGRKVYKNMLHALLSILEDEGVGGLYRGLGPSCMKLVPAAGISFMCYEAGKKILIEEEDE

SEQ ID NO: 18593 - DNA, 1856 bp, Panicum virgatum
  misc_feature: Ceres CLONE 1797595
  misc_feature: Encodes the peptide sequence at SEQ ID NO. 18594
agggtgtggcacgacgcgaccgcgcgagccatcacttggcagttggcagtttggcactccctgctccgccacgtatggctgcaacgctcccttcgtccgccgcagcaccggcgctgctcctccgccgccacaccgccgcttccctatcctcccgctgccgccagcgttggcagcgcccggctgccagacggcgcgatgaccccggagctccgttggagattcggggtgcgcggtggctgccgccaccagcgcctaccggatgcagtggcgcgagcggagccactcctacagcggaggcggcaggggaggcgccgtacagaggcagcgaggcgcaggggtcgctgtggatggtcttgctcgccaccgcggtggtcgtgtgcggctccttcgagttcggcacctgcgtcgggtattctgcacctgctcaagccggaattgtgagcgacattggactgtctaactccgagtttggtgtctttgcatctgtcttgacgattggagcaatgattggtgctctgactagcggccgtctggcagatgtacttggacgcaaaatgaccatgaggtttgcggcagttgtaggcatttttggttggattactatatattttgccaaggatgctatgatgctctatgccggaagggttctgttgggctactgtaccggggttctttcctatgtggtgcctgtgtttatatctgaaatagctccaaaggatatccgagggggccttgcaacctcaaaccagttgttcatctgttcagggtgttcagctgcttacattattggagcacttctttcatggcgctctttggttgtagtaggattagtaccttgtgcggtcctacttgtggggcttttcttcattccagagtctccaaggtggctggccaatatagggagagagaaagcgttccatgcttcattacagaagtttagggggaaagattatgacatttctgaagagactgctgagatcaaaggctatatagaatcaaatcatagattacctaaggcaaggattcaagatttgtttcagagaaaaaatatttatgcagtcacggttggtgtcagcctgatgatttttcagcaacttggaggaataaatgccttaggcttctatacaagctatatcttttcctccgcagggttttctggaacactcgggaccaccttgattggcattattcagattccagtcacattggttggggcccttctcatggataggagtggaagaagagctcttcttttggtctcttcatctggaacatttcttggctgctttctaaccgggctttcattctattttaaggcacaaggactgtactcacagttggttcctactttggccctttgtggcatattgatatattacggagcatactcagttggaatgggaccagttccttggattatcatgtccgagatattctcaatcaacatgaaagcaatagctggaagcttggtaaccctagtcagttggattggttcctttgcgatttcttactcattcaacttccttatggattggaaccccgcaggtacgttctttttgttctctgcagcgagcctggtcactattttgttcgtggcaaagcttgtaccagaaactaaagggagaacactggaagagatccaagcgttgctccaagccagcgcgtgagagactgtgatgaaggacgtacacacgctcgttacccacaagggattcaaaacattggggtaaatactcacctcttgtaaattattacccacaatggattcaaaacattgtggtgaatactcacctcttctaaattctcgccttgtgttaaattcttgtgatttggtgaaggatatttttattaatttc

SEQ ID NO: 18594 - protein, 530 aa, Panicum virgatum
  misc_feature: Ceres CLONE 1797595
  misc_feature (95)..(526): Pfam Name: Sugar_tr Pfam Description: Sugar (and other) transporter
MAATLPSSAAAPALLLRRHTAASLSSRCRQRWQRPAARRRDDPGAPLEIRGARWLPPPAPTGCSGASGATPTAEAAGEAPYRGSEAQGSLWMVLLATAVVVCGSFEFGTCVGYSAPAQAGIVSDIGLSNSEFGVFASVLTIGAMIGALTSGRLADVLGRKMTMRFAAVVGIFGWITIYFAKDAMMLYAGRVLLGYCTGVLSYVVPVFISEIAPKDIRGGLATSNQLFICSGCSAAYIIGALLSWRSLVVVGLVPCAVLLVGLFFIPESPRWLANIGREKAFHASLQKFRGKDYDISEETAEIKGYIESNHRLPKARIQDLFQRKNIYAVTVGVSLMIFQQLGGINALGFYTSYIFSSAGFSGTLGTTLIGIIQIPVTLVGALLMDRSGRRALLLVSSSGTFLGCFLTGLSFYFKAQGLYSQLVPTLALCGILIYYGAYSVGMGPVPWIIMSEIFSINMKAIAGSLVTLVSWIGSFAISYSFNFLMDWNPAGTFFLFSAASLVTILFVAKLVPETKGRTLEEIQALLQASA

SEQ ID NO: 18595 - DNA, 2094 bp, Panicum virgatum
  misc_feature: Ceres CLONE 1797617
  misc_feature: Encodes the peptide sequence at SEQ ID NO. 18596
ccagcaaggcgactaggcgagccctccatccaccgcccacgcccccctctcgactcgcggcaggagagcaggcagaagcaaggacaagccgccaaccagcagaagccaaaacgccgccggcggcgccctcccgagtcccgacgatgcggccgccgcggcgagccgcgctctcgctcgcgctcgggctctccctcgcggccctcctcgcggcgcggggcgccgacgcgtccgtccacgagtacgccggcggcggcttcgcgccgcgggccaactccttcttcttccacggcgggagcgaggggctctacgcgtccgacccgtcctccaattcctccgcatccttcatcaggtttgacactgtagtattccgtcggaccctggagtcagcatctaggcacgaggagatgcagcaaaagacaggattggtggaggctataattgttgagatacaggacagggacaaaattggaggttcataccttcattctgatgcaatatgctgcacccccgagcttgataaggagaaatcttgtagggtaggtgaagtcatcatacgtccaaatcctgataatcctgaatggcctaaaagaatccagacattctttgagggtaaaaatgaagaaaccactatgctacctcagttagtgtcaataaacaaaacagggatgtattacctctattttatgttctgcgacccccaacttaagggattgaagattacaggcaggactgtctggagaaatccgcagggttatctccctggtaaaatggctccaatgatgacattttatggtttcatgtcacttgcatatcttgcacttggacttctatggttcattcagttcgtgcgacgctggaaggacattttgcagctgcactaccatataacagctgtcattgcgcttggcatgtgtgaaatggctttctggtattttgagtatgctaactttaattcaactggaaccagacctatgggcattaccatatgggcagttacatttactgctgtgaagaagactgtatctcggcttcttctgttggtagtttcaatgggctatggtattgttctacccacattgggaggcataacatcaagagttgctgctcttggtttcatctattttgttgcttcagaagctcttgaacttgttgaaaatctgggaaacatcaatgacttctctggaaagacaaggttattcctagtgttgcctgttgcaatacttgatgctacctttatcatctggatattttcatccctctctagaacattagagaagctacagctgcggagaagcatggcaaaacttgaattatatcgaaagtttacaaattctctggccgtgtcagtgcttatctcgatcgcttggattggctatgagctatatttcaatgcaactgatccattgagtgaactttggcaacgggcttggatcatccccgccttttggaatgtcctttcatatgccctccttgccatcatatgcatcctttggtctccatctcgtaatccaacaggatttgcatattcagaggatgcaggcgagggggctgatgaggaggggctctctctagtaggcagtgcaatgaaaggaacaggagatatggtaaacatgcatatctttcctgaggataaacgtgcatgataagttttggccctgaatgcagctgtactcctggcgggatgctatgagaagtactgttttcctctggattcacgactagctgacatgttcaaaagcttgcgtaagattccagatgtacaggtggtgacttgttttgaacgatttgaccaatagatttttacttgcccagttgtgactactcaagatacaaaaagtcggcgcaataaactttcactttgagagcatacgagggttgtctgtgtaatccttgtggtggtgtagagttgtagctcgttgaaatgtagcgttgccagagttgaaatgtagcgttgccagagttgaaatgcatacccagttagcatggatctagtgatatgttagctattgcaggtgtacctatcatgtttattagtaacgcagtattctcgggttcatgactcgaatgtgaatcgtatgaattgctgagccgtac

SEQ ID NO: 18596 - protein, 499 aa, Panicum virgatum
  misc_feature: Ceres CLONE 1797617
  misc_feature (170)..(457): Pfam Name: Lung_7-TM_R Pfam Description: Lung seven transmembrane receptor
MRPPRRAALSLALGLSLAALLAARGADASVHEYAGGGFAPRANSFFFHGGSEGLYASDPSSNSSASFIRFDTVVFRRTLESASRHEEMQQKTGLVEAIIVEIQDRDKIGGSYLHSDAICCTPELDKEKSCRVGEVIIRPNPDNPEWPKRIQTFFEGKNEETTMLPQLVSINKTGMYYLYFMFCDPQLKGLKITGRTVWRNPQGYLPGKMAPMMTFYGFMSLAYLALGLLWFIQFVRRWKDILQLHYHITAVIALGMCEMAFWYFEYANFNSTGTRPMGITIWAVTFTAVKKTVSRLLLLVVSMGYGIVLPTLGGITSRVAALGFIYFVASEALELVENLGNINDFSGKTRLFLVLPVAILDATFIIWIFSSLSRTLEKLQLRRSMAKLELYRKFTNSLAVSVLISIAWIGYELYFNATDPLSELWQRAWIIPAFWNVLSYALLAIICILWSPSRNPTGFAYSEDAGEGADEEGLSLVGSAMKGTGDMVNMHIFPEDKRA

SEQ ID NO: 18597 - DNA, 2252 bp, Panicum virgatum
  misc_feature: Ceres CLONE 1797621
  misc_feature: Encodes the peptide sequence at SEQ ID NO. 18598
agaaaccactatcgggccgaacagacaacccaacccaacgctcattaacgggcaaaaccccccaacccatttccaaaccccctccctcctccacctcccctctcccctcgcttcctcgccgccgccgccgccgccgccacagccaccgccaccatgctccgcgccgccctcacctccggcggcggccgcctcactgccctcctcccccgccaccaccccgcctcctctcctcgtcctccaccatcgcctccctcttctccgatcccacccctcccgcggaccccgccgccgcgatccagtccgccggcgtcgatctctcccacccggacaccgtccccgcgctcctcctcgacccggggctcgcgggaaactaccccgcggcctcgcgcttcttctcttgggccgcgtccgaccccgccgccaaggccgcgctcaactcccggtccttcaactccatgctccagctcgccgccgcgcacggggacgccgaccgtttctggtctctcgtcgcgtccatgcggtctaggggctacgggatctccaagcccgccttccgggccgcctccgagagcttccgggccaaggacatggccagggacgccgacctgctgccggtggcattcgccgcgcacggcaggaacgcggcggcggccgaggtatgcaagattctacgggcgccgggcaaggatgacacccaaaagctagccatgctgagtggatcgagtgttgaggtgactgatgaactggtggcattagtggtggagaaggtcgggcagttcccgcagcaagcaatggtgttcttccggtgggtggaacagtcagctggagccgggatcagttggggcaaggtttacaatgtgatggcgaaggttctcggccgtgaggattgcattgaggagttccgggaggtcctgcacaagatgaggggcaaggggcttgagatggatcgagatgtgtatgttactgtcaccgacagattcctcaagaggaagatggttgaggatgctgtggacctgttccgattcatgacatgcaggccagagaagctctcgagggatgatttcatattcttgctgaagaaggtcctagtgactggggatttggatttcaagttggtgacgagagtcttgcagtactatcagcatgtgggcagcaaggtcagagactcaacttttgattctgttctcaagtcgttgaggagtgtagggaggcttggggagagtgacagagttctgaaggcgatgcaggaaggtggtttcgaaccggatagtgctgatcatgaaaaggctgttcttgcaatgtgtgatgctggcaatctggaagaagcacgaaattatttgactggtgtggaagagccagggcataagttgggtccaaagatatggtcttgtttagttcagaagtattctcttggtgaaaatgtggatacagcagtgtcgtgcttccatgaaatgctggaaaaaagcggcaccggcaacgagaacgtgggttctgctcttgaggtgctggtttctggattacacaagaagagagggtcgaaggaagcattcaaagttctgaagaacatggtaacagagaaggctgtggttccttggcaaactacctacaagtatttggtccacaagttaatccgccaaggacatctgaaaccagcttttgaagtgctaggtttaatgaaaagccatggttatccacctttcgttgatccttttatccctcatatttcaaagtctgggactgtggatgatgccctgggtttgctgaatgcaacatctttgagggggttgccgtcaagaatagtttatctgcgcttatttcaagctttcttcaaagaagagaggcatgaagtttcccaacagctgctttcccagtctcctgctagcatccaaaaccatgcagatattcgtgatattttcaataagctggaagaacctgtcgcagcagcattggcagagggttgatacgtggctaaattgagtttttgatgcccacatttggatggcaagctgaatttgcccttttgactttgtaatagggatttgagctgatatcagaaactttagctgaaatgcttgcactattttccaaagaaataagttattattttcttaaaaaaaaatctccttagcttctttctgtttgagccacatattaccatgccttatgcagttatgctggcagggccgtatgaatcaatagctgttgtctttggctgctttgttattggaagatgcaaagattggttcttatcc

SEQ ID NO: 18598 - protein, 652 aa, Panicum virgatum
  misc_feature: Ceres CLONE 1797621
  misc_feature (282)..(316): Pfam Name: PPR Pfam Description: PPR repeat
KPLSGRTDNPTQRSLTGKTPQPISKPPPSSTSPLPSLPRRRRRRRHSHRHHAPRRPHLRRRPPHCPPPPPPPRLLSSSSTIASLFSDPTPPADPAAAIQSAGVDLSHPDTVPALLLDPGLAGNYPAASRFFSWAASDPAAKAALNSRSFNSMLQLAAAHGDADRFWSLVASMRSRGYGISKPAFRAASESFRAKDMARDADLLPVAFAAHGRNAAAAEVCKILRAPGKDDTQKLAMLSGSSVEVTDELVALVVEKVGQFPQQAMVFFRWVEQSAGAGISWGKVYNVMAKVLGREDCIEEFREVLHKMRGKGLEMDRDVYVTVTDRFLKRKMVEDAVDLFRFMTCRPEKLSRDDFIFLLKKVLVTGDLDFKLVTRVLQYYQHVGSKVRDSTFDSVLKSLRSVGRLGESDRVLKAMQEGGFEPDSADHEKAVLAMCDAGNLEEARNYLTGVEEPGHKLGPKIWSCLVQKYSLGENVDTAVSCFHEMLEKSGTGNENVGSALEVLVSGLHKKRGSKEAFKVLKNMVTEKAVVPWQTTYKYLVHKLIRQGHLKPAFEVLGLMKSHGYPPFVDPFIPHISKSGTVDDALGLLNATSLRGLPSRIVYLRLFQAFFKEERHEVSQQLLSQSPASIQNHADIRDIFNKLEEPVAAALAEG

SEQ ID NO: 18599 - DNA, 1674 bp, Panicum virgatum
  misc_feature: Ceres CLONE 1797625
  misc_feature: Encodes the peptide sequence at SEQ ID NO. 18600
ccagcgactcgaccacagaagcggcggcggcggcggcggcggagggagaagaggaggcgaaggcgagggcgcgagggagggagcggagcaccagccatggtgcacgtcagcttctaccgcaactatggtaagacattcaagaaaccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcgctgctccgccgcatgaaccgctatgggctgcttgctgagggtcagaacaagcttgattacgtccttgccctcactgctgagaacttcctggcaaggcgccttcagacacttgtcttcaaggctggcatggccaagtccatccaccatgctcgtgtcttgatcaagcaacgccacatcagggttggcaggcaaattgtcaatgtcccatcattcatggtgagggtggagtctgagaagcacattgacttttcactgtcaagcccgttcggcggaggccccccaggcagggtgaagaggaagaaccagaagaaggcaagtggtggtggcggcgacggtggcgatgaggatgaggagtgagaatgaaccagtagccgtttcctgatataatattatctagttgtcatgaacatgttggtatcttgagctcttagctgtgtggcctgatgctcagtcccctgtgctgactgggcatcacagatggttatcattttatcttgcagtgttattagcctatacctagctgctgtgtttggagatgtttaatcaagttgcgtttcaacttctgttgtcatcaaagctgtacctgttttctctgcacctatgatttgccaagtcgttcacataaaaatccgttgcactacaacacctctgcgttcttcatcgatttggcacagccatcatctagctacgagctcacaattaagttcaaccccgggcagctatatggcggcgatcaccggtagaagggcggcgctcgcagtggccgcgctcctctgcgccatggcggcgatggccgctgcgcagcaggcctccaacgtgcgcgcgacgtaccacctatacaacccggcgcagaacggctgggacctcaaccgcgtcagcgcctactatgccacgtgggacgccaacaagccgctgtcgtggcggcagaagtacggctggaccgccttctgcgggccctcgggccctaggggccaggcctcctgcggcaagtgcatcaaggtgacgaaccgtgcgacgggcgcatcgaccgtggcgaggatcgtggaccagtgcagcaatggcggcctggacctggacttcgagacggtgttcaagaagattgacaccaatgggcaaggctaccagatgggccacctcaacgtcgactaccagttcgtctcctgctgagtgagctttgcgcacgcacgatcgaccggggaggaagctggaggatgtaataataattaagcgcctcgcctagatgtgtggtgtgatggaataaaagggaacagagacccgaatgatggtagctagtaatacagaataaacgaaacagaattggactaaataaagcgagatttcgatatt

SEQ ID NO: 18600 - protein, 195 aa, Panicum virgatum; identical to SEQ ID NO: 10267
  misc_feature: Ceres CLONE 1797625
  misc_feature (7)..(108): Pfam Name: Ribosomal_S4 Pfam Description: Ribosomal protein S4/S9 N-terminal domain
  misc_feature (109)..(156): Pfam Name: S4 Pfam Description: S4 domain

SEQ ID NO: 18601 - DNA, 1719 bp, Panicum virgatum
  misc_feature: Ceres CLONE 1797628
  misc_feature: Encodes the peptide sequence at SEQ ID NO. 18602
cctcactcctccactcaccctgcatcactcacctcagctcagctcagcccagctcaattgggcgcccgtgattgaggagccacggcggccagcgacgggtgcgacgccatggtcgaggcggtgatggcgcccggctgcggcggcgggggaggtgaggggaaggcggaggaggggcggcagcaggcgcaggcgcaggcgcaggcgcaggggcaggtgctggcgctggtgctggccgcgctccgcaagtcggtggtgctgccgtgccaggtggcggacgccgacgaccccgcgggggcggcccgggggatggagatcggctggcccaccgacgtccgccacgtcgcgcacgtcaccttcgaccgcctccacggcttcctcggcctccccgtcgagttcgagctcgagatccccggcccggtccccagcgccagcgcgagcgtgttcggggtgtcgccggagtcgatgcagtgcggctacgacgacaaggggaactcggtgcccaagatcctactgcagatgcaggagcggctgtacgcgcaggatggactcagggcagaggggatcttccggatcaccccggagaacagccaggaggagcatgtgagggagcagctcaacagtggcatcgtgcctgacgacatcgacgtgcattgcctggccagtctgatcaaggcctggttcagagaactccctgagggcgtgcttgacagcctctcacctgtgcaagtccttcactgcaacacagaggagcaatgcattgagctcgtggagcttcttccaccaactcaagctgcacttcttcattgggttgtagagctcatggctgatattgttgaggaagaggagtcaaataagatgaatgcgagaaatgttgccatggttattgcacccaatatgacacagatgtccgatccactgactgctctgatgcatgctgttcaagtcatgaacttgctcaagaccttgattctcaaaacacttcgagaacgtgatgatgatgatgcaggagcctattcatcattttcatattcatcatctttatctgaagaaatcgatgaggagggtcatgaccaacaggatgatgaaaatgatagtggcagtaagaactgtaactgcgatgataacaaaagacaaaaagatattgacaaggcgtctgcactaagagtagacaacgaacagctaattggtgtgtccaggaggcacacatcaattgactgccatttgcctttcattggattcgaaaactataatgaagacacgtcgctggatgatattgaagaatgtttcttaagaaggctagaatggaaagctgtaagggaatgtgttgctgaagacaacactagcagttttcctgcccccaaggaaggggcagagcagctgagctcgtctgaaagtattacagaaggtagtaacacaaatgtcgaaaacagagatgtgacaagcaacgccattgatgtaactatcaatgagctgaggcaaatggaaattagaattgaaatgacagatgcagaggtaagaaatgctacaaaaggcgagctaattctttgctcataagctatcgtcacaagggcgctggttatctttcatgtaagtttatgtgaagttgtaagtcggttcttggcagtccctcagtcaacacgaggctggggaactttgtccttgtaatattcttcgcatgctctcgagcatgagcagcgtagttgagtagttgtgtggttt

SEQ ID NO: 18602 - protein, 481 aa, Panicum virgatum
  misc_feature: Ceres CLONE 1797628
  misc_feature (131)..(271): Pfam Name: RhoGAP Pfam Description: RhoGAP domain
  misc_feature (68)..(114): Pfam Name: PBD Pfam Description: P21-Rho-binding domain
  misc_feature: SWISSPROT Homolog: EC 2.7.11.1 Non-specific serine/threonine protein kinase
MVEAVMAPGCGGGGGEGKAEEGRQQAQAQAQAQGQVLALVLAALRKSVVLPCQVADADDPAGAARGMEIGWPTDVRHVAHVTFDRLHGFLGLPVEFELEIPGPVPSASASVFGVSPESMQCGYDDKGNSVPKILLQMQERLYAQDGLRAEGIFRITPENSQEEHVREQLNSGIVPDDIDVHCLASLIKAWFRELPEGVLDSLSPVQVLHCNTEEQCIELVELLPPTQAALLHWVVELMADIVEEEESNKMNARNVAMVIAPNMTQMSDPLTALMHAVQVMNLLKTLILKTLRERDDDDAGAYSSFSYSSSLSEEIDEEGHDQQDDENDSGSKNCNCDDNKRQKDIDKASALRVDNEQLIGVSRRHTSIDCHLPFIGFENYNEDTSLDDIEECFLRRLEWKAVRECVAEDNTSSFPAPKEGAEQLSSSESITEGSNTNVENRDVTSNAIDVTINELRQMEIRIEMTDAEVRNATKGELILCS

SEQ ID NO: 18603 - DNA, 1704 bp, Panicum virgatum
  misc_feature: Ceres CLONE 1797643
  misc_feature: Encodes the peptide sequence at SEQ ID NO. 18604
actcccgttcctcccgtcgagatctccctcccgtcccgttgctgtgcgccacgcgtcccccggagctgccgcccccagccaccgctccaggagctggcgccccttggccggcgcccccagccgccgccgcccgaggccaccgtccccagccaccgcggcccagggctgcctcgccgaggagccccgcccgcagacgaccatcagcaggggccaggaatatctaggcgagtcacatccaccaattccaatctcattgtcgctggccgttgctttctccacttcgcccaccatgctctccgccatggccgcgcgctgccccgtgaccgcgagcagctcacgccgccctcctctcccagctcaggcggcggcggcggctgctgctgctgctggccctttctcttcccctgcggttcgtggagtcagatcgggggcgggagcgaagcgctcgctccttcggccgtgcccgatgctgctgacgtctgtggcagtggggagtttggttgccgctggggccgctaatgctgccgagctattggatcctctgcacggatcatcagaacttcttctggctgatcttggcattggagattggtttgggggtttgctgttttctgctggacagcaggctaacgaggctgttcaggatcagctatctgctcttagtttctctagcttggcagttattttcggtgctggacttgtaactagtttgtctccatgtacactcagcgttctaccattgaccctaggatatataggtgcatttggctctggaaaaggccgaaccgaggttatcggaaattcagtagcattttcattaggactggcaacaaccttagctattcttggtgttgctgcttcgtttgctggaaaggcttatggtcaggttggacaaggactcccagtggctgcttctggattggccatcatcatgggactgaaccttctagaggtagttgagttgcaacttccctcctttttcagcgattttgatcctcgagctgctgctgctaacctcccttcaagtgtacaagcatatcttgctggtcttacatttgcattagcagcatcaccttgcagcacacctgttcttgctacccttctgggatatgttgccacttcaagagaccccattattggaggaagcttattgttgacatacacaacgggctatgttgcgcctcttcttattgcagcttcttttgctggagcattacagagtttgttgtcattccgaagatactcagcatggataaacccaatcagtggtgcatttctacttggtggaggtgtctacacccttctggacagggtgtttcctgcaacatcaatggcaatgtaggacattgttggacaagaactgcaagacaacagtccattgaacatgtgatagcaatgtctttagatgtacagtaggtaatgatcaagcactgacagagtatttttggttctctctgcaatgtataggcgtgtaaatgattccagacagccaagacatctttacctcattagtctgtactgtaagggcctcaataattggaggtgtaccctgttaaaattacttacatctggagactggaaggattatataatacatgaaatccatatatgcgtatgtacctaaggatcggtgtttgaaccaatgaccaaaactggttatcagggcatctggcgggcccaaatttagtggtcaattcctttgcg

SEQ ID NO: 18604 - protein, 346 aa, Panicum virgatum
  misc_feature: Ceres CLONE 1797643
  misc_feature (128)..(335): Pfam Name: DsbD Pfam Description: Cytochrome C biogenesis protein transmembrane region
  misc_feature: SWISSPROT Homolog: EC 1.8.1.8 Protein-disulfide reductase
MAARCPVTASSSRRPPLPAQAAAAAAAAAGPFSSPAVRGVRSGAGAKRSLLRPCPMLLTSVAVGSLVAAGAANAAELLDPLHGSSELLLADLGIGDWFGGLLFSAGQQANEAVQDQLSALSFSSLAVIFGAGLVTSLSPCTLSVLPLTLGYIGAFGSGKGRTEVIGNSVAFSLGLATTLAILGVAASFAGKAYGQVGQGLPVAASGLAIIMGLNLLEVVELQLPSFFSDFDPRAAAANLPSSVQAYLAGLTFALAASPCSTPVLATLLGYVATSRDPIIGGSLLLTYTTGYVAPLLIAASFAGALQSLLSFRRYSAWINPISGAFLLGGGVYTLLDRVFPATSMAM

SEQ ID NO: 18605 - DNA, 648 bp, Panicum virgatum
  misc_feature: Ceres CLONE 1797659-R
  misc_feature: Encodes the peptide sequence at SEQ ID NO. 18606
catctcattcacttacaggagtattattccaagaaagctatgactgacatggatagcaccaacgtgtatgcttacatctcgataatttcgctccttgtttgcattccacctgcactgatttttgaagggcctcaactgatgcagcacggatttagcgacgctattgctaaagtaggtctgcaaaagtttgttactgaccttttcttggttggactgttctaccatctgtacaaccagcttgctacaaatactttggagcgagtggctcctctgacacacgctgttggcaatgtgttgaaacgtgtgtttgtcattggtttttcaatcattgtttttggcaacagaattacgacacaaactggaattggcacttgcattgccatagctggtgtggccatgtactcttacatcaaggctaggattgaagaggagaaaaggaaaaagagcgcatgatgaggtgactactgtgaatatgtgtcgggtggctgagttgtacttcctgagacaacatcgtcgacaatcatgacttccttctctgccttgttttttgttttcaccttgaggcatttggtcaattgtttgttcccaacctggtcatgaacagcagcacattgcagatggcaagtatattgttcttcataccatcag

SEQ ID NO: 18606 - protein, 150 aa, Panicum virgatum
  misc_feature: Ceres CLONE 1797659-R
  misc_feature (5)..(136): Pfam Name: TPT Pfam Description: Triose-phosphate Transporter family
HLIHLQEYYSKKAMTDMDSTNVYAYISIISLLVCIPPALIFEGPQLMQHGFSDAIAKVGLQKFVTDLFLVGLFYHLYNQLATNTLERVAPLTHAVGNVLKRVFVIGFSIIVFGNRITTQTGIGTCIAIAGVAMYSYIKARIEEEKRKKSA

SEQ ID NO: 18607 - DNA, 463 bp, Panicum virgatum
  misc_feature: Ceres CLONE 1797659
gaaaaatcgatccgtgcaagcacacaccaagcaaatcgaggaaagtgcaaagcgcggcgtcccaatcagcggacgtggtgagcagcagcaaatccatggaggccgtgctgatgcagcgggcggcggcggcgaggtgggggttcgtaggggaggcggcgacgggtggcgccgggcagcagccggccggcgttttccggctcggtgcggcgcggcgcgcacccggcggggccgtccgggccagcaggcttgagggtcccgtgcggcgctcggcgcgctctccggcggcgccgccggtgtcgccggcctcctcggcctccgccgccgcgccgcgccacckccctctggcctcgcatcctcgccgcrcctcccgtctctctystgcgccgtcccgcccgttgccggcctgctcgtgtggggccgcctgcttcggcgggcgttcttccccgctgcctccctcccgctg

SEQ ID NO: 18608 - DNA, 1285 bp, Panicum virgatum
  misc_feature: Ceres CLONE 1797669
  misc_feature: Encodes the peptide sequence at SEQ ID NO. 18609
gcccacggcaccgcaccaccggctttcccgacgacgaacccatcccatcgcgattccaattcagttcagcgcgaagccaagccaccttatctgtgcctgcgcgtgtccaatcaccaggctccgctccactgccctgccgcttgccaccgcccgcgcgccctcccgcgccgcacgccatggccgcgaccgcgtccaccgcggccgcgctgctgccgcggccggttgccggcacgccgcgccccggctccgcggcgtcggccccatccacgtctcgcaggaggcgcctcctcgcgctcaggtgccagtccaccagcgtcgacaaggagcagcagcagcagccgccgcccaagccgaagcagcggaacctgctcgacaacgccagtaacctgctaaccaacttcctcagcgggggcagcgtcgggaccatgcccgtcgccgagggagccgtcaccgacctcttcggcaagcccctcttcttctcgctgtacgattggttcctcgagcatggctctgtctacaagcttgcttttggacccaaatcgttcgtagttgtctccgaccctatcgtcgctagacacatcctccgggagaatgctttctgttacgataagggagttctcgctgaaattttaaaaccaataatggggaagggtcttatacctgccgaccttgatacctggaagcagaggagaaaaggttagaaagttataacacctgggttccatgccttattcattgaagctatggtgagaatatttactaaatgctcagaaagaacaatatccaagcttgaacagcttactgaaagtgaaggccaagtcataatggaccttgaagctgagttctccaatttggcactcgatataattggtttgggtgtgttcaattttgattttgactcagttactaaggaatcccctgtaatcaaggcagtgtatggaacacttttcgaagctgagcaccgatccacattttacattccctattggaatcttccttttacaaaatggatagttccaaggcagcgcaaattccatagtgacctcaaggtcatcaacgattgccttgataatcttataaaaaaatgcaaaggagacaaggaagctgatgtggaaaagctccagcaaagggactactcatctctgaaggatgtcagcttgctgaggtttcttgttgacatgcggggagctgatgttgatgatcgccagcttcgggatgatcttatgacgatgcttattgctggacatgaaacaactgctgctgttctgacatggtctgtttttct

SEQ ID NO: 18609 - protein, 180 aa, Panicum virgatum
  misc_feature: Ceres CLONE 1797669
  misc_feature: SWISSPROT Homolog: EC 1.14.14.1 Unspecific monooxygenase
  misc_feature: Functional homolog of the protein sequence given in SEQ ID NO 50441
  misc_feature: Useful for making plants with altered carbohydrate content
MVRIFTKCSERTISKLEQLTESEGQVIMDLEAEFSNLALDIIGLGVFNFDFDSVTKESPVIKAVYGTLFEAEHRSTFYIPYWNLPFTKWIVPRQRKFHSDLKVINDCLDNLIKKCKGDKEADVEKLQQRDYSSLKDVSLLRFLVDMRGADVDDRQLRDDLMTMLIAGHETTAAVLTWSVF

SEQ ID NO: 18610 - DNA, 668 bp, Panicum virgatum
  misc_feature: Ceres CLONE 1797669-R
  misc_feature: Encodes the peptide sequence at SEQ ID NO. 18611
cttgttaatcaggcgttctctccagccagacaaagttgccaggtgggtacaatggagcaaaagagggatatgaaataccaaccgggactgatatatttgtttcggtgtacaacctccaccgatccccatacttttgggaccggccaaatgaatttgaacctgagagattttcagttccaaagaaggaagagagcatagaaggctggtctggttttgatcccagcaggagtcccggcgcaatgtaccccaatgagatcatagcggactttgctttccttccctttggcggaggaccccgcaagtgcgtgggagaccaatttgcgctcctggagtcaacggtggcactgtccctgctgctgcagaagtttgatgtggagctgagggggtcgcccgatgaagtggagatggtgacgggcgctaccatccacacgaagaatgggctatggtgcagactaaggcggaggacctgatcaaacatagcttttacaccgagaagtagctctcttgcttgacttctttgatatgctttagccaagctaaacagcttcatgaatccttatttaaaaaaggccctcatgaacagcgaatgagaatcatgtacatggagacatctcctgtagcgcaatagtgacaatcataaaaccatttaaccatttctgtgcatacct

SEQ ID NO: 18611 - protein, 76 aa, Panicum virgatum
  misc_feature: Ceres CLONE 1797669-R
  misc_feature: SWISSPROT Homolog: EC 1.14.15.3 Alkane 1-monooxygenase
  misc_feature: Functional homolog of the protein sequence given in SEQ ID NO 50441
  misc_feature: Useful for making plants with altered carbohydrate content
  misc_feature: Functional homolog of the protein sequence given in SEQ ID NO 50773
  misc_feature: Useful for making plants with altered cell wall content and/or composition
  misc_feature: Functional homolog of the protein sequence given in SEQ ID NO 50320
  misc_feature: Useful for biocontainment applications
  misc_feature: Useful for making plants with modulated biomass
  misc_feature: Useful for making plants with modulated flowering time
MYPNEIIADFAFLPFGGGPRKCVGDQFALLESTVALSLLLQKFDVELRGSPDEVEMVTGATIHTKNGLWCRLRRRT

SEQ ID NO: 18612 - DNA, 1704 bp, Panicum virgatum
  misc_feature: Ceres CLONE 1797695
  misc_feature: Encodes the peptide sequence at SEQ ID NO. 18613
catcgttctcccggaaacctcaacctcctagatcgatcgatctagcccccctcgccggaggaagctcgccatggcggacgccatcgtctccgccgtcataggcgaggccgtccgcagggtgatctccctcctcacgggacgcttcggagtcggccaccagcagagcaccgaggacaagctgcggaggatctgccgcacgctcgtcaggatccacgccgcggtggaggaggccagagggcggcagatcaccaacgatggcgccctccggtggctctcggagctcatcgacggcgagtaccaggcccggtacctgctcgacacggttggccttggccgcggcagccgggacgagctcgaggtcacgaactcccgcgacgacaaccaggtgccggcgcctcctcctccgcgagattcctccacttccccgttcaaccctgcgaagcgcgtgcggcgggtcgccgcgaccgccgtgaggagggctttgtcgcgcggcgatcccggtactgacggcgacgagatcgacagggctctcgagagcttgcaggaggcctcggctcacctcggtgagttcattctgctcctccaaggctgccagccgatccgccgtcccctgccaacgagcatcttcatcgacgggcagatgttcggccggcacgtggagaaggagcgggtcatcaacttcctcctgcacgacggcggcgccggggagctgggcgtgctcccggtcgtcggcgccgtcggagccggcaagacgaccctggtgcagcacgcctgcgacgacgaccgggtgcgcgggcacttcgccgcgatcctcttcctcaacttcccgtgcacctacgccatcgcggcgagcggaggagccgccgccgccgccctccggtccaagcacgtcatcggcgacgctccgcgcggcctcagcgacccgctgcggtggatcaaggggaataattttcagagcaagcggttcctgatcgtgttcgaggacgtcgacatgcgcgggaagcagaggctggaggagctcctgctcaagctgaggcgcgccggcgccgagcaggggagcagggtgatcttcacgacgagcaaccggcgcgtttcgacgttggggacggtggagccggtcgtgctcaaggtcctgcccgccccggagtactggttcttcttcaaggcgcacgcgttcgccggcagagacctcgaggagcgcccgaggctggtgaccgccggcaaggcgatcgcccggaagctgaacggatcattcttcggagccaagattgtgggaggattgctcagggaccatccggaccccagattctggtgcagggtgctggggagcaacattgggggcctctctctgctgggcgatggccttggttacattgcggatttgtccgagaacctgctgccggatcatgtgagcgttcaccaggtgaccatctccaaggcccccttcgcctcacaggtagagctgccaagatttcaggacctggtgtgtgaacctcgtggcccggggaccggcaccggcttggcggagaacaccagctctgtcagagtgctgctgtgcaagtcggtgatgccgttctacagcacttactacattgcttcttgcactgttggctcaggaaacagtaggtacgagcgcgctatggtttcgtctaatttgttgttggatcatgtgtaaatagcgtcatgtgaaaaacaagcttgtat

SEQ ID NO: 18613 - protein, 534 aa, Panicum virgatum
  misc_feature: Ceres CLONE 1797695
  misc_feature (174)..(478): Pfam Name: NB-ARC Pfam Description: NB-ARC domain
MADAIVSAVIGEAVRRVISLLTGRFGVGHQQSTEDKLRRICRTLVRIHAAVEEARGRQITNDGALRWLSELIDGEYQARYLLDTVGLGRGSRDELEVTNSRDDNQVPAPPPPRDSSTSPFNPAKRVRRVAATAVRRALSRGDPGTDGDEIDRALESLQEASAHLGEFILLLQGCQPIRRPLPTSIFIDGQMFGRHVEKERVINFLLHDGGAGELGVLPVVGAVGAGKTTLVQHACDDDRVRGHFAAILFLNFPCTYAIAASGGAAAAALRSKHVIGDAPRGLSDPLRWIKGNNFQSKRFLIVFEDVDMRGKQRLEELLLKLRRAGAEQGSRVIFTTSNRRVSTLGTVEPVVLKVLPAPEYWFFFKAHAFAGRDLEERPRLVTAGKAIARKLNGSFFGAKIVGGLLRDHPDPRFWCRVLGSNIGGLSLLGDGLGYIADLSENLLPDHVSVHQVTISKAPFASQVELPRFQDLVCEPRGPGTGTGLAENTSSVRVLLCKSVMPFYSTYYIASCTVGSGNSRYERAMVSSNLLLDHV

SEQ ID NO: 18614 - DNA, 1772 bp, Panicum virgatum
  misc_feature: Ceres CLONE 1797697
  misc_feature: Encodes the peptide sequence at SEQ ID NO. 18615
acttggaattcttgtcgcaagtacagcatggtctgctacatgctgtggttgctggcatgctgcctattgctgctcttgtacagcgtcaggctcaggtctggctggagccatggccacgggccgaggagcttcccggtgatcgggtgcctggtcgccttctaccagaaccggttccggctgctggactggtacaccgagctgctggcggcgtcgccgacgcagacgatcgtcgtggaccggctgggcgcgcggcggaccgtggtgaccgcgaacccggtgaacgtggagcacatcctcaagggcaacttcggcaactaccccaaggggaagcccttcaccgacatcctcggcgacctgctcggcacggggatcttcaacgtcgacggcgagctgtgatacgcgcagcggaagctggtgagccacgagttctcggcgcgcgcgctccgggagctggagttcgccgtgctcgaggacgaggcgcgggaccgcctcgtgccggcgctgggcctcgccgcggcgcgcggcgacgccgtcgacatgcaggacctgctccgccgcttctccttcgacgtcatctgccgggtgtctctcggcgttgaccccgggtgcctcgacccagcattgccggcgccaaggcttgccgcggcgttcgacgccgcggccgggatcatcgccaggcgcggcgccgcgcccgtggccgccgtgtggaaggccaagcacgcgctggacctcggctccgagcgccggctgcgcgaggagatcagcgtcatccatgaggccgtcatggacctcatccacacccgcaagaaggagcgggccctcgtcaacggcggcgacgggcggaggagcgacctgctgtcgcggatgatcgaatgcggctacccggacgaggcgatccgcgacatggtgatcagcttcatcatggccggccgcgacacgacgtcgtcggcgctgacgtggttcttctggctgctcacccgccaccgcgacgtcgagcgggaggtcctgcgggagatcgcgggcggcgcgagccacgccgccggcgggcagggcaagatgcgcgtcctccacgcggcgctgtgcgagacgatgcggctgtacccgccggtggcgtgggactcgaagcacgcggcggcgggcgacgtgctgcccgacggcacccgcgtggggtgcggcgaccgcgtcacctacttccagtacggcatggggcggatggagtccatctggggcgccgacgccgctgagttcagcctgcagcgctggctttccctgccggaggacagcgcgccccccgccgccgtcgccggcgtgtcgccgttcaagtatcccgtgttccaggccgggccgcggacgtgcctcggcaaggagatggccttcgtgcagatgaaattcgtggccagcaccgtgctccgccggtttgagctcgtccccgtcgacgagggccgcgtgccggtgttcctgccgctgatgacggcgcacatggccggcgggctaaacgttacggtgaggagcagaggggatcagatcgccgccgcagctgcggcagcaggcagcaaacccgttgctgcagctggaactccccagttgagcactccatctgccagtagttaacccctgattattgtaagtacacaccaattaaaatcaggatcatttagttcacatatacacatttataaattcatgaggattatactattgctgcttacaagtagtgtacactttgtaccatatatgaaagagatacacaacaagcatacaaatttccatcc

SEQ ID NO: 18615 - protein, 357 aa, Panicum virgatum
  misc_feature: Ceres CLONE 1797697
  misc_feature (1)..(323): Pfam Name: p450 Pfam Description: Cytochrome P450
  misc_feature: SWISSPROT Homolog: EC 1.14.15.3 Alkane 1-monooxygenase
MQDLLRRFSFDVICRVSLGVDPGCLDPALPAPRLAAAFDAAAGIIARRGAAPVAAVWKAKHALDLGSERRLREEISVIHEAVMDLIHTRKKERALVNGGDGRRSDLLSRMIECGYPDEAIRDMVISFIMAGRDTTSSALTWFFWLLTRHRDVEREVLREIAGGASHAAGGQGKMRVLHAALCETMRLYPPVAWDSKHAAAGDVLPDGTRVGCGDRVTYFQYGMGRMESIWGADAAEFSLQRWLSLPEDSAPPAAVAGVSPFKYPVFQAGPRTCLGKEMAFVQMKFVASTVLRRFELVPVDEGRVPVFLPLMTAHMAGGLNVTVRSRGDQIAAAAAAAGSKPVAAAGTPQLSTPSASS

SEQ ID NO: 18616 - DNA, 1650 bp, Panicum virgatum
  misc_feature: Ceres CLONE 1797700
  misc_feature: Encodes the peptide sequence at SEQ ID NO. 18617
gacctgcatcacaaatcctactccgccactctcatcgccgccgccaaggcgccaacaagccgcgccacaagaaccaccacgccccgatggagaacggcgccggcaatggggtggccgtggctgcagcggcggcctggaacttcgcgccgaacgaggccctcctgggcctgacggcgctctcggtgcgcggcgtgctgggcagggtgaaggccgggatggtggccgacggcggcggggcccggccggtggtcccgatgggtcacggcgacccgtcggcgttcccgtgcttccgcaccgcgcaggaggccgtggacgccgtcgccggcgcgctccggtcaggggagcacaactcctaccccaccagcgtcggccttgagcccgcacggaggtccatcgcgaagtacttatcccgtgatctgccatatgaattatcaccagatgacatctacctcacaagctgctgtactcgcaattgagataatctgctctgttttttctcgtcctggtgccaacatcttgcttccaaggcctggctacctgttctatgaggcgcgtgctgctttcacggcatggaagctcggtattttgatcttctacctcagaaggattgggaggttgatattgattgcgtccaagctcttgccgacaagaacaccattgccatggtcattgtcaacccaggaaacccttgtggcaatgtctactcctatgagcacctagccgaggttgccgagaccgcgcagaagcttggcatatttgtaatcacagatgaggtgtatgcacacttgacatttggggagaggaaatttgtgcccatgggtgtgtttgggacagtggttcctatgttcacactaggatcgatatcaaagagatgggtggtgcctggatggcgtcttggatggattgttaccaatgatcctaatggtgtatttcagaggactaaggtagttgactgtatcaaaagctaccttgatatctcctctgatcctccaacatttgtccagggagcaattccaaaactcctggagaacacaaaggacgaattcttcagcaaaactgtcgaaattcttagagaaactgcagatatatgctgggagaaactgaaggacatcaattccatcacatgcccgagcaaacctgagggatccatgtttgtaatggtgaaactggacctatcctgcctgcaagacatcaaagatgacatggacttctgctgccggctggcaaaggaagaattagtggttcttctgccaggttgtgctgtgggatacaagaattggctccgaatcacctttgccattgatccatcttctctagaagatggccttgacaggctcaaatccttctgcttgcgacacagcaagccggcaatgtgatatgataagctcatcggttccttgcaacacaagacaaattgttatcaaattctagtgatttattatgatacgccatcatcttcactcggagatgatatctttgatgcgctaggtccttggtaagcaatgggttctgcttttatctagtcatcattgagtgccattacaacagtttgtcgcactcagtgcctgtaggtgaaacacaaattttaggaatctgaagtgtacaacgaataaagaagggactatatgagaattgtcatctgattatagc

SEQ ID NO: 18617 - protein, 129 aa, Panicum virgatum
  misc_feature: Ceres CLONE 1797700
  misc_feature: SWISSPROT Homolog: EC 2.6.1.5 Tyrosine transaminase
MENGAGNGVAVAAAAAWNFAPNEALLGLTALSVRGVLGRVKAGMVADGGGARPVVPMGHGDPSAFPCFRTAQEAVDAVAGALRSGEHNSYPTSVGLEPARRSIAKYLSRDLPYELSPDDIYLTSCCTRN

SEQ ID NO: 18618 - DNA, 822 bp, Panicum virgatum
  misc_feature: Ceres CLONE 1801544
  misc_feature: Encodes the peptide sequence at SEQ ID NO. 18619
acagatatttcccagccatcctcctgccgcggttcgcgttgctacaccacgatccaggaccaggatccaggaagataatcgaggaggagggcggagccatggcgagcgagcacgcggaggcggagccgaagcagaagcagagcctgatggacaaggccaaggagttcgtggcggacaagatcgcgcacatccccaagccggaggcgacgctcgacggcgtctccttcaagagcatgagccgcgagtgcatcaccctgcacagcaacgtcaacgtctccaacccctacgaccaccgcctccccatctgcgaggtcacctacaccctcaagtgcgccggcaaggttgtggcgtccggcaccgtgcccgaccccggctggatcgccgccagcgacaccaccaagctggagatccccgccaaggtgccctacgacttcctcatctcgctcatgaaggacgtgggcagggactgggacatcgactacgagctccaggtcgggctcaccgtcaacctccccatcatcggaaacttcaccatcccgctctccaccagcggcgagttcaagctcccaaccctcaaggacatgttctaataattcatcagattccgtggcgtcgaccatgtaccaccaatgtaactctgtcatcccatccccacggctgtatgaatcctagtgccgtcttgcaaataaaggcagatgctctgtttcagttctaccacatactgctacggcataccagtatcagctgcctgaacatctgtttctgaatgcatgcctaatggttgcaataaagagatagatgcctgaatttcaggtttcagtg

SEQ ID NO: 18619 - protein, 163 aa, Panicum virgatum
  misc_feature: Ceres CLONE 1801544
  misc_feature (14)..(163): Pfam Name: LEA_2 Pfam Description: Late embryogenesis abundant protein
MASEHAEAEPKQKQSLMDKAKEFVADKIAHIPKPEATLDGVSFKSMSRECITLHSNVNVSNPYDHRLPICEVTYTLKCAGKVVASGTVPDPGWIAASDTTKLEIPAKVPYDFLISLMKDVGRDWDIDYELQVGLTVNLPIIGNFTIPLSTSGEFKLPTLKDMF

SEQ ID NO: 18620 - DNA, 725 bp, Panicum virgatum
  misc_feature: Ceres CLONE 1801553
  misc_feature: Encodes the peptide sequence at SEQ ID NO. 18621
aagtcgcggcctccctcggtttctcccctctcccactggcccccacgccatctccttccaccggccctccctctctgacggaggaagagccaagggacaaaaccctagagttcggcgaggggggaagggcggagctgcggctgctggtgggtggtcgctacatcggatctcgccgccggcgccgcttgaactaggcctttgttctccttccccctgaggtgccgcaatggctgcgaagggcttctcatccaacccggagaaggagcagatgttttggatggcggagaaggagatggagtacagggttgaactcttcaataaacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacatgggaagcactagttgcattttgtagtgtaatttgtcgctctgtttctccattttggttggttttagaatgtggccacctgctgctaagtactccaatacagcatcagtgacttgctaattcatggatcgcgcaaaaggaaatcccaatgtcttgcacttttgagggatgtgccttgtctatgaaccatgacagggaacatgcctgtaataatttgatacagctcgagagaacaattttgttggg

SEQ ID NO: 18621 - protein, 83 aa, Panicum virgatum
  misc_feature: Ceres CLONE 1801553
  misc_feature (14)..(80): Pfam Name: zf-Tim10_DDP Pfam Description: Tim10/DDP family zinc finger
MAAKGFSSNPEKEQMFWMAEKEMEYRVELFNKLTQTCFDKCVEKRYKETELNMGENSCIDRCVSKYWQVSNIVGQMLGNRPQM

SEQ ID NO: 18622 - DNA, 825 bp, Panicum virgatum
  misc_feature: Ceres CLONE 1801556
  misc_feature: Encodes the peptide sequence at SEQ ID NO. 18623
gaaccctagctcctcccgccgccacaccctcacaccagcagccatgccgcccaagctcgacccgtcgcaggtggtggaggtgttcgtccgcgtgaccggcggcgaggtcggtgcggcctcttcccttgcccccaagattggtccgctcggtctctcgcccaagaagatcggtgaggacatcgccaaggagacggccaaggactggaagggcctgcgcgtcaccgtcaagctcaccgtccagaaccggcaggccaaggtctccgtcgtgccctccgccgcggcgctcgtcatcaaggcgctcaaggagcccgagagggaccgcaagaaggtcaagaacatcaagcacagtggcaacatcagcctcgatgacgtcatcgagatcgcccggaccatgagggtcaggtccatggccaaggagatggccggcaccgtcaaggagatcctcggcacctgcgtcagcgtcgggtgcaccgtcgacggcaaggaccccaaggacctccagcaggagatcgacgacggcgacgtcgagatcccgtcagcttaagaaggtttgcagtcgaggaggttgctatgtgaggctgctgaagtagttctttctatctaaatgacacttggacttcaactcttgatgatgaagaaactcctgtcatgctttagtggtcgagactatttttgtcaaagattttatgagcattcacaagcaatattgaagttattaatgtggttagaaatatatgttgtcctgctgagttttgttggaaattttgatatgtttttgaatgttgactatattgctggtttactgattgcctcaatgttttagcg

SEQ ID NO: 18623 - protein, 166 aa, Panicum virgatum
  misc_feature: Ceres CLONE 1801556
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARTMRVRSMAKEMAGTVKEILGTCVSVGCTVDGKDPKDLQQEIDDGDVEIPSA

SEQ ID NO: 18624 - DNA, 772 bp, Panicum virgatum
  misc_feature: Ceres CLONE 1801560
  misc_feature: Encodes the peptide sequence at SEQ ID NO. 18625
atcgacgaggcagcgatggtggggcgaaagccgatgcgccgccgcagaactgatcggcagccgcctccgccgccgccgcagtccttcggcgccacggctcgcccgacctccccacgttcgtccgcctccgccgccgcggtggccgccgacctggacgagctgctgctcacggcgccgccgccgtcggcgtcggagccccggagcttcccgtacgcggtgaagcagcagtgctgggagaaggcggagcgagtgccggggcgcgacccggagaggtggcgccgcgacgcgctcggcaacatcgtcttccgcaagctcgtcggctgccccggctgcctctgccacgactacgaccacatcgtcccctactccaagggcgggaagagcacattggagaattgccaggttttgcaggctacagtgaatcgatctaaaggtaacaagactgaggtatctaaatccgagctcatacagaagagtgcatattgtagggtttcaggacgcgatatggatcttgttgaactctctgcctatggaaatgtccggcgaggaccagattcagggggctgcaaaatccaatgaagttcagagtagatatatctgaggagttgtgttaatcagtttgaagtagttgcctgaatctaaatggagaaagcttgattaatttttctgtcaaacatgttcgatcatgtttgtactatgtagcttgatgcttcaagtgattcatccgagaacagcaattgtgatatctttgaatcaatgattgtctgcattc

SEQ ID NO: 18625 - protein, 187 aa, Panicum virgatum
  misc_feature: Ceres CLONE 1801560
  misc_feature (101)..(143): Pfam Name: HNH Pfam Description: HNH endonuclease
MVGRKPMRRRRTDRQPPPPPPQSFGATARPTSPRSSASAAAVAADLDELLLTAPPPSASEPRSFPYAVKQQCWEKAERVPGRDPERWRRDALGNIVFRKLVGCPGCLCHDYDHIVPYSKGGKSTLENCQVLQATVNRSKGNKTEVSKSELIQKSAYCRVSGRDMDLVELSAYGNVRRGPDSGGCKIQ

SEQ ID NO: 18626 - DNA, 356 bp, Panicum virgatum
  misc_feature: Ceres CLONE 1801575
  misc_feature: Encodes the peptide sequence at SEQ ID NO. 18627
cctcgatcaatctgttgtggagaagaccgtgaggccatgccttgttgagctcagcgaggatcctgatgtggatgtaagatactatgcaaaccaggcactgcaggcgtgcgatcaaatgatggtgtcaagctaactagtctgatatttagtgcttgattgttttagtccaattttggagtacctgtaatctggcctttagattgaagaaaagttccttctagcctcagtaacagattgaaactgccatgctgaaaatggacggtcttgatcccttgttcgttgtgttattaatgttttgtaattgagcaagacacaacacgttattatgtgtgaatgtagattggacttcgctttcg

SEQ ID NO: 18627 - protein, 43 aa, Panicum virgatum
  misc_feature: Ceres CLONE 1801575
  misc_feature (4)..(40): Pfam Name: HEAT Pfam Description: HEAT repeat
LDQSVVEKTVRPCLVELSEDPDVDVRYYANQALQACDQMMVSS

SEQ ID NO: 18628 - DNA, 743 bp, Panicum virgatum
  misc_feature: Ceres CLONE 1801582
  misc_feature: Encodes the peptide sequence at SEQ ID NO. 18629
accccttcgcgttgtgctcttgcgtttccgtgttgagacttgagagagagggagagaggagctgccgtgtggggccggagagtagcgaccgcgagcgagagaaggcgatggcggggatcgggccgatcaggcaggactgggagccggtggtggtgcggaagaaggcgccccccgccgccgccaagaaggatgagaaggccgtcaacgccgcgcgtcgctccggcgccgagatcgataccatgaagaagtacaacgctgggacgaacaaggccgcgtccagcggcacatccttcaacaccaagcggctcgacgacgacactgagaatctagcccatgagcgcgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagataattagcaagcttgagagggcactcggaacaaagctgcgtgggaagaaataactttcaaacttgtgccccgtagcagcatgaagctgaaggagacaaggcagtctgtctgcttattatctatgcttggttttcaatgtcatgcagactgtttctgtgtttggtacatgagtgaataacagtgtcgtggtggaccttgtaatgccttgctgcttttatgtgtcatatgatccctggtaggtaagagttacgctacgttgt

SEQ ID NO: 18629 - protein, 142 aa, Panicum virgatum
  misc_feature: Ceres CLONE 1801582
  misc_feature (9)..(79): Pfam Name: MBF1 Pfam Description: Multiprotein bridging factor 1
  misc_feature (87)..(141): Pfam Name: HTH_3 Pfam Description: Helix-turn-helix
  misc_feature: The sequence is a functional homolog of SEQ ID NO 1 in US patent 7238857
  misc_feature: Functional homolog of the protein sequence given in SEQ ID NO 50189
  misc_feature: Useful for making plants with altered lignin content
  misc_feature: Functional homolog of the protein sequence given in SEQ ID NO 50190
  misc_feature: Useful for making plants with modulated heat sensitivity
MAGIGPIRQDWEPVVVRKKAPPAAAKKDEKAVNAARRSGAEIDTMKKYNAGTNKAASSGTSFNTKRLDDDTENLAHERVPSDLKKNLMQARLDKKMTQAQLAQMINEKPQVIQEYESGKAIPNQQIISKLERALGTKLRGKK

SEQ ID NO: 18630 - DNA, 749 bp, Panicum virgatum
  misc_feature: Ceres CLONE 1801611
  misc_feature: Encodes the peptide sequence at SEQ ID NO. 18631
ctagtctccatccccccacccgccgcccctcaaccctacccagccgccgccgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacctacaccaagcccaagaagatcaagcacaagcataagaaggtgaagctcgccgtcctgcagttctacaaggtcgacgacgccactggcaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctacctatcatgaaattgagctgttggtttctcgagttggatatcatttagatctgtctgaggttgaaacttaaatggagcagtatctattttctcggaacgcctgttactgagctgatatgatgcgagtttaattttggttccattttctatctt

SEQ ID NO: 18631 - protein, 155 aa, Panicum virgatum; identical to SEQ ID NO: 14149
  misc_feature: Ceres CLONE 1801611
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time

SEQ ID NO: 18632 - DNA, 880 bp, Panicum virgatum
  misc_feature: Ceres CLONE 1801622
  misc_feature: Encodes the peptide sequence at SEQ ID NO. 18633
ctctatatgttttgttgcagaatctccctctacctctccacaactcagcccaaatcaatcagtgacatttatatcatattattctctatatgttttcttgcaggatgtgcgtaaaaagttccctaattgcagtccagatatggagccagggcagtgcttcttcccgcgggaagttgcgaaaagcatcaccacaccgatgtttatactcaatcctgcatatgatgtttggcaggtagagcatgtcttgtctccagaaggttctgaccctcaaaatttatggcgaaattgcagaatggatattaccaagtgtagctcaaaacagctggaaattctccaaggttttaggaaagcgctgcttgatgctataaatgaattcaagaatagaagagactggggtatgttcatcgactcgtgctttatacactgccagtcgatgaaagctattacttggcactccccatcaactgctagaatcaacaacaagacggctgctgaagcagtgggagattggttctttgatcggagggaggtgaaggaaatagactgtgaatatccctgcaacccgacttgctacaatacggttcttgatgagccctacaaggaagactgactgtgtttaggagttttgtcgatttattaggcgcaatcgcagttgcaaccgattctccatgaattgatatctgttgggttgaatgtgatcagaattcagacttacttgagacctatttctatatgttaaagccccgaggggcagcgagcggccagacaggtcacgtaggccggaaaaattcgaccgtccgatcgcgatccgatggctatggatgaaagggaatcttgctatttcagtgtactaaataaaatctatttaattttttttttg

SEQ ID NO: 18633 - protein, 202 aa, Panicum virgatum
  misc_feature: Ceres CLONE 1801622
  misc_feature (1)..(180): Pfam Name: PAE Pfam Description: Pectinacetylesterase
  misc_feature: Functional homolog of the protein sequence given in SEQ ID NO 50811
  misc_feature: Useful for making plants with altered cell wall content and/or composition
SICFVAESPSTSPQLSPNQSVTFISYYSLYVFLQDVRKKFPNCSPDMEPGQCFFPREVAKSITTPMFILNPAYDVWQVEHVLSPEGSDPQNLWRNCRMDITKCSSKQLEILQGFRKALLDAINEFKNRRDWGMFIDSCFIHCQSMKAITWHSPSTARINNKTAAEAVGDWFFDRREVKEIDCEYPCNPTCYNTVLDEPYKED

SEQ ID NO: 18634 - DNA, 613 bp, Panicum virgatum
  misc_feature: Ceres CLONE 1801630
  misc_feature: Encodes the peptide sequence at SEQ ID NO. 18635
ccgtgatagcaatagagcccttttcttttctccctccttccatcccaagtctcaacatcttcttcagttcatcaccaaacatatgggtcctcagcaagatcggcgttccatggcggcgaacggcacggcggcgaggaaggagacgaataataaggtggtgcactaccgggagtgccagcgcaaccacgcggcggccatcggcgggtacgccgtggacgggtgccgggagttcatggcgtccggcgcggagggcacggccgcggcgctcatgtgcgccgcctgcgggtgccaccgcagcttccacaggcgcgaggtggagcccgacttggactgctcctccaccacctccgcctgaattgaatctcgagatggatcgatcatgggtggcaaaggcattgaaatgattggtagctgcattatattcaaccgtatatggaatggacatatttattttcttcttcttttcccccttatggccttggatttgcagtgaaacttatgtatgtgttgatggttcgtgtatggtgcttgtaactgacgctatgtatatagtcaaagtgctttacttgctgttggcgtatagaaatgaacacctttgttatattttgtagat

SEQ ID NO: 18635 - protein, 90 aa, Panicum virgatum
  misc_feature: Ceres CLONE 1801630
  misc_feature (23)..(82): Pfam Name: ZF-HD_dimer Pfam Description: ZF-HD protein dimerisation region
  misc_feature: Functional homolog of the protein sequence given in SEQ ID NO 50409
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 50410
  misc_feature: Useful for making plants with modulated low light sensitivity
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 106 in the 10/714,887 US patent application
  misc_feature: The sequence is a functional homolog of SEQ ID NO 106 in the 11/435,388 US patent application
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 64 in the 10/714,887 US patent application
  misc_feature: The sequence is a functional homolog of SEQ ID NO 64 in the 11/435,388 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 104 in the 10/714,887 US patent application
  misc_feature: The sequence is a functional homolog of SEQ ID NO 104 in the 11/435,388 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 1554 in the 10/666,642 US patent application
  misc_feature: The sequence is a functional homolog of SEQ ID NO 44 in the 10/714,887 US patent application
  misc_feature: The sequence is a functional homolog of SEQ ID NO 44 in the 11/435,388 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 102 in the 10/714,887 US patent application
  misc_feature: The sequence is a functional homolog of SEQ ID NO 102 in the 11/435,388 US patent application
  misc_feature: The sequence is a functional homolog of SEQ ID NO 48 in the 10/714,887 US patent application
  misc_feature: The sequence is a functional homolog of SEQ ID NO 48 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: The sequence is a functional homolog of SEQ ID NO 628 in the 10/666,642 US patent application
  misc_feature: The sequence is a functional homolog of SEQ ID NO 68 in the 10/714,887 US patent application
  misc_feature: The sequence is a functional homolog of SEQ ID NO 68 in the 11/435,388 US patent application
  misc_feature: The sequence is a functional homolog of SEQ ID NO 56 in the 10/714,887 US patent application
  misc_feature: The sequence is a functional homolog of SEQ ID NO 56 in the 11/435,388 US patent application
MGPQQDRRSMAANGTAARKETNNKVVHYRECQRNHAAAIGGYAVDGCREFMASGAEGTAAALMCAACGCHRSFHRREVEPDLDCSSTTSA

SEQ ID NO: 18636 - DNA, 355 bp, Panicum virgatum
  misc_feature: Ceres CLONE 1801635
  misc_feature: Encodes the peptide sequence at SEQ ID NO. 18637
aactaatgcttgcaacaactcatccatccatcaccgcatcgtgccatcatcacattgacgcgcaacggttcgctgctcaaaggacagtggcgatagccgtctatgccaccttcctgctgctcgccgcggcggcaaggtccgaggccggattgacctgggggcaggtcaactccggcatcggcccctgcatcacctacgcccgcgggtccggctccggcccctcctcagcctgctgcagcagagtcaggagcctcaactccgccgccagaaccaccgccgacaggcgcgccgcatgcaactgcctcaagtccgccgcaggcagggcgagcggcctcaacgccggcaacgccgccag

SEQ ID NO: 18637 - protein, 116 aa, Panicum virgatum
  misc_feature: Ceres CLONE 1801635
  misc_feature (52)..(115): Pfam Name: Tryp_alpha_amyl Pfam Description: Protease inhibitor/seed storage/LTP family
MLATTHPSITASCHHHIDAQRFAAQRTVAIAVYATFLLLAAAARSEAGLTWGQVNSGIGPCITYARGSGSGPSSACCSRVRSLNSAARTTADRRAACNCLKSAAGRASGLNAGNAA

SEQ ID NO: 18638 - DNA, 310 bp, Panicum virgatum
  misc_feature: Ceres CLONE 1801635-R
accatcagcccatccgtcgactgctccaaggtggcttaatatcgtgatgagttggttggagcctgcatgctgccaagcacatccaccgagatatatatatctaggtatcgtgtatgatcgatggagttctcgctaggtcgtggatgaataaactttgtgggccgtggctgatcatgtgagagacacggcggtatgggacgggtgggttcgtgttaggtgtggggtgggtgggcatgtacacctccattttcgggcccggttcaggacctcgttccgttcctgttaatacataagaccatttttggtattt

SEQ ID NO: 18639 - DNA, 536 bp, Panicum virgatum
  misc_feature: Ceres CLONE 1801640
  misc_feature: Encodes the peptide sequence at SEQ ID NO. 18640
aaaacataccgagagcaacgcgcagtcgcaacaggcctctccgcctctttgctctcgagaagctttcggcacggacgtatggcggcggtgacggccccgacgagggcagaggcgctgtccctcttccggtccctcctccgcacggcgaagcagttctccgactacaacatccgggagtacacgcgccgccgcgccgcggacgccttccgcgagaaccgcgccctccccgacgcggcggccgcggcggcggcgttcgcggaggggaagaagcagctcgaggtcgcgaagcggcaggcggtggtgtactcgctctacgccccaaagtccaagagcgtgatggagttgaaggtgcagtgatggacgagggagagaggtgttgcgcccttttcttctcttcctcgtcgtctcccccctttgcggatttgtgcctttttgtgtgatgatgatgcaactggaactgctctcttatcacgtttgctagatgactatcatgatacagctgctttctgtgcaataaattactaaattttactgcc

SEQ ID NO: 18640 - protein, 92 aa, Panicum virgatum
  misc_feature: Ceres CLONE 1801640
  misc_feature (7)..(71): Pfam Name: Complex1_LYR Pfam Description: Complex 1 protein (LYR family)
MAAVTAPTRAEALSLFRSLLRTAKQFSDYNIREYTRRRAADAFRENRALPDAAAAAAAFAEGKKQLEVAKRQAVVYSLYAPKSKSVMELKVQ

SEQ ID NO: 18641 - DNA, 847 bp, Panicum virgatum
  misc_feature: Ceres CLONE 1801649
  misc_feature: Encodes the peptide sequence at SEQ ID NO. 18642
atcgcgctttgcccccatctccgccccgccgctgcagcgctccgcctccctccccctcgcagccgcaggctagggttctcctctagaggcggcgccatgttggtctaccaggatctgctcaccggcgacgagctgctctcggactcgttcccgtacgaggagatcgagaacggcgtgctctgggaggtcgagggcaagtgggtcgtccaaggagcagtggaggtgaacattggtgccaacccgtctgccgagggtggcgaggaggagggcgtagacgatcaggctgtgaaggttgtggacattgtcgacaccttccgkctacaggaacaacctgccttcgataagaagcagtttgtcacatttattaagcgctacataaaaaacctcacctccaagctggagccggagaaggctgatgagttcaagaagggcattgagggtgccaccaagtaccttcttggcaagttgaaggacctacagttctttgttggcgagagcatgcatgacgatgggagtctcgtgttcgcgtactacaaggaaggagccaccgacccgaccttcctctactttgcgcatggcctgaaggagatcaagtgctaggtgcccctgaccatrcgggtgtyatcgtgttcttaatttgtctggttttgttcgtatmgtgctgagaaacattgtgctgagaaacggttgtcggcttttaccgccaaaagatactcttactttccggatgtgatctgttactccgtgtttctgttaccttccggacgttcgggatgtgatctgttactccgggtttccgttactttctggatgctcgggatgtgatctgttactctgggtttctgtc

SEQ ID NO: 18642 - protein, 167 aa, Panicum virgatum
  misc_feature: Ceres CLONE 1801649
  misc_feature (1)..(164): Pfam Name: TCTP Pfam Description: Translationally controlled tumour protein
MLVYQDLLTGDELLSDSFPYEEIENGVLWEVEGKWVVQGAVEVNIGANPSAEGGEEEGVDDQAVKVVDIVDTFRLQEQPAFDKKQFVTFIKRYIKNLTSKLEPEKADEFKKGIEGATKYLLGKLKDLQFFVGESMHDDGSLVFAYYKEGATDPTFLYFAHGLKEIKC

SEQ ID NO: 18643 - DNA, 858 bp, Panicum virgatum
  misc_feature: Ceres CLONE 1801651
  misc_feature: Encodes the peptide sequence at SEQ ID NO. 18644
agaccccaacgattcctttcttctccggctccgcgtgccaacgaagttaaccgagaaccggagcaagagatcgcgccgcgccgcgcgcaggaggccgccggaaagcggaagagaagggcgcggccgtagagatggacgagatcatgaacaaggtgggcgcctactggctggggcagagggccaacaaggagatctcgtcggccggcgacgacatcgagtcgctctcgaccagcgtcggggagggcgcgaaatggctggtgaacaagctgaaaggcaagatgcagaagccgctgcctgacctgctcaaggagcacggcctgccggtggggctcttcccgcgggaggccaccaactacgagctcgcgccggagacgcggcgcctgacggtgtacatcccgtccaagtgcgaggtcggctaccgcgacggctccgagatgcggttcgacgccacggtgtccggcacgctgggcgagggccggctcacggaggtggaggggatcaagaccaaggtgctcgtctgggccagggtcaccgccgtcaaggccgacgccgccaaggtgcacttcacggccgggatcaagaggtcgcgcgcccgggacgcctacgaggtcgtcaggggcggcatcaccgtcgacgagttctagctctggctgtatgtcagtatgtggcgccgctggacggacgatctcgatcttgctggttttgcacgctgagatgcttgcaggaataaattctacgcttaattagttgtgtgaccgtgtgctttattgtgggacttgtgagttgtgacgcactcacgcacgtactttactgtacagtattaagatttgaatgagaacatagaccacaagcataggc

SEQ ID NO: 18644 - protein, 170 aa, Panicum virgatum
  misc_feature: Ceres CLONE 1801651
  misc_feature: Functional homolog of the protein sequence given in SEQ ID NO 50572
  misc_feature: Useful for making plants with modulated nitrogen use efficiency
MDEIMNKVGAYWLGQRANKEISSAGDDIESLSTSVGEGAKWLVNKLKGKMQKPLPDLLKEHGLPVGLFPREATNYELAPETRRLTVYIPSKCEVGYRDGSEMRFDATVSGTLGEGRLTEVEGIKTKVLVWARVTAVKADAAKVHFTAGIKRSRARDAYEVVRGGITVDEF

SEQ ID NO: 18645 - DNA, 852 bp, Panicum virgatum
  misc_feature: Ceres CLONE 1801654
  misc_feature: Encodes the peptide sequence at SEQ ID NO. 18646
atctcattccgctttgagcttgcttgcagctccagctcccctcgtctcttggtggctacgccatggccaccgtagtcctgatgagctgcagcctccgcgcgccggccagcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtacccgacgacgtgtacatcctggatcaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatataaatataattaaaccctacgtcgtgcgtgctatagctatagctatagctatactatacttaattggtttgcaattcagctatatgcataatgcatgctagctgtggctatttatatctggtttatttgcaattgatcgagctatttttttttgtgttaatgtttcagctccatataaataatgtaatgtttaaatgatatgcttgtctatgaaatattgaaataaaacttaatttgtactgccatatttaattcattcgtcatttcaaatgtctct

SEQ ID NO: 18646 - protein, 149 aa, Panicum virgatum
  misc_feature: Ceres CLONE 1801654
  misc_feature (58)..(133): Pfam Name: Fer2 Pfam Description: 2Fe-2S iron-sulfur cluster binding domain
MATVVLMSCSLRAPASSGLSGVRAAPAPAIVAMPAAKQQVVGRGARLRAQATYNVKLITPDGEVELQVPDDVYILDQAEEEGIDLPYSCRAGSCSSCAGKVVSGSVDQSDQSFLEDDQVAGGWVLTCAAYPTSDVVIETHKEEELTSSS

SEQ ID NO: 18647 - DNA, 825 bp, Panicum virgatum
  misc_feature: Ceres CLONE 1801656
  misc_feature: Encodes the peptide sequence at SEQ ID NO. 18648
tccaagctagctaggaactcaaaatactaacaatggcctccctctcctctgccgccgtcaccgccccttccttcgccgcggctgcccggcccgcccccaggcgctctgctgctttcaccgtgcgcgcctcgctcggcaaggccgccggcaccgccgccgtggccgtggccgccagcgccctgctcgcaggcggcgccgccatggcccaggaggtgctgctgggcgccaacggaggcgtcctcgtcttcgagcccagcgagttcaccgtcaaggccggcgaggccatcaccttcaagaacaacgccgggtacccccacaacgtggtcttcgacgaggacgaggtgcccagcggcgtcgacgctgccaagatctcgcaggaggagtacctcaacgcgcccggcgagacctactccgtcacgctcaccgtgccggggacctacggattctactgsgagccgcaccaaggagccggaatggtcggcaaggtcaccgtcaactgatgcatgctgcgatatatctatcatctgcrcatgcatctactgcgtgctatcaattacagtactacaagtattatgtattcaaacgtatgtacctaccaggaggctaggctagctagctagagagcttattagcttgccttcccctcaagagtcagtgaccatcttgtacctaccaagtggccggaatgcatgcatgctattgcttcwtcatatatcatcggcccaccttccattgcttcttttactcttttttttagctactaataattattaaaaactgttgtatatggattattataagctgtataaaaggttcacaatacac

SEQ ID NO: 18648 - protein, 155 aa, Panicum virgatum
  misc_feature: Ceres CLONE 1801656
  misc_feature (59)..(155): Pfam Name: Copper-bind Pfam Description: Copper binding proteins, plastocyanin/azurin family
  misc_feature: Functional homolog of the protein sequence given in SEQ ID NO 50157
  misc_feature: Useful for making plants with modulated nitrogen use efficiency
  misc_feature (140)..(140): Xaa is any aa, unknown, or other
MASLSSAAVTAPSFAAAARPAPRRSAAFTVRASLGKAAGTAAVAVAASALLAGGAAMAQEVLLGANGGVLVFEPSEFTVKAGEAITFKNNAGYPHNVVFDEDEVPSGVDAAKISQEEYLNAPGETYSVTLTVPGTYGFYXEPHQGAGMVGKVTVN

SEQ ID NO: 18649 - DNA, 613 bp, Panicum virgatum
  misc_feature: Ceres CLONE 1801667
  misc_feature: Encodes the peptide sequence at SEQ ID NO. 18650
caattgctttgtattctgccaggtattcaatgaggtgagctcgagagagatggagaagataaacgtatttgaaggcattctaaacaataacgtgttcattgtggtcctcagcagcaccatcatcttccagttcatcataatacagttccttggcgatttcgcaaacaccacacccctcacattcaaccagtggatcacatgcatcttcattggttttataggcatgcctattgctgctattgtcaagatgatcccagttggttcgtcgtaggaaactagagctaatttgagcgagaaactgaagttgggcgggattatggtctgatcatggcaatggagttttgtgcatcgccattaacgtacaagatagatctttctgccatcatgtttctctttaggtgaatctttgccctttttgtcatgtatttaatcttagagcatgagccaaggttgtgttgtgtgggcttgattcttagaaaatacctcgaactcctgtagctgttctttgatttctcttttttctttttccctggtgcttttccttggaacgttggaggctggagctgtatatggcaaatctattgctcaccagaatgtgattgtttagacacct

SEQ ID NO: 18650 - protein, 89 aa, Panicum virgatum
  misc_feature: Ceres CLONE 1801667
  misc_feature: SWISSPROT Homolog: EC 3.6.3.8 Calcium-transporting ATPase
NCFVFCQVFNEVSSREMEKINVFEGILNNNVFIVVLSSTIIFQFIIIQFLGDFANTTPLTFNQWITCIFIGFIGMPIAAIVKMIPVGSS

SEQ ID NO: 18651 - DNA, 955 bp, Panicum virgatum
  misc_feature: Ceres CLONE 1801668
  misc_feature: Encodes the peptide sequence at SEQ ID NO. 18652
gccccactcccacccctccccatgcactccacagcaacagctaggctacacccaccaaacaccactctggactgatgagcgaggcctagaaggtggaggtggaggtcgcgcaggagcccgaggcggcaccggcgccggccgcggagccggccaaggaggacgtccccgaggagaaggccgtcatccccgccaccgagccgccggccgccgaggagaagccagcagccgactccaaggccctggccatcgtcgagaaggttgcagatgaacctgctgcagagaagcctgcagctgaaaagcaagggagctccaatgacagagatctcgctcttgcaagagtggaaactgagaagagaaactctttgatcaaagcatgggaagagaatgaaaagacaaaagctgagaacaaggcttctaaaaaaatatctgctattctttcatgggagaacacaaagaaagcgaacatagaagctgaactgaagaagattgaggagcaactggaaaagaagaaggctgaatatgctgagaagatgaagaacaagatcgcaatcatccacaaggaagccgaagagaagcgggccatggtcgaagcaaaacgcggcgaggaggtcctgaaggccgaggagatggctgccaagtaccgcgccaccagccacgctcccaaaaaactcattggatgctttggagcctaagaaacatcccgagtcacaccgagcagaaagtgaataacgtcaatccatgattgcttggttctctcgatctatcaagtgtgtattttgtcttcaaaagtgtgaaaagcctaccgttggggtatatacacatattccttgctagtctgtcgtttgatggtgtacttgttgaatgttagacgggcaacattgtcaggtgtccttaagaggtctcaaagttgttaatgttatcattaaatcgaacataaaactgttcttgttttgtc

SEQ ID NO: 18652 - protein, 53 aa, Panicum virgatum
  misc_feature: Ceres CLONE 1801668
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 438 in the 10/666,642 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature: The sequence is a functional homolog of SEQ ID NO 496 in the 11/435,388 US patent application
MKNKIAIIHKEAEEKRAMVEAKRGEEVLKAEEMAAKYRATSHAPKKLIGCFGA

SEQ ID NO: 18653 - DNA, 912 bp, Panicum virgatum
  misc_feature: Ceres CLONE 1801669
  misc_feature: Encodes the peptide sequence at SEQ ID NO. 18654
gctggagctcggctcattgacagctcacggctcagggcctcaggctcatctctgtttctccttcccctttccctttctctctgactatctcctcccttggtcttatccctgacggcggcgactgggcgagcggcggcgcgattcgtcacgtcttcgcccagccctttaccggcgacgagcatccaccagccttttgtgctggtctctgccgtgtcataagacaagatggtttccttcgagatgaatgacctcaacaagattggtcttggcctgacaggctttggaatattcttctcctttctgggaatcattttcttttttgacaaggggctcattgcaatgggcaatattcttttcttgtcaggtctgggcttgacaattggtctgaaatcaactatgcagttcttcaccaagcctaagaattacaagggtacaatctcatttggcgctggatttttcctggtactcattgggtggcctttttttggcatgctcttggaggcatatggctttattgtactcttcagtggattctggccaacactagttgtgttcctgcagaggattcctatcattggctggatatttcaacaaccgtttgtgacatcattcctcgatcgttacagagggaaacgggttccggtctagcatccttgttggtgtatgttactttggtctagcagctgatggttttagccacattagcaaaatgtttatgcaggcgtccggtctttgctgttgtttttccttctatgtttagctcccaataggtttgtccctttgtaaattacagccccaaatggccgaaaccaagctccgtagttttgttgagaccaggatgctgattcacccatgaaatggactggagaaactcttaagcttaccctgtttatttggtggccttgtaacagt

SEQ ID NO: 18654 - protein, 140 aa, Panicum virgatum
  misc_feature: Ceres CLONE 1801669
  misc_feature (30)..(130): Pfam Name: Got1 Pfam Description: Got1-like family
MVSFEMNDLNKIGLGLTGFGIFFSFLGIIFFFDKGLIAMGNILFLSGLGLTIGLKSTMQFFTKPKNYKGTISFGAGFFLVLIGWPFFGMLLEAYGFIVLFSGFWPTLVVFLQRIPIIGWIFQQPFVTSFLDRYRGKRVPV

SEQ ID NO: 18655 - DNA, 690 bp, Panicum virgatum
  misc_feature: Ceres CLONE 1801671
  misc_feature: Encodes the peptide sequence at SEQ ID NO. 18656
gacaagccgtgcccggcagctccgctccacccgtcgccgagaatgtccgacgaggctaggcgcggggccgggggcgccgcgcaggcggcgctccgggcctcctccgaggaccgcaagccggtgggcgcggggtccccgccgccggccgcggcggcggcggcggcgcacaagatccagctcaagagcgccgacatgaaggaggagatgcggcaggaggccttcgaaatcgcccgcatcgcgttcgacaagcacaccatggagaaggacatcgcggagtacatcaagaaggagttcgacaagaaccacggcccaacctggcactgcatcgtcggccgtaacttcggttcgtatgtaacgcatgaaacaaactactttgtatacttctacatcgattctaaagccgtcttgctattcaagtctgggtgattggcacagttattgtgatcacccttgcatgcctgcatcctgttactcttttgtatgtcccccttttctctgagtcgtctgcagccaagctggaagctggtgaggcgataatcttgtgagcctgcatgttgatgtatcagcgacagatttttcctccctattccagcagtgtgggatcagattgtatctgttttgcgtctgctatatctaggtgttgtgaggaccttctcttattgcaatatgattgcctgaaatattggacgc

SEQ ID NO: 18656 - protein, 127 aa, Panicum virgatum
  misc_feature: Ceres CLONE 1801671
  misc_feature (39)..(127): Pfam Name: Dynein_light Pfam Description: Dynein light chain type 1
MSDEARRGAGGAAQAALRASSEDRKPVGAGSPPPAAAAAAAHKIQLKSADMKEEMRQEAFEIARIAFDKHTMEKDIAEYIKKEFDKNHGPTWHCIVGRNFGSYVTHETNYFVYFYIDSKAVLLFKSG

SEQ ID NO: 18657 - DNA, 797 bp, Panicum virgatum
  misc_feature: Ceres CLONE 1801689
  misc_feature: Encodes the peptide sequence at SEQ ID NO. 18658
gtcggccgccatctcccccgcttaggtttagggtcccttccgcctcccatctccggcatcacgagctcgcggaaatggtcgcccacaggttccatcagtaccaggtggtgggtcgcgctctgccgacccccggcgatgagcaccccaagatctaccgtatgaagctctgggccaccaacgaggttcgcgccaagtccaagttctggtacttcctgaggaagctcaagaaggtgaagaagagcaatggccagatgctcgccatcaacgagatctttgagcgcaacccaaccacaatcaagaactatggcatctggctgcgctaccagagcaggacaggttaccataacatgtacaaggagtatcgtgacaccaccctgaatggtgccgtggagcagatgtacaatgagatggcctcccgtcatcgcgtgagggccccctgcatccagatcatcaagacggcgacagtgcacttcaagctgtgcaagagggacaacaccaagcagttccacaactccaagatcaagttcccgcttgtgtaccgcaaggtgaggccacccaccaggaagctcaagaccactttcaaggcatccaggcccaacttgttcatgtgataggtctcagcaggatgttacctatgttatgtgtcttagcgcgcaaaagtggaaagattttgcctgtggaagttttggtgccctgtgtattgagcactcccatgtttccagttatgaatttgaatgatgctctgcaaacccctgatttcggtcaaattaactatcagcagactgcttatttactcc

SEQ ID NO: 18658 - protein, 178 aa, Panicum virgatum
  misc_feature: Ceres CLONE 1801689
  misc_feature (5)..(178): Pfam Name: Ribosomal_L18ae Pfam Description: Ribosomal L18ae protein family
MVAHRFHQYQVVGRALPTPGDEHPKIYRMKLWATNEVRAKSKFWYFLRKLKKVKKSNGQMLAINEIFERNPTTIKNYGIWLRYQSRTGYHNMYKEYRDTTLNGAVEQMYNEMASRHRVRAPCIQIIKTATVHFKLCKRDNTKQFHNSKIKFPLVYRKVRPPTRKLKTTFKASRPNLFM

SEQ ID NO: 18659 - DNA, 735 bp, Panicum virgatum
  misc_feature: Ceres CLONE 1801696
  misc_feature: Encodes the peptide sequence at SEQ ID NO. 18660
atcttctcagtagtacactcgctagctagctaagctgctatataaattaaattaaagctagcagcgcgcggcaagtagtactgatcgatcggcatcgccggccggagatcgacatgacgatgatgaagaagcagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatctgtatctatacatacatacatacatatatacgctcgctcgatcgatcttagtcgtctacgtgtggcttgctgctgttcatccagccgctcgctacgtgtgtgtgtagacacacacacacacgacggataaataaaagatgcatgggttgcctccgggccgctccctatatagctactttgttgtgtactactagtatcaatcaatcctactttctgatgtcttcactacatgtgaaaagctgataatcttatagctgtacctactccatgtaataattttgttgcattatc

SEQ ID NO: 18660 - protein, 94 aa, Panicum virgatum; identical to SEQ ID NO: 12072
  misc_feature: Ceres CLONE 1801696
  misc_feature (29)..(94): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass

SEQ ID NO: 18661 - DNA, 443 bp, Panicum virgatum
  misc_feature: Ceres CLONE 1801698
  misc_feature: Encodes the peptide sequence at SEQ ID NO. 18662
gtgctctctcagaggtgggttggcttctccccctcttacctagtcctcggttctagggttttagttggaaggggagatggcggcggcggatgtggagtaccgctgcttcctcggcggcctcgcctgggccaccgaccacgcgtccctccagcaggccttcgcctcctacggcgacgtcctcgactcccaggtcctccccgaccgtgagacggggaggtcccgcgggttcggcttcgtcaccttctcagccgagcagtccatgctcgacgccatccaagccatgaacggccacgagctcgaccgccgcaacatcaccgaccaccagcccccatcccgctgcgggggcggcggcgacagccccggtggtggccgcggcggtccccgcccaggctgccctggccctgctggtgctgctgccgctcctccccctgatgctcctcgcc

SEQ ID NO: 18662 - protein, 122 aa, Panicum virgatum
  misc_feature: Ceres CLONE 1801698
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAAADVEYRCFLGGLAWATDHASLQQAFASYGDVLDSQVLPDRETGRSRGFGFVTFSAEQSMLDAIQAMNGHELDRRNITDHQPPSRCGGGGDSPGGGRGGPRPGCPGPAGAAAAPPPDAPR

SEQ ID NO: 18663 - DNA, 636 bp, Panicum virgatum
  misc_feature: Ceres CLONE 1801700
  misc_feature: Encodes the peptide sequence at SEQ ID NO. 18664
agatgcgcaaacaccggatcgccggactcgtggctgccctgctcgccctctccctctcgtccctccgcaccgcgcaagaggagccgcccatggcggacagcgggcctctggcgggcggcgtcacggacgtgccgcagaacaaaaacsacatccacctacaggagctcgcccgcttcgccgtygacgagcacaacaagaaggccaatgctctcctgtggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagsgsttaaggatatytcgtcttccacgtgcaattgctacctgaagcactaaacagacttgcagaataaggagctggttcggatgtataatagatgtgctgttgcgagctccgttgtgtagtatcataagatcaccttgccctttgtgtaatatcatgaataacggggtcctttgtgtaaaatcatgaattcagtgccctttatgtgtaacattataaataaataacagggctgagtattcatcagc

SEQ ID NO: 18664 - protein, 131 aa, Panicum virgatum
  misc_feature: Ceres CLONE 1801700
  misc_feature (38)..(126): Pfam Name: Cystatin Pfam Description: Cystatin domain
  misc_feature (49)..(49): Xaa is any aa, unknown, or other
  misc_feature (130)..(130): Xaa is any aa, unknown, or other
  misc_feature (131)..(131): Xaa is any aa, unknown, or other
MRKHRIAGLVAALLALSLSSLRTAQEEPPMADSGPLAGGVTDVPQNKNXIHLQELARFAVDEHNKKANALLWFEKLVKAKTQVVAGTMYYLTVEVKDGEAKKLYEAKVWEKPWENFKELQEFKPVEESAXX

SEQ ID NO: 18665 - DNA, 940 bp, Panicum virgatum
  misc_feature: Ceres CLONE 1801712
  misc_feature: Encodes the peptide sequence at SEQ ID NO. 18666
agtagcaattctctggttggttgttctctgctgctgctgtgtgtgtgtctgcgaagaaacgaggagagggagagatggcttgccctgcgcagtacatgctctcggccagcggctgcatcttcctggggagcagcaagcctcaggcgagccttgtccgaggcgccgtcatcggcggcgttagcggcagcaggccgttcctgctcacctgcagcgcctcgtcgtctccgtctccttccacgccggcgcaggaggactccgactgcaacgaggaggagtgcgccccggagaaggaggtcgggagcctgagcgccgagtggctggcggaggagcggaccagggtcgtcggaaccttcccgcccaggaagagagggtggaccggcctcgtcgagaaggacaccgccggccagaccaacatctactccgtcgagccgacggtgtacgtggcggagagcgccgtcagctccggcacggcgggcacgtcggcggagggggccgagaacacggccgccatcgcggcggggctggtcctcatcaccgtcgccgcggcctcgtccatcctcatccaggtgagcaagaagcagccgcaggtgcccgaggccgcctacagcggcccgccgctcagctactacgtcgccaagttccagcccgcggcggaggcgccggcgccggcggagcccctcgaggcccccgcccccgcggaggcggcggtcgtcgcccaggacagccccgccgtcgaggcagccgccccggaggcgctggaagcagagcagctgtcctcgtgagctgatgttgtagtcaagattcagctttgtggctgcttacagatgagcttgtagtgcacgatggtgggagataatacacatggtaatcgtgagcatttgctaattgtaaaagttgcgtgtgtatatacaatgcattcagcatgcctatatgcttatat

SEQ ID NO: 18666 - protein, 235 aa, Panicum virgatum
  misc_feature: Ceres CLONE 1801712
  misc_feature: Functional homolog of the protein sequence given in SEQ ID NO 50253
  misc_feature: Useful for making plants with modulated flowering time
MACPAQYMLSASGCIFLGSSKPQASLVRGAVIGGVSGSRPFLLTCSASSSPSPSTPAQEDSDCNEEECAPEKEVGSLSAEWLAEERTRVVGTFPPRKRGWTGLVEKDTAGQTNIYSVEPTVYVAESAVSSGTAGTSAEGAENTAAIAAGLVLITVAAASSILIQVSKKQPQVPEAAYSGPPLSYYVAKFQPAAEAPAPAEPLEAPAPAEAAVVAQDSPAVEAAAPEALEAEQLSS

SEQ ID NO: 18667 - DNA, 633 bp, Panicum virgatum
  misc_feature: Ceres CLONE 1801729
  misc_feature: Encodes the peptide sequence at SEQ ID NO. 18668
accttccagttctctgaaattcacaggcgcaagcgcaacgtcttcctcctcgcgacctcgcccgtccagcaacgagcccgggaccgggagggactagcaagccgcccatggcgctagagaaggccaaggagatcgtcccctcctcccccgtcgtcgtcttcagcaaaacttattgtcctttctgcacccgagtaaagcaactgctagcacaactgggggcgaattacaaggctgttgaattggatgtggaaagtgatggatctgatttgcaatcagctctcgctgaatggactgggcagaggactgttccaaatgtcttcgttaaaggagagcgtatcggtggctgtgatgcgaccatggcaatgcacaacggtgggaagttggtgcctctgctgacggaggctggagcagttagtgcccccggcactgcaactccgtctctgtagacagcattctgctcgtttggtggttacatgcaaatgttgtgctactaatgtggttgttgtaaaataaagataaatgaggtgtttcatcgacctgaattacctcttgatgttgactgtaactgtagctttgggtggctatcaagcctctccttaaatcttcagacaccaataaatcatctgtcctggc

SEQ ID NO: 18668 - protein, 112 aa, Panicum virgatum
  misc_feature: Ceres CLONE 1801729
  misc_feature (15)..(77): Pfam Name: Glutaredoxin Pfam Description: Glutaredoxin
  misc_feature: SWISSPROT Homolog: EC 1.11.1.15 Peroxiredoxin
  misc_feature: Functional homolog of the protein sequence given in SEQ ID NO 50111
  misc_feature: Useful for biocontainment applications
MALEKAKEIVPSSPVVVFSKTYCPFCTRVKQLLAQLGANYKAVELDVESDGSDLQSALAEWTGQRTVPNVFVKGERIGGCDATMAMHNGGKLVPLLTEAGAVSAPGTATPSL

SEQ ID NO: 18669 - DNA, 750 bp, Panicum virgatum
  misc_feature: Ceres CLONE 1801732
  misc_feature: Encodes the peptide sequence at SEQ ID NO. 18670
atcccatcgacccgacgccgcgccgcacccctcttctgcgccctttcctctccgttggcggcgaagaggttttctccaaaccggcgaggggagaggaactagccaatgaattcggtccctccaacccaacgagaagatgccgcggatccctctgatcaagttccccaagcggaatctcaaagccccatccccatccgcaccagcagcatcgcagcccgcggaccagcacgcgaccctcatgtcccgcttgggggctaaagtagaggcaccatcttctggagagattaaaaattaccgttttagatctgatgtgccatccccaccttctcatactgctgttggaggtccagcttcactccttcctaagcgcaaaccattgactgaacaagagattgaggccatcatgcttggtggctccatctgatatggcctcgcatggattggaaacgtaggaggtatcaataagatcatatacccaaacttgccttgactggaaggggtgttattcaagccatgttgatatggaatttgtttttttttttgtttctatgtctgggagtcagctgctgtgccattcgtttctaatattctccggtcttcacatgtgacttgaccaaatcgtgagcaggcatgttgatatggagtccggtttttgtttctctgcctggaagccagctgttgcgatatcaggccctaatattcttcacatgtgactgaccgaatccgtgggcgtattgaacttggttgccg

SEQ ID NO: 18670 - protein, 61 aa, Panicum virgatum
  misc_feature: Ceres CLONE 1801732
  misc_feature: Functional homolog of the protein sequence given in SEQ ID NO 50812
  misc_feature: Useful for making plants with modulated heat sensitivity
MSRLGAKVEAPSSGEIKNYRFRSDVPSPPSHTAVGGPASLLPKRKPLTEQEIEAIMLGGSI

SEQ ID NO: 18671 - DNA, 932 bp, Panicum virgatum
  misc_feature: Ceres CLONE 1801735
  misc_feature: Encodes the peptide sequence at SEQ ID NO. 18672
gcaacaagccacagctcaacttcttcagcgaggagcagctgagatcgagatgacgaccagcggcatgggcgccgccgtcctcgctctcctcgtcgccggcggcctcgccgcggccgccgccgcgaggccctcccacgccggcgccatcatccgtctccccaccagcggcggcgaccggccgtgggagtgctgcgacttcgtcgtgcgggacccggacttccggccgccgcggtggcagtgcaacgacgtgtcggccgagtgccccgcggcctgcagccggtgcgaggcggcgccgggcgacggcggcggctacgtgtgccgcgactgggtcgtgagcctgctcgagccgcccgtgtgcacgccgaggccgtgggactgctgcgacgccgccgtctgcacccgggcgtacatccccgactgccgctgcgccgacgaggtggaggcgtgcccgtgcaactgcagcgagtgcgagctggcgggggcggacccgccccgctaccgctgcctcgacctgttccacggataccccgggcccaagtgcacgccgttccttgattccatgggcaactagcccagatcacgtacgtccacaaataaataaaattagctagctagcgtacaagctactgtagcaagtgattgttcatccgacgtggacaattagctaccctgctcgctagctgctactgtatttcgtgcaactcaataagtgacgtggccaagtagacctcagtcccaagtgcagatcagagtggagatagatatgatcaaccgaccacagtactacactaccactgcacgttgatccattgtgcaagtacgtactccctgcgtccatgcgacaccgtgttgtgggccgggaacgatgtgggctgtctactcgtgcattttagatgtactccagatgtgtgttgggctgaaccgattttctc

SEQ ID NO: 18672 - protein, 173 aa, Panicum virgatum
  misc_feature: Ceres CLONE 1801735
  misc_feature (110)..(134): Pfam Name: Bowman-Birk_leg Pfam Description: Bowman-Birk serine protease inhibitor family
  misc_feature (136)..(160): Pfam Name: Bowman-Birk_leg Pfam Description: Bowman-Birk serine protease inhibitor family
MTTSGMGAAVLALLVAGGLAAAAAARPSHAGAIIRLPTSGGDRPWECCDFVVRDPDFRPPRWQCNDVSAECPAACSRCEAAPGDGGGYVCRDWVVSLLEPPVCTPRPWDCCDAAVCTRAYIPDCRCADEVEACPCNCSECELAGADPPRYRCLDLFHGYPGPKCTPFLDSMGN

SEQ ID NO: 18673 - DNA, 933 bp, Panicum virgatum
  misc_feature: Ceres CLONE 1801755
  misc_feature: Encodes the peptide sequence at SEQ ID NO. 18674
gcggcactgctccttcccggcgctgcttatctccccgctccctccttccagcgcgtcgccatgaacacagccatggccaccgcttccttatccctcaaaggccgcccttgccagggcgcggccaagaacctctcctccccgctcctcggcgcccccgcctccttcctccggccgctggcgcccgcgcccagcgccgccccctcgcggcggacgctcgccgtcagggccatggcgccgcccaagccgggaggcaagccgaagaaagtggtgggcatgataaagctggccctggaggccggcaaggcgacgccggcgccgcccgtcggcccggcgcttggtgccaagggtgtgaacatcatggcgttctgcaaggaatacaatgccaagacggccgagaaggccggctacatcatccccgtcgagatcaccgtcttcgatgacaagagctttactttcgtcttgaagacaccaccagcctccgttctgctccttaaggctgcaggtgtcgaaaagggttcaaaagagccacagcgagaaaaggttggcaaagtaacagcagatcaagtccgtgcgatagctcaagagaagttgccggacttgaactgcaagagcatcgactctgctatgaggatcattgctggcactgccgctaacatgggcattgatgttgaccctccaatccttcagaagaaggaaaaagtcctcttgtagtttgttttgctggcacccacagatcaaattatcaatcgctttctgtagattctgccttcctttttgttcgtcaattcgcagtgccaacttgaagttttcctctggtgtccgtaaccttgttcactaatccagtcatttggtgtagacctgtaattttttcttgccaagtccttcgatataccacatctgaaaggaaagggctattccaagcctttgcgcacc

SEQ ID NO: 18674 - protein, 212 aa, Panicum virgatum
  misc_feature: Ceres CLONE 1801755
  misc_feature (131)..(199): Pfam Name: Ribosomal_L11 Pfam Description: Ribosomal protein L11, RNA binding domain
  misc_feature (68)..(126): Pfam Name: Ribosomal_L11_N Pfam Description: Ribosomal protein L11, N-terminal domain
MATASLSLKGRPCQGAAKNLSSPLLGAPASFLRPLAPAPSAAPSRRTLAVRAMAPPKPGGKPKKVVGMIKLALEAGKATPAPPVGPALGAKGVNIMAFCKEYNAKTAEKAGYIIPVEITVFDDKSFTFVLKTPPASVLLLKAAGVEKGSKEPQREKVGKVTADQVRAIAQEKLPDLNCKSIDSAMRIIAGTAANMGIDVDPPILQKKEKVLL

SEQ ID NO: 18675 - DNA, 605 bp, Panicum virgatum
  misc_feature: Ceres CLONE 1801765-R
  misc_feature: Encodes the peptide sequence at SEQ ID NO. 18676
atccgttctagttctgaggggttacagttacaggagtgggttgatgagcattgctgtgcaccttatcgtgcccttgaattatgggactgcccaagccatgttgatattgatgagaggacagacatatggtttttaggatgcaccctttacgcaatcatgtttaatgtttcaccatttgagtatgctgttggtgaatctggaggaagtttgcaacttgctattgtcaatgggcagttgaagtggccagcaggacccaaccctccttatcctgatgagcttcgtcagtttgttatgtggatgcttcagcttcaacctgcgatgcgccctcacattggtgatgtatttcttcatgttaacaagctcatcgcaaaatacttgtcgtaatccagcttttgccattgtgtttcatttttttgttacacaaagtgaacagtgtaaaatgggttcatgattgacatcattcaagcgttagataagtgcaatattgattctttgtagaactttctgattgttattgacatccatgttaatgttttactcagttatcatgtacaaatatgtcaagtgaacatctgaagttggtatagaatatatgtaatagcatc

SEQ ID NO: 18676 - protein, 127 aa, Panicum virgatum
  misc_feature: Ceres CLONE 1801765-R
  misc_feature: SWISSPROT Homolog: EC 2.7.11.1 Non-specific serine/threonine protein kinase
IRSSSEGLQLQEWVDEHCCAPYRALELWDCPSHVDIDERTDIWFLGCTLYAIMFNVSPFEYAVGESGGSLQLAIVNGQLKWPAGPNPPYPDELRQFVMWMLQLQPAMRPHIGDVFLHVNKLIAKYLS

SEQ ID NO: 18677 - DNA, 358 bp, Panicum virgatum
  misc_feature: Ceres CLONE 1801765
ccatgttcgctgaatgtccgcaccgtaatggcctcatgttacatcagagggtaatggttctacagctccacctggattgaaggcttttgaggctcaactagccatgaacaaaacaggatcagcccttactgaatcagggatcattggagccatgactcgcacctgctctctcccgtccaactggatggtactttattcgacaacgccaacctcatgctgccgacaaaggaattctattcaacacctgacctcctgaaaatattccatcagatgtctgacccactgaagcacatgcgcatctttcatcctccatatgctcataatgatgtgaagcccggtaactttcttattacccgtc

SEQ ID NO: 18678 - DNA, 852 bp, Panicum virgatum
  misc_feature: Ceres CLONE 1801770
  misc_feature: Encodes the peptide sequence at SEQ ID NO. 18679
aactataaagcgctccccgctgcgccgccgccgcctccgagaggagaaaccctaccccgcgcagccgccgcccgtcgccgccgccgccgccgcttcgtcgaactccggcgcgtgcccgagcctcgccagtcgctgccaccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggcgggtgaactgaccccagatgagcttgagcgcctcatgactgtggttgccaacccccgccagttcaaggtccctaactggttcctcaacaggaagaaggattacaaggatggtaggttctcccaggtcgtttctaacgctctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgtcgatgcgccttgtattggcttggcctagtttgtgtcgagtatgcggacctttgtgctgtgttttgctggaggatatgtttatctctaggatagatggtgagctgtttgggttcatgaatacttgtagcgactcctttggtgcctatgttcgaagcacggattgaatttcagtgttctgtgaaaaacaatgaagttttgcctgtttggaaaaagcatcctatgtccttccgtgggtcttttcggc

SEQ ID NO: 18679 - protein, 152 aa, Panicum virgatum
  misc_feature: Ceres CLONE 1801770
  misc_feature (14)..(142): Pfam Name: Ribosomal_S13 Pfam Description: Ribosomal protein S13/S18
MSLIAGEDFQHILRLLNTNVDGKQKIMFALTSIKGVGRRFSNIVCKKADIDMNKRAGELTPDELERLMTVVANPRQFKVPNWFLNRKKDYKDGRFSQVVSNALDMKLRDDLERLKKIRNHRGLRHYWGLRVRGQHTKTTGRRGKTVGVSKKR

SEQ ID NO: 18680 - DNA, 671 bp, Panicum virgatum
  misc_feature: Ceres CLONE 1801772
  misc_feature: Encodes the peptide sequence at SEQ ID NO. 18681
acgcgcttcgttcctcctcgtccctcggctcggcctcgcctcctctccgtctccctgcagagagagcgcagcaaggcaagaggggggataggaggaggaagagagcaggagatggcaggctgcgagggagccaagtcaccggcctcccaggaggaagaggcatgtgttgagaagaagtacggaggaattgcgcccaagaagcctttgatatccaaggaccacgagcgcgcgtacttcgattcagcagactgggtgctcggcaagcaagctgcaaatagcagcacaagggctgctgtcgagtctctgaagcccaagctgaagagaacgcctcaccaccagctcccccctcgcaagccgacctgcgcttccagctgagacgcacgtgcagcagctggagggagtgctcggaggcaagaaagggagaatgaatgattgagctcggataaatgcttggcagccgaaatcgtagggatggatcacaagcccgaggtgcaatctggttagtacttgtcaattgcagcctctactatgtctatcatcagaacggattaattatcggcatcatgcttaagttagatggtacttggtggttgaactgaaagttttctcctttttgaagaaaaaaaaacatttgtccattacccacgggctatcaatcaccgtcgttctag

SEQ ID NO: 18681 - protein, 87 aa, Panicum virgatum
  misc_feature: Ceres CLONE 1801772
  misc_feature (20)..(87): Pfam Name: Lg106 Pfam Description: Lg106-like protein
  misc_feature: Functional homolog of the protein sequence given in SEQ ID NO 50181
  misc_feature: Useful for biocontainment applications
MAGCEGAKSPASQEEEACVEKKYGGIAPKKPLISKDHERAYFDSADWVLGKQAANSSTRAAVESLKPKLKRTPHHQLPPRKPTCASS

SEQ ID NO: 18682 - DNA, 916 bp, Panicum virgatum
  misc_feature: Ceres CLONE 1801785
  misc_feature: Encodes the peptide sequence at SEQ ID NO. 18683
ccaaaaccttgtttgtcatcaactttgacccaatcaacacaagaattcgagatctggagaggcactttgataaatatggcagggttgcgaatgtgagaatcaaaaagaactttgcatttgtccagttcgaggtacaggaggatgctactagagcattggagggtactaatggaagccatttcatggacagggtcatctcagttgaatatgcacttcgtgatgatgatgaaagaggtgaaagagggaacggatacagcccagacaggagaggtcgtgaaagatccccaggcagaaagcgatctccaagtccttacggcagaggacgggagaggggtagccctgactatggaagaggacgggagagggggagcccggactatgacaggggaggtgacaggcgtagccctgataatggctcaaatggtggtggcagaggtggcgacaggggcagccccaactatgacaacgagcgccgtgaagctagtcctcgtcgcgagcgccatgaagctagtcctcgtcgcgagcgccgtgaagctagccctcgtcgcgagcgccgtgaagccagccctcgtcgcgaacgccgtgaatccagtcatggctatgacaggccccccagcagctcgcctggaagggatgagagagattaagttctccatgcctgtgttcaagccacccgctttggctgaatgtgtgaactgatgttatgttgaagttggtaatgttgggcaccaggaaacttttgtaccatctgtgttagcttgtattgaacgggcgatgttagctaatatttcccgtttctctatgaagcaactccagaatgtaactcatgtattgactggtagctttcagtgttcagttgaaccatcttgttggcagtatttctgtttttatcgtgatgttgctgctgaacgtctct

SEQ ID NO: 18683 - protein, 214 aa, Panicum virgatum
  misc_feature: Ceres CLONE 1801785
  misc_feature (3)..(67): Pfam Name: RRM_1 Pfam Description: RNA recognition motif. (a.k.a. RRM, RBD, or RNP domain)
  misc_feature: Functional homolog of the protein sequence given in SEQ ID NO 50813
  misc_feature: Useful for making plants with modulated biomass
KTLFVINFDPINTRIRDLERHFDKYGRVANVRIKKNFAFVQFEVQEDATRALEGTNGSHFMDRVISVEYALRDDDERGERGNGYSPDRRGRERSPGRKRSPSPYGRGRERGSPDYGRGRERGSPDYDRGGDRRSPDNGSNGGGRGGDRGSPNYDNERREASPRRERHEASPRRERREASPRRERREASPRRERRESSHGYDRPPSSSPGRDERD

SEQ ID NO: 18684 - DNA, 1037 bp, Panicum virgatum
  misc_feature: Ceres CLONE 1801789
  misc_feature: Encodes the peptide sequence at SEQ ID NO. 18685
aagcaggtccactgcagcaagggaacctagcaggcaggaactgatccaagctgtgatccggcatggcgagctcagcggcgatgtcgagggtcctgctgaccctcgggctggcaatcctctgcgccgccggcctggcagccgcgcagaacgtgggcagcgtcgtcaccgactccttcttcaacggcatcaagaaccaggccgggggcgggtgcgagggcaaggacttctacacgcggagcgcgttcctgagcgccgtcaactcgtactcgggcttcgcacacggcggctccgagacccagggcaagcgcgagatcgctgccttcttcgcgcacgtcacgcacgagaccggatgtgagtcaacaacagattagctcgcattgtttgttatgatccttttgatgcatcgtttctttgcctgacaacgtgaaacagctttctgctacatcagcgagatcaagaaggacgacagctactgcaaagcgagcaagacggagtggccgtgcgcggcggggaagaagtactacgggcgcggcccgctgcagatctcgtggaactacaactacggccccgccgggagggacatcggcttcgacgggctggggaacccggacgcgttggcgcaggaccccgtgatcgcgttcaagacggcgctctggttctggatgaacaacgtgcacggggtgatctcccaggggttcggcgccaccaccagggctatcaacggcgactgcgagtgcgacggcaagaaccccgacaagatgaacgcgagggtgggctactacaagcagtactgccagcagctcggcgtcgaccccgggagcaacctcacctgctagagctgctgcttggtttcatggtcatcatggatgcctgctttgctcgtgaagagtgaaggatcctcggcgtcgcatacatgaaatggcaccgggagtgaaacccagagtttatgcactagtagttgcaaaaaaaaacacgggtcggcttgtgtacctaataataataaaaaagaagcactgcgcggcgagcacttggcaagt

SEQ ID NO: 18685 - protein, 102 aa, Panicum virgatum
  misc_feature: Ceres CLONE 1801789
  misc_feature (33)..(102): Pfam Name: Glyco_hydro_19 Pfam Description: Chitinase class I
  misc_feature: SWISSPROT Homolog: EC 3.2.1.14 Chitinase
  misc_feature: The sequence is a functional homolog of SEQ ID NO 12 in US patent 7087810
MASSAAMSRVLLTLGLAILCAAGLAAAQNVGSVVTDSFFNGIKNQAGGGCEGKDFYTRSAFLSAVNSYSGFAHGGSETQGKREIAAFFAHVTHETGCESTTD

SEQ ID NO: 18686 - DNA, 939 bp, Panicum virgatum
  misc_feature: Ceres CLONE 1801790
  misc_feature: Encodes the peptide sequence at SEQ ID NO. 18687
atcacctttcatcgaaacacaacaagttgagtcaagtagcggcactagctagctagctagcaatggccacacccaccgatgatcccaccatggagacctgtggcgacgtctccgagtccgacccaaccatggagaccatcggcgtcctctccgatgtccccatggtgagcagaaaccactacataggcgtcgcctccgccaatttcagggtccctggaccgccaaggatccctatacgtataaagcgaggaccatggggtggaaatggaggcacccatagggaaatggaaggcaaatcacaacgtctagaaagtttaacaatctaccatcatggcgtagttgaagggtttcaattttcctacattgatgaagacgggcaaatccgcaccgctggtccttggggtcaaaatcgtaacttgttcattcaccaaataatgtttggcccatcagagtatgtgaaggagatctctgggcatggtcacaaagcaaacacgtcctatctgtgtcaattgaagatcgtcaccaactacgctgagtatggtccttttggagactggaccggcattccattcagatttactgtgccagagaatgagaccgtggtgggcttctttggaagctatgacacatctttcgtcacaaagattggtgcttacatcatctctaaaattttttgctagtattcgaccctgctccagcctgcagctacctgcatgttcctttcaatcatcagagtgtttgatttcctcccgtttccactgttccagcaataagatggctagctaacaagggtgttccccttgtctatgcctgtttgcatgttgtgatcttttagtcaaatcgatcgtgtaacatctttccctttttttcctttgcaatgttcaatgatgtaattttcagagattgttttcgtcagaataaaacatatcaatgcatgat

SEQ ID NO: 18687 - protein, 196 aa, Panicum virgatum
  misc_feature: Ceres CLONE 1801790
  misc_feature (61)..(192): Pfam Name: Jacalin Pfam Description: Jacalin-like lectin domain
METCGDVSESDPTMETIGVLSDVPMVSRNHYIGVASANFRVPGPPRIPIRIKRGPWGGNGGTHREMEGKSQRLESLTIYHHGVVEGFQFSYIDEDGQIRTAGPWGQNRNLFIHQIMFGPSEYVKEISGHGHKANTSYLCQLKIVTNYAEYGPFGDWTGIPFRFTVPENETVVGFFGSYDTSFVTKIGAYIISKIFC

SEQ ID NO: 18688 - DNA, 923 bp, Panicum virgatum
  misc_feature: Ceres CLONE 1801791
  misc_feature: Encodes the peptide sequence at SEQ ID NO. 18689
agggacgcgatcgtcccagaaccaaaccgccggtcccgaacccgcatcagcagcagcagcgcgagcgagagaatgaagcaaagcatggcgcgccggagcagcaggttgctcgtcctcgtcgccggcgccgccgcgctgctcgccgtcgccgcggcggtcgcggtgccgccgacgtgcgagcgcatcgagtgcccggcgtacgaggtggtggacagcgccaatgggttcgagatccggcggtacacggacgccatgtgggtctccaccgccgccatcgaggacatctccttcgtcgccgccacgcgcaccggcttcctccagctgttcaagtacatccagggcaagaacgcgtacaacgagacgatcgagatgacggcgccggtgctgacggaggtgtcgcccagcgacgggcccttctgcgcctcctccttcgtggtcagcttctacgtgccggccaagaaccaggcggacccgccgccggccgagggcctgcgcgtgcggcgctgggccggggccaggttcgccgccgtgcgccggttcgggggcttcgtggcggacgccgacgtcggcgagcaggccgcgcggctcgacgccagcctgcaggggacaaggtgggccgccgccgtcaacgagggccaggcggggtcgtaggtcgtggcgcagtacaactcgccgtttgagttcagtggcagggtcaacgagatatggatgctcttcgacggcgccaaggtcggctctcacgtcaactaatccgcgctttgtatatgtatctacaagatagtacaagtgctcctgctcgattcaataatctatctcttttcttgatgagagaaacaggtagtgtaatagtgtatcttgtcagatgcagcagatgaataatgtgagctataaaagatgctcaagtaaatacactggtttggcct

SEQ ID NO: 18689 - protein, 188 aa, Panicum virgatum
  misc_feature: Ceres CLONE 1801791
  misc_feature (33)..(186): Pfam Name: SOUL Pfam Description: SOUL heme-binding protein
MARRSSRLLVLVAGAAALLAVAAAVAVPPTCERIECPAYEVVDSANGFEIRRYTDAMWVSTAAIEDISFVAATRTGFLQLFKYIQGKNAYNETIEMTAPVLTEVSPSDGPFCASSFVVSFYVPAKNQADPPPAEGLRVRRWAGARFAAVRRFGGFVADADVGEQAARLDASLQGTRWAAAVNEGQAGS

SEQ ID NO: 18690 - DNA, 788 bp, Panicum virgatum
  misc_feature: Ceres CLONE 1801801
  misc_feature: Encodes the peptide sequence at SEQ ID NO. 18691
aaccacagctccgccgcttccgctctcggcttcgtctgcacgctaccccgcctcgccaccgcttctccctcgccccagcatggccgccgcgtcgtccgccacctccgtccacgacttcaccgtcaaggatgcgagcgggaaggacgttgacctcagcacctacaagggcaaggttctcctcatcgtcaacgttgcatcccagtgtggattaactaactccaactacaccgagttggcccagctctatgagaagtacaaggaccaaggctttgagatcctcgcttttccatgcaaccagtttggtgggcaggagcctggcaccaatgaggaaattgtccaatttgcctgcacacgcttcaaggctgagtaccccatctttgacaaggttgacgtcaacggtagcaatgccacacccctctacaagttcctgaagtctagcaagggtggcctgttcggtgacagcatcaagtggaacttctccaagttcttggttgacaaggaggggcgcgttgtggatcgctacgctccgaccacttcccctctgagcattgagaaggacatcaagaagctgcttgggagctcttaaaccatctgtctagaacctgtagcgcaaaactgtattcatctgagcgctaaaatttacaataatattgtatcaataaagaagctgcttgggagctcttaaaccatctgtctagaacctgtagcgcaaaactgtattcatctgagcgctaaaatttacaataatattgtatcaataaagtagtgctccgctgcagtgcccgctc

SEQ ID NO: 18691 - protein, 168 aa, Panicum virgatum
  misc_feature: Ceres CLONE 1801801
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50171
  misc_feature: Useful for making plants with modulated nitrogen use efficiency
  misc_feature: Functional homolog of the protein sequence given in SEQ ID NO 50170
  misc_feature: Useful for making plants with modulated flowering time
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGSNATPLYKFLKSSKGGLFGDSIKWNFSKFLVDKEGRVVDRYAPTTSPLSIEKDIKKLLGSS

SEQ ID NO: 18692 - DNA, 787 bp, Panicum virgatum
  misc_feature: Ceres CLONE 1801811
  misc_feature: Encodes the peptide sequence at SEQ ID NO. 18693
cttttgcttatcggtctcggaattggagcaactcctttcatcagcatactgaaggatatgttgaacaacctaaaatccaatgaagaggtggaaagcatccacggctctgagataggcagcttcaagaataatggtccaggaagagcttatttctactgggttactagggagcaaggatcattcgaatggttcaaaggagtcatgaatgatgttgccgaaagcgatcacagtaatgttatagagatgcacaattgcctaaccagcgtctatgaagaaggcgacgcaaggtcagctctgattgccatggtgcagtcacttcagcatgcaaaaaatggcgtggacattgtttccggcagcaggattcggacacattttgcaaggccaaactggagaaaagtattctctgatttggccaatgcccacaagaactctcgcataggtgttttctactgtggatctccaacactcacaaaacaactcaaggaactttcaaaggaattcagccagacaaccacgactaggttccatttccacaaggaaaacttctaagaccacatataccagaagacacttgtataggaaagattacaatagcattggtatagcagacttagctttacaagttttgttgtacgccggggtacaaaatatgggttgaaagcatgtaagcatcacacatagattctgaaatgcacacagatttctatattcgagaagtgaaactacttgtttcctagaatttctgggttcctgatggtgcgccttgaacacgcaaattttctctttc

SEQ ID NO: 18693 - protein, 182 aa, Panicum virgatum
  misc_feature: Ceres CLONE 1801811
  misc_feature (1)..(165): Pfam Name: NAD_binding_6 Pfam Description: Ferric reductase NAD binding domain
  misc_feature: SWISSPROT Homolog: EC 1.6.3.1 NAD(P)H oxidase
LLLIGLGIGATPFISILKDMLNNLKSNEEVESIHGSEIGSFKNNGPGRAYFYWVTREQGSFEWFKGVMNDVAESDHSNVIEMHNCLTSVYEEGDARSALIAMVQSLQHAKNGVDIVSGSRIRTHFARPNWRKVFSDLANAHKNSRIGVFYCGSPTLTKQLKELSKEFSQTTTTRFHFHKENF

SEQ ID NO: 18694 - DNA, 397 bp, Panicum virgatum
  misc_feature: Ceres CLONE 1801821
  misc_feature: Encodes the peptide sequence at SEQ ID NO. 18695
gcagcctttattccccagcacaccacccgctccgctccggcgcttccacttccccatctctctcgctcgctctctgcgctcgccacgccatggctcccgccacggcaaccgccgcgttcactagcctcctccccgccggcgcctcgcggctcccctcggccgccgccgccgccggagcggcggcctccttcgtgcggctcccgccgcacccgacgggctgggctggcgcctcccacgcggcgccacggacggcgagcaggcggtcgcccggggacacctaccccaccgccccgaccgaaaaaagcctccacgactacacccatcacgacatagacggaatagatgtccctcttcagaccgtcaaaaacaaggaggtgctgaatgttaacgccgccta

SEQ ID NO: 18695 - protein, 102 aa, Panicum virgatum
  misc_feature: Ceres CLONE 1801821
  misc_feature: SWISSPROT Homolog: EC 1.11.1.12 Phospholipid-hydroperoxide glutathione peroxidase
MAPATATAAFTSLLPAGASRLPSAAAAAGAAASFVRLPPHPTGWAGASHAAPRTASRRSPGDTYPTAPTEKSLHDYTHHDIDGIDVPLQTVKNKEVLNVNAA

SEQ ID NO: 18696 - DNA, 651 bp, Panicum virgatum
  misc_feature: Ceres CLONE 1801827
  misc_feature: Encodes the peptide sequence at SEQ ID NO. 18697
agtacaagaagcacaagaaaaaacacttgtagccatcaacttcttcttcttcttcttcttcaccgtcatcaactcatcatcagctcagaccgtgagtggaatcccttgccttaatttttttacagtttctttgtacacatatatagctacatgtttttgactgcaaataaagcatcgatcgatccgcagctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaatcagggttagaaatatcggccgcaatttcacgatatacccgatatatcgggtttatcggtggggtctgatatttttttttatcggccgaaattgatttaatgaatatttttt

SEQ ID NO: 18697 - protein, 74 aa, Panicum virgatum
  misc_feature: Ceres CLONE 1801827
  misc_feature (15)..(74): Pfam Name: potato_inhibit Pfam Description: Potato inhibitor I family
MSSSAEAADQCGGGKTSWPEVVGMSIEEAKKVILKDKPDADIHVLPVGTPVTRDFRPNRVRIFVGTVAQTPHVG

SEQ ID NO: 18698 - DNA, 931 bp, Panicum virgatum
  misc_feature: Ceres CLONE 1801860
  misc_feature: Encodes the peptide sequence at SEQ ID NO. 18699
aaccccaagagcctcctctccggtccctccaccagtctcctcctcctcctcctcctctgctttgcctgccaagggcggctcggtccccgacacaaatcgcattcctcgagcgccaaccggtaggcataggcatggccggcgcgcagtcgtggaggccgttcctgtgctgcgtcggcggcagcgcggcggtggaggacgacgactcggcgccgcggcggcggcggcggatcgggggcaaggacagcccgcgctcgtcgtcgcgcaagtccttctcgagcctcggctcgtcggagacgctgtccccggaggacctctcgctcacgctctccggctccgacctgcacgccttcacgcgcgccgagctccgcgccgccacgggcggcttctcccgcgccaactacctcggctgcggcggcttcggccccgtctaccggggcgccgtcgccgagggcctccgcccgggcctgcgcgcgcaggacgtcgccgtcaagtacctcgacctcgaaggcggcacgcaggggcacaaggagtggctggccgaggtgttcttcctcgggcagctgcggcacaagaacctggtgaagctcatcggctactgctacgaggcggagcaccggatgctggtgtacgagttcatgagctccgggagcctggagaaccacctcttcaaaagtgagcactttctccgcctcacgccgctaaatttgcaccccgtcgcgtgctgattaatccggtcgttcttgagcccagcaagcaaagaaattccccaatttgaaaaaaaaagagcgcatgcaaggcaccgatagtctttgttgtcccctgcctccagtctctgtttccttttgtgtgaagtcatagggctaggtgaactgtaatgtgccttccagaggaacgccatttttttttatgagaaaggaacaccgatttcttc

SEQ ID NO: 18699 - protein, 197 aa, Panicum virgatum
  misc_feature: Ceres CLONE 1801860
  misc_feature: SWISSPROT Homolog: EC 2.7.11.1 Non-specific serine/threonine protein kinase
MAGAQSWRPFLCCVGGSAAVEDDDSAPRRRRRIGGKDSPRSSSRKSFSSLGSSETLSPEDLSLTLSGSDLHAFTRAELRAATGGFSRANYLGCGGFGPVYRGAVAEGLRPGLRAQDVAVKYLDLEGGTQGHKEWLAEVFFLGQLRHKNLVKLIGYCYEAEHRMLVYEFMSSGSLENHLFKSEHFLRLTPLNLHPVAC

SEQ ID NO: 18700 - DNA, 634 bp, Panicum virgatum
  misc_feature: Ceres CLONE 1801868
  misc_feature: Encodes the peptide sequence at SEQ ID NO. 18701
tgctttccgtcgcttttccccagcgcgcacggagattgcagtcgcgccgtccaacgccgttagccgcgccgccgctgacttttcccctgcgcacgcgcgcaatccgtgccctggaagctggaaccctagcccacttcccctcgtctggttaattgaagcccaatctatccggctatcccgagcccatccgtgcctctatcccacacctctctcccacctataaaaaccctagcggcctccgatccacgggtttcgcccgccgccgccgccgccgccgccatgccgtcccacaagaccttccggatcaagaagaagctggccaagaagcagcgccagaaccgccccatcccctactggatccgcatgcgcactgacaacaccatcaggtacaacgcgaagcgcaggcactggcgccgcaccaagctcggattctgagcgggggaagagatgccgggcaccgatgcttggggaaactggggcttacgagccagcctctggacgcttccatgtttccccatgctatgaagctcttgtttagattttgcttgtgttaaatttatcttatccgttgttcctgtagcactgagaatgccatgttttgctgatggttgaagaacatcttttataattatgc

SEQ ID NO: 18701 - protein, 51 aa, Panicum virgatum; identical to SEQ ID NO: 9830
  misc_feature: Ceres CLONE 1801868
  misc_feature (9)..(51): Pfam Name: Ribosomal_L39 Pfam Description: Ribosomal L39 protein

SEQ ID NO: 18702 - DNA, 808 bp, Panicum virgatum
  misc_feature: Ceres CLONE 1801886
  misc_feature: Encodes the peptide sequence at SEQ ID NO. 18703
accagcgcatcgcattccaatcccatttcccccttgagcaaaaaagaggcagccagagagagcatcaccatgtcgggcatcatccacaagatcgaggagaccctccacatggggggcgaccacaagaaggaggaggagcacaagaaggcggaggcgcacaagaaggccgaggagcaccacaagaaggacggggagcacaaggagggcatcgtcgagaagatcaaggacaagatcaccggcgagcacggcgacaagtccggcgagcacaaggacgacaaggaccacaaggagaagaaggacaagaagaagaagaaggagaagaagcacggcgagggccaccacgacggccacagcagcagcagcagcgacagcgactgatcgcctcgccgcgcgccgtgcttgccggtgaaaaaggtgcttggagaggactatctaccggaagctgtgtgatgtaatgtttcatgagtgccatgtgtgtgtgtgtgtgctaatcaagggagaaatgcaaaaaaaaaaaatcctttatgttggtgaatgtactcctaatgatggctccatggtgctagcttgtaataaaatgttaatgcagtaattggtctgctagcttgtgtctttaccatgtattcacgtgtatgttcttgctctcaagggggccaggttggggaattaggatcgagggggtccacttttttattttttgggttgatgtgccatgctgcccatgcatgtgactccactccctagatctagctagctgttgcacattggatatctctgttcaattcagaattacagagtttctctttcc

SEQ ID NO: 18703 - protein, 102 aa, Panicum virgatum
  misc_feature: Ceres CLONE 1801886
  misc_feature (2)..(102): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDKDHKEKKDKKKKKEKKHGEGHHDGHSSSSSDSD

SEQ ID NO: 18704 - DNA, 774 bp, Panicum virgatum
  misc_feature: Ceres CLONE 1801896
  misc_feature: Encodes the peptide sequence at SEQ ID NO. 18705
aaccacctcgctatcggcacctcgattcgtcctcagcatcatcttgtacttctccggcctgcgccacagccgtcgagctcttctactcctggttctccgtccatggagctggccgcctccacgtccgcctccgtctgctccgcgtacaaccacctctcggccgccggcggtgacagcggagaccaggcggcggcatcaacgcagcaccagcagcttgcgcggcggcagaggaagcacggcggcggccgcggctgcgcggggctccggcggcggtgctacgcggtgctgaagcagcagcggacgcggctctacatcctccggcgctgcgtcaccatgctcctgtgctggcacgagcacgacgacctctccgactgagcacggccgccgcggtccgtgcttgttagagagcttggctctatctacgcggggcgggccaggttttccatgctcgatttgtataggaacccagagagagatgcgcgcctgtactactactacaagattttaaatagctggttatacttccgctatagcttccgctatagcttctagaaagggcggccattatggcatttagcccgctaaatttcggctatagtccactaaacaccgtaatggcagctctaccgctaaacgtcttaaccggcgatttaaaaccttgactactacactgccagcctgtgaaatatgatcaaacgctggtggattttcggtctgaatttggcgtgtattcgagcaacaatgcttgtgattcgacgaaactgcaatttattt

SEQ ID NO: 18705 - protein, 90 aa, Panicum virgatum
  misc_feature: Ceres CLONE 1801896
  misc_feature (63)..(81): Pfam Name: DVL Pfam Description: DVL family
MELAASTSASVCSAYNHLSAAGGDSGDQAAASTQHQQLARRQRKHGGGRGCAGLRRRCYAVLKQQRTRLYILRRCVTMLLCWHEHDDLSD

SEQ ID NO: 18706 - DNA, 584 bp, Panicum virgatum
  misc_feature: Ceres CLONE 1801898-R
  misc_feature: Encodes the peptide sequence at SEQ ID NO. 18707
gtcgcaggtgtcgcaggtgttagagaagtcggtgcagtaggtcatgcgctttagcctctacaagatccccgtcgctgtgcgccaggtcggtgagatggtcatccgatgagccctcgccgagttcgaggtctgcaccatgggtaacatctgccctgacaccagcggtgaggccgacgggctcgtcccttcccttaagtcggggggcagttttgagggagatcccggggacgcgaagattgagaagatgctcaacggcctgtccatcatcaagaagttagagtagccaggtggggggccatttgccacagtcttgctttattaccatggccctgcccttggttcccggaatccgtcagttcctcaggcaagcccttccttgtcacatcaggatccatgttaatgatcatcaatgattcatgtttgtaactttgaacaaaaagcctccaggctgttgaattagagagctcaagagaggaccttagaacatgaggttgctttccctgttactttggacgtctcataaaagtagcagtgatacatctattagtgggggtatgaacatgaagtctaaaagggaacattcc

SEQ ID NO: 18707 - protein, 48 aa, Panicum virgatum
  misc_feature: Ceres CLONE 1801898-R
  misc_feature: Functional homolog of the protein sequence given in SEQ ID NO 50814
  misc_feature: Useful for making plants with modulated drought sensitivity
MGNICPDTSGEADGLVPSLKSGGSFEGDPGDAKIEKMLNGLSIIKKLE

SEQ ID NO: 18708 - DNA, 519 bp, Panicum virgatum
  misc_feature: Ceres CLONE 1801898
attcgagtccagtcccatcgcatcttacccattcctactccggcgatctcgctccggtcggaagcagcaggatgtccggagaggaggaggagaacgccggctagctcccgatcggagaaggttcgctctccctctcttcctgctctccccactatcccccctctggcggcttgggtttcgccgctcttccgtctcaccggacggcgtgttgctttatcatggccgtcggggtgctaacgaaattagccggctgccggggtgaagcagagttcctcatggccaagtgcctgatgaactgagaggtgaccttcttcctgcagtacaagtactattagatgcagcagcacgcgtcggactcggaccccgctgctgatgtgtcccatgtgttcgagaggtccctgctgtaggtctagcgcttcaatggctacaataactccgacgacgtgcgatacgtcttctagacactcacccgctactgactcgcgaagttcaagctctgctctgtcggcttcctctgcc

SEQ ID NO: 18709 - DNA, 916 bp, Panicum virgatum
  misc_feature: Ceres CLONE 1801911
  misc_feature: Encodes the peptide sequence at SEQ ID NO. 18710
accaccctagcacatcggccaggcaagcaggcggccatggcggcggcgaacgcgggggatgttgaggtggtcgacttcgactccgatgacgacgacctcatggacgacgacgcccccgaggccaacccggccccggccgcccctcgcctccgctccaccatcgccgccggcgggaactccgccgccgccgtgcgcaagaccaagggccgcggattccgcgaggagccttcctcctcgcgccccctagccggccgcgccgatttcgattctctcggctccgacgacggccctggacccctcagatctattgaggggtggattattttggtaaccggcgtccatgaagaagcacaggaggatgatctacataatgctttccgggaatttgggcaggtcaagaacttgcacttgaatttagatcgtcgtactggatttgtcaaaggatatgctttgattgaatatgagagctttgacgaagcccaggctgcaataaaagcaatggacggaactgaacttgttacacagataataaatgttgactgggcatttagtagtggcccagtcaagcgaagaaatgttcgcaggagatcaaggagccctgccaggaggagatactgagcttgccttctccaccatgtcataaggagggcttgtgtgatgaaacctgagcttgctttctctacattgtcataaagagagcttgcgtgatgaaaattatctgttttccaggttttgcgcttcccgatttcgtgagtttagtttgacgcatgatggtttgcttttgttttccaactactatgtagcatgactgttgtatctcatttcctgtttcctattattttggtatacgtgggtgtttgtacaaacatgccatgagtattgtgcctcggattgtaattgcgatctaagttaccct

SEQ ID NO: 18710 - protein, 193 aa, Panicum virgatum
  misc_feature: Ceres CLONE 1801911
  misc_feature (96)..(167): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAANAGDVEVVDFDSDDDDLMDDDAPEANPAPAAPRLRSTIAAGGNSAAAVRKTKGRGFREEPSSSRPLAGRADFDSLGSDDGPGPLRSIEGWIILVTGVHEEAQEDDLHNAFREFGQVKNLHLNLDRRTGFVKGYALIEYESFDEAQAAIKAMDGTELVTQIINVDWAFSSGPVKRRNVRRRSRSPARRRY

SEQ ID NO: 18711 - DNA, 789 bp, Panicum virgatum
  misc_feature: Ceres CLONE 1801935
  misc_feature: Encodes the peptide sequence at SEQ ID NO. 18712
ctgtcctctgcctcctcctttcctctccacctcctctccagtgtagggctccgacgagatggccgccccgctccggcggagcctcccctccctcggccgcgcgctcctctctccggcgccggtgaggatgctctccgcggaggcctccgacgccctggtcgagatcaagccgggggagatcgggatggtctccggcatccctgaggagcacctccgccgtaaggttgtaatttattcacctgctaggactgcatcccagcaaggttcaggcaaagtcgggaggtggaaaattaactttttgtcaacccaaaagtgggagaacccgttgatggggtggacatctactggggatccatatgctaatgttggtgaagccggacttacattcgacactgcggagtcagcaaaggcattcgctgaaaaacatggatggaattatgtggttcggaaacgccatacacctcttttgaagcccaaggcttacgcggagaacttcaagtggagaggtcccccgaagccggagcaagcttgagctctagacctctagtctgtgagcctgacattcagacgatgttgttttcctcctggactgcttttgctttcatcagtatccgttgtgaagtaagagcgagtacatgcctcgattaaacctgtaataagcatgagctacaatcaaacaaaatacatatcactccaaaatgtttgttcaaggacgtctttgtatttcaatcccgtgtggttgcctggttggtcacattggaaagaagacaacatgccatttatgtgtcg

SEQ ID NO: 18712 - protein, 157 aa, Panicum virgatum
  misc_feature: Ceres CLONE 1801935
  misc_feature (54)..(156): Pfam Name: ETC_C1_NDUFA4 Pfam Description: ETC complex I subunit conserved region
MAAPLRRSLPSLGRALLSPAPVRMLSAEASDALVEIKPGEIGMVSGIPEEHLRRKVVIYSPARTASQQGSGKVGRWKINFLSTQKWENPLMGWTSTGDPYANVGEAGLTFDTAESAKAFAEKHGWNYVVRKRHTPLLKPKAYAENFKWRGPPKPEQA

SEQ ID NO: 18713 - DNA, 513 bp, Panicum virgatum
  misc_feature: Ceres CLONE 1801936
  misc_feature: Encodes the peptide sequence at SEQ ID NO. 18714
cccagtcgcaccaccccccaccaggccagagctcgcgcgcgcacacgcatacacaccgtgcccctcggcgtcgccagagcagagtctgtgcttcgagctactagcaagtcatcaagccctctcggcctctcacggtcccgatggctccccgcgccgtcgtcgccgccgccgtgctgctcctcgccgcggccgtgctcgtcgcctccgcgtcggcgcaggagttcactgcggcgccgtcgtccgagcccgcgcccgcgccggtcgccggggcggcgtctgctccggccgtggcgtcgtccgcgctagtggccctgctcgtggccgcgctgatgcgataggatcgtgctttctctttcagatttgagcgggcggctccttgagagtcgtatcgtgcgaggccttgatgctattcgttattcttttctgtaccacacatatatagttgtactatgtaaactctgtgccttacatatgtacgaataaagttggatgaccttgtcgtccccttcgacg

SEQ ID NO: 18714 - protein, 65 aa, Panicum virgatum
  misc_feature: Ceres CLONE 1801936
  misc_feature: Functional homolog of the protein sequence given in SEQ ID NO 50208
  misc_feature: Useful for making plants with altered carbohydrate content
MAPRAVVAAAVLLLAAAVLVASASAQEFTAAPSSEPAPAPVAGAASAPAVASSALVALLVAALMR

SEQ ID NO: 18715 - DNA, 729 bp, Panicum virgatum
  misc_feature: Ceres CLONE 1801937
  misc_feature: Encodes the peptide sequence at SEQ ID NO. 18716
agctcaccaagccaagctcagtagcacccaccactcgcacgaagaacacgccctagctaggaagagaagagagggagggatcgaagatgagcgtggagattctggacgggagcacggtccggagcttcgtggaggacgagggcgccttcaactcctccgtcgacggccgcttcgccgcgctggacgccgaccgcgacggcctgctcacgtacgcggagatggccggggagctcatgagcctccgggtccttgagaagcacttcggcgtggacgaggcagcggtgccggccgacgagctcgccgcgctgtaccgcggcctgttcgcgcggttcgacagggacggcagcggcaaggtggaccgccacgagttccgcgcggagatgagggaggtgctgctcgccgtggccaacgggctcggcttcctccccgtgcagatggtcgtcgaggaaggcagcttcctcaagatcgccgtcgacagggagctcggccagatcgccaaggctgcgtaaagctcgatcgcatgcatggaccactacttgctcgattggagtaatatagattactgaattttcaagtgtcatagttgcaatttcgtcatcgatttacacggttacgacgaacttatgtagtatgcttcctgtcctttttattacctgaagggatagataaagacatcacacatgtaattgcaagagtaatttattgaaagagagctgctctgattatttc

SEQ ID NO: 18716 - protein, 140 aa, Panicum virgatum
  misc_feature: Ceres CLONE 1801937
  misc_feature (74)..(102): Pfam Name: efhand Pfam Description: EF hand
MSVEILDGSTVRSFVEDEGAFNSSVDGRFAALDADRDGLLTYAEMAGELMSLRVLEKHFGVDEAAVPADELAALYRGLFARFDRDGSGKVDRHEFRAEMREVLLAVANGLGFLPVQMVVEEGSFLKIAVDRELGQIAKAA

SEQ ID NO: 18717 - DNA, 1034 bp, Panicum virgatum
  misc_feature: Ceres CLONE 1801946
  misc_feature: Encodes the peptide sequence at SEQ ID NO. 18718
aaaaatccccattcgctcccctcctccccactcctcgccgccgcaaatcccacctcgatctgccgccgatcttccccaaaccctcgccgaatcccagatccagcccagccctccagacgctcgcccgccggccgccatggggaaccccgagaagctgatgaaccagatcttcgacctcaagttcacctccaagtcgctgcagcggcaggcgcgcaagtgcgagaaggaggagaaggagcagaagctcaaggtgaagaaggcgatcgagaagggcaacatggacggcgcccgcatctacgccgagaacgccatccgcaagcgcaccgagcacatgaactacctccgcctcgcctcccgcctcgacgccgtcgtggcgcgcctcgacacgcaggccaagatgcaggtcatcggcaagtccatgcagtccatcgtcaagtcgctcgactccgcgctcgccaccgggaacctccagaagatgtccgagaccatggacaacttcgagcgccagttcgtcaacatggaggtccaggccgagttcatggagggcgccatggccggctccacctcgctctccacgcccgagaccgaggtcaacagcctcatgcagcaggtcgccgacgactatggcctcgaggtctccgtcggcctcccgcaggccgcggcgcacgccatccctgctgccaaggataaggagaaggtcgacgaggacgacctctctcgccgccttgctgagctcaaggcccgcggctgagcacctttcaggctttcagctttttcagatgccattcatgctatgctgccgagcggcaattacccagtgtcacgtggactgctactcatatttggtagattcgtaaatactgtgatgcttaagcgtgtgttggcatcgccatgtggggtctgcggacttgatgaaaactttgctgtgtcatattgtactataaaatccgtaattttcgggcttgcaaacattgtggttccccgttgctgtttggccagtccaaatctcgtctgaacaaatattgaaagctgtc

SEQ ID NO: 18718 - protein, 204 aa, Panicum virgatum
  misc_feature: Ceres CLONE 1801946
  misc_feature (9)..(179): Pfam Name: Snf7 Pfam Description: Snf7
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSALATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 18719 - DNA, 844 bp, Panicum virgatum
  misc_feature: Ceres CLONE 1801951
  misc_feature: Encodes the peptide sequence at SEQ ID NO. 18720
acgccattgaacgctccggacctttcttcctccctcctccgacccactctcgcgtccgcgtccatcgcttcccactccttgccttccttaatcccgcccgcgctcgttgccccctccccaccaccgggcttatggcggatcagctcaccgacgaccagatcgccgagttcaaggaggccttcagcctcttcgacaaggacggcgatggttgcatcacaaccaaggagctgggtactgtcatgcgctcactgggccagaatcctacagaagctgagctccaggacatgatcaatgaggttgatgccgatggcaatggcaccatcgattttccagaatttctcaatcttatggctcgcaagatgaaggacactgactcagaggaagagcttaaggaggccttccgtgtgtttgacaaggaccaaaatggcttcatctccgccgctgagctccgccatgtcatgacaaaccttggtgagaagttaactgatgaggaggtggatgagatgatccgtgaggctgatgtcgatggtgatggtcagatcaattatgaggagttcgtcaaggtcatgatggccaagtgagccactgaaccataatctgaaggcggagaagattgtgcattgcatattagtcaagatgcaactcttatttcatcaacttgctgtgaaacattctattagctgtagttgctaaaaggacagtgcaattcctgctatgtttttccctcctgtgtgttttcagatctcttgttttatgtgaacctgtaatgctcgccctgcctggtgtgtactggttgcagttgatcccttatgtagttatatttttgtttcatgaacttctgctt

SEQ ID NO: 18720 - protein, 149 aa, Panicum virgatum; identical to SEQ ID NO: 12456
  misc_feature: Ceres CLONE 1801951
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 18721 - DNA, 909 bp, Panicum virgatum
  misc_feature: Ceres CLONE 1801964
  misc_feature: Encodes the peptide sequence at SEQ ID NO. 18722
aagtccctgatgaggcggcaaaaatagaggtcataagggacaagatctttgagtttggacaaaaagttggccaggttatcatctttgttagaacaaagcaaagcactaagaatgttcacaatgctttgacgagagaggactacgtgtgctcctcaattcaaggatcccttgaccaagcagagagggaaaagattatacaggaattcaaggatgggttcaccaaggttcttatatcaactgatgtgcttgctcgtggttttgaccaagcacaggttaacctggtcatcaactatgacatgccaatcaaatttggtacaagagatgaacctgattatgaggtgtacttgcacagaattggcagagctgggcgctttggccgaaaaggtgctgtgttcaacttgctgtgtggtgaaacagataatgttgtgatgaaaaagattgagaactacttccagcaccaagtacctgaggtgcggaattggaaaaacgaggaagattttgagactgctctcaaggatgcaggtttactatgagtaacctcatcagaaacatggctagctgttgcgctctcccaatcaggacaattcgctggtgattgtttgccgagccagctgcctgctcctcatcatggtgatagctttgtttaggcggccgaaagttctgtatggagttttgtggattatgttaaaagactcgcttatacgcagaagagtttttttttgccgatcacctgtttggtggagtagcgccagttattggctttaccagttgaaactgtaaatcaagttaaacaggaaactgtttctgtcgttgatatgcagcaattttgaggttgttgaacacatgtatacctcaaatgtcacatgtcagtgccccctcaatgtatcgtcggtgtacactttttctttg

SEQ ID NO: 18722 - protein, 176 aa, Panicum virgatum
  misc_feature: Ceres CLONE 1801964
  misc_feature (41)..(125): Pfam Name: Helicase_C Pfam Description: Helicase conserved C-terminal domain
  misc_feature: Functional homolog of the protein sequence given in SEQ ID NO 50815
  misc_feature: Useful for making plants with modulated heat sensitivity
  misc_feature: Functional homolog of the protein sequence given in SEQ ID NO 50816
  misc_feature: Useful for making plants with modulated cold sensitivity
VPDEAAKIEVIRDKIFEFGQKVGQVIIFVRTKQSTKNVHNALTREDYVCSSIQGSLDQAEREKIIQEFKDGFTKVLISTDVLARGFDQAQVNLVINYDMPIKFGTRDEPDYEVYLHRIGRAGRFGRKGAVFNLLCGETDNVVMKKIENYFQHQVPEVRNWKNEEDFETALKDAGLL

SEQ ID NO: 18723 - DNA, 951 bp, Panicum virgatum
  misc_feature: Ceres CLONE 1801976
  misc_feature: Encodes the peptide sequence at SEQ ID NO. 18724
gacaccgggagcgccgatttcactccacgcaacccctgctcttcccccgcccgcgcgccgcagcagttccccagatctccgtccggtctcaggagctccgggccctccccaatggcggtcaaggtctacgtcgtgtactattccacgtatggacatgttggtaaactagctgaagagatcaagaaaggtgcctcgtctgttgaaggtgttgaggctaaaatatggcaggtccctgaaactctccctgaggaagtgcttggaaagatgggcgcgccccctaagcctgacgtgccagttatcacaccgcaagaacttgctgaggctgatggaatcctcttcggattcccaacgaggtttggcatgatggccgcacaaatgaaggcattcttcgacgccactggtggcctgtggagggagcagagccttgctggcaagcccgccggcatcttcttcagcaccggaacccaaggaggtggccaagaaactaccccgttgacagcgattacccagctgactcaccacggcatggtgtttgtgccggtgggttacaccttcggcgccaagctgttcggcatggaccaggttcagggtggcagcccctacggcgcgggcacgttcgccgccgacggctcgaggtggccgagtgaggtggagctggagcacgccttccaccaggggaagtacttcgcaggcatcgcgaagaagctcaaggggtctgcttgatcgctctgccctttggctcatacctcatcaacgatttaaaacatttatttacagctccaccataccgtcaatagcttggtctgttctctctctcgtagtgcctggatgctatgtgcctctgggcacatcctgccgtgtgatatggttttcttgctctggcgacttggttgtaatctggggttgaactgttgtgtttctcgtcccataaatatcgatgattgctcaacc

SEQ ID NO: 18724 - protein, 203 aa, Panicum virgatum
  misc_feature: Ceres CLONE 1801976
  misc_feature (7)..(138): Pfam Name: Flavodoxin_1 Pfam Description: Flavodoxin
MAVKVYVVYYSTYGHVGKLAEEIKKGASSVEGVEAKIWQVPETLPEEVLGKMGAPPKPDVPVITPQELAEADGILFGFPTRFGMMAAQMKAFFDATGGLWREQSLAGKPAGIFFSTGTQGGGQETTPLTAITQLTHHGMVFVPVGYTFGAKLFGMDQVQGGSPYGAGTFAADGSRWPSEVELEHAFHQGKYFAGIAKKLKGSA

SEQ ID NO: 18725 - DNA, 913 bp, Panicum virgatum
  misc_feature: Ceres CLONE 1801977
  misc_feature: Encodes the peptide sequence at SEQ ID NO. 18726
tcggccgcctcccagcgcagccatggccgccacctctacctccccgctattctcgctctcctccctctccgcctcgctcccttcccccacccggctccccaccaccctctcccttcgcaccctctccccacgtgcccgcctctcggcctccctccccttcgcctccccacatggcgtgtacggggcctgggccgcggcgtcgacgtcgtcggcggggaggttgagacggcgggggctggaggtggtgtgcgaggccgcgaccggccggcggcctgactcggtcgcgaagagggagcgccagaacgagaagcaccgcatccgcaaccacgcgcgcaaggctgagatgcgcaccaggatgaagaaggtcttcagagcacttgaaaagcttaggaagaaagttgatgcccagcctgaagaaataattgaaatagagaaaatgatctctgaggcgtacaaagcaatcgacaagacagtgcaagttggtgccctgcacaggaacactgggaaccatcgcaagtccagattggcaaggaggaagaaggccattgagatactccgtggctggtatgttccaaatgccgaacctgttgcctaggattcttgagaaatcattgtcatggattagtggaagcttttcatcaaagctcaccaattttgggcgacatgttattccacggatctcaattgcttgacaagttctctccattcaagtggtctgtttatactttttgtatcatcttctatgtttatgtgcttgctctgtactagaagccgcaactagagtggccagttctcccctgcttctgttattgttcacctcgctgttgtaaaacttcagatcggaaaatttaaaatatagctgtcatctgatctgtccagatttcctcagctggagaaaaatatatcagtacgc

SEQ ID NO: 18726 - protein, 190 aa, Panicum virgatum
  misc_feature: Ceres CLONE 1801977
  misc_feature (82)..(174): Pfam Name: Ribosomal_S20p Pfam Description: Ribosomal protein S20
MAATSTSPLFSLSSLSASLPSPTRLPTTLSLRTLSPRARLSASLPFASPHGVYGAWAAASTSSAGRLRRRGLEVVCEAATGRRPDSVAKRERQNEKHRIRNHARKAEMRTRMKKVFRALEKLRKKVDAQPEEIIEIEKMISEAYKAIDKTVQVGALHRNTGNHRKSRLARRKKAIEILRGWYVPNAEPVA

SEQ ID NO: 18727 - DNA, 843 bp, Panicum virgatum
  misc_feature: Ceres CLONE 1801989
  misc_feature: Encodes the peptide sequence at SEQ ID NO. 18728
aactacccccagtcaagcagccccgccccgcccgggaaccttccagaagcgcaagattccaaggccgtcgccttcccacccgttcctcgccgcgggggtcgcctgagatcacattaacaatggtgaaggctgttgctgtgcttggtaacagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagtgtcgtcgtccccgctgtcaccactcaccactggaccagcctgagcatcctctggatatgtgaaataagagcgcctgatctatgatcggcgtgtttgtgttctcgctcctgtagcacctaccgatgaactgaaacctgtgttggtgtaacgctgtttcacctggacctgtgtttcatacatttcgctttgagaacgcctggaccgatctgtggaaataagaaggcacttgttgcgg

SEQ ID NO: 18728 - protein, 152 aa, Panicum virgatum; identical to SEQ ID NO: 9904
  misc_feature: Ceres CLONE 1801989
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 18729 - DNA, 587 bp, Panicum virgatum
  misc_feature: Ceres CLONE 1801991
  misc_feature: Encodes the peptide sequence at SEQ ID NO. 18730
accccgctcccacttatcttctctgtctgctacattccttcgtatataataaatccatcaactccatccacaatggagagtgttgcccccgcctttgtgttggttctgctagtctctgttccttttttctttctcctactggcgcctgatctcctgtgttcctcccgaccgaagctgcctgctatggccatcccccacatcctctcggtgtgctcgcccctgccgaggactcccccgcacctcaagaagaggaaccccttccagaccgtggacatgaagatgccgatcaactgctaggggtgctagcgcacggcgcgcaaggcgctggagggcatggaaggcgtgagctccttgtaggtggcgccgccgaactccaaggcgaccgtggcctgttacctggacgccggctaggtgatgcggcggctggcgcggcctacgggtaagcgtgtggaggcttggccctacgtgccctacgacctggtgccgcacctctacgcgcccggcgcctacgacaagaacgcgccgtctgggtacgtgcgcaacgtcatcaccgacccctccgcctcgccgctcgcctgcgtctcctc

SEQ ID NO: 18730 - protein, 57 aa, Panicum virgatum
  misc_feature: Ceres CLONE 1801991
  misc_feature: Functional homolog of the protein sequence given in SEQ ID NO 50155
  misc_feature: Useful for biocontainment applications
MRRLARPTGKRVEAWPYVPYDLVPHLYAPGAYDKNAPSGYVRNVITDPSASPLACVS

SEQ ID NO: 18731 - DNA, 604 bp, Panicum virgatum
  misc_feature: Ceres CLONE 1801991-R
  misc_feature: Encodes the peptide sequence at SEQ ID NO. 18732
tgtggtgcgtgcggccgtccacgggcaagtgccccctgaacacggagaagctgatggcgtgggtggaggcgctcaacgggctggtgcacgcggtggtcggggccaaggccagcgagaagtggtgccggctgttgcaaggggtggcggacctggacgccgcgctgtgcctttgctcccccatcaaggtcaaggggatcagcatcaacctggtgcttcccatagccatggaggtgctggtcaaggagtgccacaagaacgtccccgccagcttccagtgcccgtaatcactcactcactcatctctattgcgtatgtatgtatccattaattaattatacatctgcacgcatgcatccatgcatgatgggttaaggttatgataaaccagtcatatactcatatatctatatatatgttaagcatgtacgtatagcttaatgcatgagctttttttggcttgtgatataaatggagctgtggattgtccatttgtttttgtaattgtgtatcaatattgtaacatgaaccagtgtgagagttgtgggcttggaacttgtagtgaccaaaaagatttatatgaataaagcgtgtgtgtcatacatgt

SEQ ID NO: 18732 - protein, 93 aa, Panicum virgatum
  misc_feature: Ceres CLONE 1801991-R
  misc_feature (10)..(92): Pfam Name: Tryp_alpha_amyl Pfam Description: Protease inhibitor/seed storage/LTP family
WCVRPSTGKCPLNTEKLMAWVEALNGLVHAVVGAKASEKWCRLLQGVADLDAALCLCSPIKVKGISINLVLPIAMEVLVKECHKNVPASFQCP

SEQ ID NO: 18733 - DNA, 609 bp, Panicum virgatum
  misc_feature: Ceres CLONE 1802015-R
  misc_feature: Encodes the peptide sequence at SEQ ID NO. 18734
gagctcgtcccaaacaagtagagtaactcgccactgatccttgcaaaagagaagcaaccatgaagccccaggtgctgctcgtcgcggtggccgccctcgccgtcctcgcagctctgcccctcgccgaaagcaaagggcacgggatcggggagcacgcggaggccgcgacggcgagcgcgtggccgtgctgcgacacctgcggctcgtgcaccaggtccatcccgccgcagtgcctgtgcgaggacgaggcgccaggcgggtgccacccggagtgcaggaactgcgtcaagtccaccgacggcggcagcgacgtcttccgctgcgccgaccgcatcaccaacttctgcaagcgccgctgcacgccggccgcgtccgcgtgattggttggacgccgggatcctgctctgctgtcacctgaataataccatgccggcagctgccgatcgattagctccggcctgcctttggtttcagtcttccagtgttccctctgcatcctgctctggatggggagaagagatcagtggtgttgtttttttttctttctaatgtctggtctggactcatggatttcttactgtttgtcgaataaagacccgtgttccacgc

SEQ ID NO: 18734 - protein, 106 aa, Panicum virgatum; identical to SEQ ID NO: 2550
  misc_feature: Ceres CLONE 1802015-R
  misc_feature (43)..(69): Pfam Name: Bowman-Birk_leg Pfam Description: Bowman-Birk serine protease inhibitor family

SEQ ID NO: 18735 - DNA, 618 bp, Panicum virgatum
  misc_feature: Ceres CLONE 1802015
tattcttccgattggcccaggcccaacgattcaacttcgtcccaaacaattaaattacccccccctggttcttggcaaaaaaaaaccaccctggaacccccgggggtggttcgcccggggggcccccttcccctccttcccacttttccccctccccaaaggcaaagggaccggattcgggaagcccccgaaggccccaccggcaagggctgggcctggttccacccctggcggttcgggccccagtcccttccccccccatggccggggcaagaacaagggcccgggcggtggccccccgaatggcagaacttgcttcaggccccccaacgggggcgccacctccttcccttgccccaaccccttcaccactttcggcaaccccccttcccccccggccccttcgcctgattgggtggacccccggattctggttctgttgcaacctaattattccctggccgccgcttgccattcaattactcccggcttgcttttgttttcatccttcagtggttcctcctgcttctggtttggaaggggaaaaaaaattcatggtggttttttttttttctttctatggctgggccggaattcttgatttcctaactgttggcg

SEQ ID NO: 18736 - DNA, 797 bp, Panicum virgatum
  misc_feature: Ceres CLONE 1802019
  misc_feature: Encodes the peptide sequence at SEQ ID NO. 18737
gagagttcgttgttgtcggaaggggagctgagccttggacttggagatggcaagcttcagtgaagagaagagagcagctccgcagagggacgaggcaccttcccggagcaagtacggcggcatttcgccgaagaagcccctgatcagcaaggaccacgagcgcgcctacttcgactcggcagattgggtcctcggcaagcacggcgcgagcagcatcaacggcgcgacggtcccggccgccgagcccctcaagcccaagctgcagcggacggcgtaccaccagctccccccgcgaaggccggcgtgcacgtcggagtagctggcgcgcggctcccctgtcccgtcgcgtcggcggcgtcgctgctgctactgctagctcgtgatgcgcaggcggaacggtgctgtggatgtgaatgtgatgagcgatcactcacactatagggagccaggatccgtggagttggggccaattgggttgtaaatacggggacgcatgctgtcagcctgtcactgctcagcagtgtggagctatctgaaatgaagtgatcggtgcacccggcgtctcgtcttcactcttcagtcttcgttttggtttctgctgcttcttcagtgtaatcgcgtcttcagccttcgccattgtagtagagcttaggctcaggtacgcgcgccgcgggctgccgggctgcctggcctttgctgtcgttttgaatggaactgcggccttttttctatttttatattttttaaaaatattttttacagaaatatatttttggtttcacaatttacagttttat

SEQ ID NO: 18737 - protein, 90 aa, Panicum virgatum
  misc_feature: Ceres CLONE 1802019
  misc_feature (20)..(90): Pfam Name: Lg106 Pfam Description: Lg106-like protein
  misc_feature: Functional homolog of the protein sequence given in SEQ ID NO 50181
  misc_feature: Useful for biocontainment applications
MASFSEEKRAAPQRDEAPSRSKYGGISPKKPLISKDHERAYFDSADWVLGKHGASSINGATVPAAEPLKPKLQRTAYHQLPPRRPACTSE

SEQ ID NO: 18738 - DNA, 924 bp, Panicum virgatum
  misc_feature: Ceres CLONE 1802024
  misc_feature: Encodes the peptide sequence at SEQ ID NO. 18739
caaatccaagctcgtgcactccatcatgcgccacgtcgccgagacgctcgaggtcgacctcgagccgctctaccagcgcattggctggccgctctaccgcaagtacggccacgccttcgaggccttcaagctcatcgtcgccgaccccgactccatcctcgacgcactgacctacgaggagaaggagacgggcccagatgggcaggaggtaactaaggtggtgcctgctgtcactcctgaggttaaggattctctggtgaagaacataaggaggaggatgacaccacagccactcaagatccgtgctgatgtggagatgaaatgcttccagtttgatggagtgctccacattaagcaagccatgatgaaagctgaagcctctggtaatgatagctgtcctgtgaagattaagctagttgctcctccactttatgttctgaccacacagactcttgataaggagcaaggcatttcagttctcactgatgcaatcaaggcttgtacagcagagattgaaaaatacaagggaaagttggtagtgaaggaaccaccaagagctgtgagtgagcgggaagacaagatattcctcgaccagattgattccttgatggcgcaaaatgcagaggttgatggcgacgatgacagtgaagaggaggaagatacaggaatgggcgacgttgaccttagaaataccggagtcgcagcttattaaggcccctctggaccctggttgttttggatgagatttgctgtatagcaagatgtccggtttggaagcagtttctttttgtttaggcttttggtggctgaaccccagtggattcactaaaacttgttaccagcggtgttcatgttttttgggttcagctggtgtcgggaaaacttttacttagctcgagcagtacctaattactattgggagtg

SEQ ID NO: 18739 - protein, 236 aa, Panicum virgatum
  misc_feature: Ceres CLONE 1802024
  misc_feature (22)..(153): Pfam Name: EIF_2_alpha Pfam Description: Eukaryotic translation initiation factor 2 alpha subunit
KSKLVHSIMRHVAETLEVDLEPLYQRIGWPLYRKYGHAFEAFKLIVADPDSILDALTYEEKETGPDGQEVTKVVPAVTPEVKDSLVKNIRRRMTPQPLKIRADVEMKCFQFDGVLHIKQAMMKAEASGNDSCPVKIKLVAPPLYVLTTQTLDKEQGISVLTDAIKACTAEIEKYKGKLVVKEPPRAVSEREDKIFLDQIDSLMAQNAEVDGDDDSEEEEDTGMGDVDLRNTGVAAY

SEQ ID NO: 18740 - DNA, 874 bp, Panicum virgatum
  misc_feature: Ceres CLONE 1802025
  misc_feature: Encodes the peptide sequence at SEQ ID NO. 18741
gcgcaccacaccgaactgagggattcaattcaattaataaaaaccagcgcttggcttggcctctagcgccagcgggtacgaacgcctgtacttgcaccggctcgcgacgtcgtggtgcgacaagccagggaagcgaggcacagagacggcggtgggcgtgtcgtagcgaggaggaggaggaggacggaggagctgaggtagcaaggcgccatgcagggggaggagaagagggggaaggtgaagaaggggtggctggcggtgcgcgtcggcgccgaggacgacgagggcggcttccagcgcttcgtcatccccatcgcctacctctaccacccgctcttccggcggctgctggaggccgcgcgcgacgcctacggctacgactactcggcggggccgctgcgcctgccgtgttccgtcgacgagttcctccgcctgcgcgcgctcgtcgagcgggacacgcaggcggcggcgccagcctcctcgtcctcgcaccgcgtgcacgccggcggccacggccactactccctctccccgtgcacccgcgccaaggtcagctcctgaagatggtttcgtcatcaggagggcctgcctgcccagctgccctgtgcctggtcgagtcgaggcgtcgacctcggcttccatccatcatgtcgtgcccgcccggcgcgaccgcgaggagtccatgcccatcgatcgagcccggaggtgtagagagagacatgaggcggtagttgtagattagtcttgggggtgcttcctctttgatttcgagtgctggctttggccttctctttttgcgtctgattttgccgatgcgcatgtactatatatttatagatgcatcgatgtataattactagctgaattgacactc

SEQ ID NO: 18741 - protein, 116 aa, Panicum virgatum
  misc_feature: Ceres CLONE 1802025
  misc_feature (1)..(80): Pfam Name: Auxin_inducible Pfam Description: Auxin responsive protein
MQGEEKRGKVKKGWLAVRVGAEDDEGGFQRFVIPIAYLYHPLFRRLLEAARDAYGYDYSAGPLRLPCSVDEFLRLRALVERDTQAAAPASSSSHRVHAGGHGHYSLSPCTRAKVSS

SEQ ID NO: 18742 - DNA, 863 bp, Panicum virgatum
  misc_feature: Ceres CLONE 1802031
  misc_feature: Encodes the peptide sequence at SEQ ID NO. 18743
gaaacatcacccaaatccaaagcaaacggaaaaacactcgctcacctagtcacctgtctgtccatcgctctagctcagctcccagtcagtgatagctgcaagcgacagcgcagccagcgccaccaagagctgggaggaaggttgtagaagatggggaagctctggacgatcctcactcacctccactcccttgcagggccaacggtcatgctcctgtaccccctgtacgcgtcggtgcaggcgatggagagcctgtccaagcttgacgacgagcagtggctcgcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgataagttcgtcagggagcagctcaggaagcacggcctctccgccggcggcggctccagcggcaaggtcaagaaggacgacaagtcgccctcgtcttctcccaaggacaaggagaagcccaagagcaagtttcttgccttcgtcacccccaagaaggatcacgaagcttactgaaacaggccgcagggtgcggtgacatgatcccggcggcttgtcgatgcagagcctatagtgtttctagtgtccagctgtgtttgttcatgcttgtcactcgaaatagagctatttgatgtatatggcgatcctgtgtgtgaacatctagcagaaatattgaatggagacgagagcaaactttccgtgttgatcatgtgaatgtgactcgagagatctgacaaaaagtcaatacaatgttctgggacaggctttccagtctc

SEQ ID NO: 18743 - protein, 150 aa, Panicum virgatum
  misc_feature: Ceres CLONE 1802031
  misc_feature (4)..(101): Pfam Name: TB2_DP1_HVA22 Pfam Description: TB2/DP1, HVA22 family
MGKLWTILTHLHSLAGPTVMLLYPLYASVQAMESLSKLDDEQWLAYWILYSFITLMEMVLESLIYWIPIWYELKLLFIAWLVLPNFRGAAFIYDKFVREQLRKHGLSAGGGSSGKVKKDDKSPSSSPKDKEKPKSKFLAFVTPKKDHEAY

SEQ ID NO: 18744 - DNA, 792 bp, Panicum virgatum
  misc_feature: Ceres CLONE 1802048
  misc_feature: Encodes the peptide sequence at SEQ ID NO. 18745
tattgttgattcatcagatccaattgggccagctcaggcacttgtggagaaaccatttattcagacaattgctagagctttaaaggccggtggtgttctttgtaatcttgctgagagcatgtggctgcacacacatctaatccaggatatgctctctatatgtcgtcagacattcaaaggtggtgtgcactatgcctggacaagcgttccaacataccccagtggtgtcattggatttttgctatgtgctaaagaaggtccgccagtgaacttcttaactcctgtgaacccaattgagaaaatacaaggagctacaaaagctggaaaggaactcagattttacaattcagagattcatagggctgcttttgttctgccaacatttgtaagaagagaactggaatcatatgatactagtagtacttctactgaaaaggagaaaccaaaagaatcagtttcaaaatcgcagaagataaagattttgccgaacaattccattcttacagcttcctaagctcgaatcatactcaatctacctctgagttctgacagaaaaaaaaaacagttgctgagaagtggcgcggcgccaggagtataagtatatactgggtttgtgagtgatgactgattgaataatggggtaattgaactgctgtgatgcctaccggaataatgtgtttcccctttgtttcatgtgtttggtgtgcataatttcccaacttggaacttgtaagacctgttgatgtaatatgggccatttgcataactgccctcgttttcacctcttactgc

SEQ ID NO: 18745 - protein, 170 aa, Panicum virgatum
  misc_feature: Ceres CLONE 1802048
  misc_feature: SWISSPROT Homolog: EC 2.5.1.16 Spermidine synthase
IVDSSDPIGPAQALVEKPFIQTIARALKAGGVLCNLAESMWLHTHLIQDMLSICRQTFKGGVHYAWTSVPTYPSGVIGFLLCAKEGPPVNFLTPVNPIEKIQGATKAGKELRFYNSEIHRAAFVLPTFVRRELESYDTSSTSTEKEKPKESVSKSQKIKILPNNSILTAS

SEQ ID NO: 18746 - DNA, 629 bp, Panicum virgatum
  misc_feature: Ceres CLONE 1802053
  misc_feature: Encodes the peptide sequence at SEQ ID NO. 18747
gcagcaccgcagcagccaccaccaccaccacgacgaggatgatgtcggcagcagtagagcttccttgttgcatcgccctgcagtcgaattcgaagagcgacagtggaagctacctgcgctacgtccacgagagcggggagaactacaagcggctgcagatcaacggtaaggacgccaacagcccctacaccaggtacgatgtggaagcgtcgctgctccaccaaggtctggtgcacatccgatgccgctacaaccgcaagtactgggtgcctcgtcggcggggcgacggctggtggatcgtcgccgacgccgacgagcgggaagaagacctgaccaaacccaactgcacgctgattgttgacgaccaaaattggcagcagactagaccaaccggtctgaccggtcgctccaagcggtctgaccggtctttgacgatgtagccgattcggcaggagccgaccggtctgaccggtccaagcagagtccgagtacaactaaagattttcgtagatttagatcttgtaataggatttcttgcgggacaagtccacccaccctataaatataaagggccacggccgattgagaaatccaatcgatcaaaatacatcaatacattatttttcttt

SEQ ID NO: 18747 - protein, 133 aa, Panicum virgatum
  misc_feature: Ceres CLONE 1802053
  misc_feature (6)..(131): Pfam Name: Agglutinin Pfam Description: Agglutinin
MMSAAVELPCCIALQSNSKSDSGSYLRYVHESGENYKRLQINGKDANSPYTRYDVEASLLHQGLVHIRCRYNRKYWVPRRRGDGWWIVADADEREEDLTKPNCTLIVDDQNWQQTRPTGLTGRSKRSDRSLTM

SEQ ID NO: 18748 - DNA, 972 bp, Panicum virgatum
  misc_feature: Ceres CLONE 1802054
  misc_feature: Encodes the peptide sequence at SEQ ID NO. 18749
cgccgcgaccaccaaggcgacgagacgatgctgcggatctaccgcttcctcccatccgcctccaggagaggttttgatctaaaagaacctctttggagtggttcgttgacattccaacaagctgtctcaacttcagcaggaaatcttgatgagaacctgtctggtaaaaagtttgcaagctatactgtgttcaagggaaaggctgcactttctattcatcctatactgccaagtttcagcaaaatggaatctggagcatatcagatgaacagaaatggatcagtaatgttgaccttccttcctgctgttggacaaaggaagtatgactatacaaagaaacagctttttgctctgtcacctactgaagttggaagcttgatatgtcttgggcctgctgaatcctgtgagtttttccatgatccgtccatgaaatcaagtcatgaaggacaggtgaaaaaatcgctgtcgcttactccccttggcagtggcagtggatactttgttaatataaccgttctgaacaacgtgcagaagactaccgatcgcctttcagtccctatcacaaaagctgagtttgcagtgatgcgcacagcactgagttttgcgttgccacacatcatgggctgggatcaggtgttgacgcaccatccagctcccctagctagcaacaagcctaggatggagggtccacacccggattctgaatgggaaaggtgaagctttccttgtagcagcaagatggagtattttgggcatcactatgaagttgctgctgcaaagtttggaatgttggtgtgcgttgattgtatctccctcctgatcgattcagaacacttgtctgctttagatttctgtaacttgagattgaaggcacgatggagcatgatggaccatattgtttgttcagtgcatgtataacttcaccatgcctactaagcgcatgtttctagtcgagtgagctggtagcactac

SEQ ID NO: 18749 - protein, 229 aa, Panicum virgatum
  misc_feature: Ceres CLONE 1802054
  misc_feature (53)..(191): Pfam Name: Whirly Pfam Description: Whirly transcription factor
MLRIYRFLPSASRRGFDLKEPLWSGSLTFQQAVSTSAGNLDENLSGKKFASYTVFKGKAALSIHPILPSFSKMESGAYQMNRNGSVMLTFLPAVGQRKYDYTKKQLFALSPTEVGSLICLGPAESCEFFHDPSMKSSHEGQVKKSLSLTPLGSGSGYFVNITVLNNVQKTTDRLSVPITKAEFAVMRTALSFALPHIMGWDQVLTHHPAPLASNKPRMEGPHPDSEWER

SEQ ID NO: 18750 - DNA, 946 bp, Panicum virgatum
  misc_feature: Ceres CLONE 1802055
  misc_feature: Encodes the peptide sequence at SEQ ID NO. 18751
acacggatccatccatctctcctttgctctttcccttcaattcaatcgtctcacagaactctttccgagagatcgagacaatccggcggcggggaggatcgacgatggcctggaggtgacgtggggggacgggcgcgggagcgtgtcgccggacggccaggtcctgacgctgtcgctggaccgcacctccggctccgggttccgctccagggacacctacctcttcgcgcgcgccgacgtgcagatcaagctcgtccccaacaactccgccggcaccgtcactaccttctacttcatctcggaggggccgtgggacgtccacgacgaggtggacctcgagttcctgggcaacgtgagcgggcagccctacacgctgcacaccgccgacttccacacctactccatcgagtggacgcagcagcacatcctcgtgctggtggacgggacgccgatccgggagttcaagaatcacgcggaccgcggcgtggcgtacccgtcgacgcagcggatgcggctgtacggctcgctgtgggacgccgaggactgggccacgcagggcggccgcgtcaagacggactggtcgcaggcccccttcgcggcgcagtaccgcaacttcacggccgcggacgcctcctcctcctcggcgtcgccggcggcggcgggcgggtacgggcaggagatggacgcggcggcgcagcaggccatgaagtgggcgcgggacaactacatggtgtacgactactgcgccgatggcaagcggttcccgcagggcgtcccgcccgagtgctccatgccgtagccgtagcgtagcgtccagatgggctaagagccggcgcgctttgattgcgaagtcgtcgatcggagggagcaagcattaggggcaggttacacgcatatgctaggttacagaatccattggtctcattcattgtttatatattcatcg

SEQ ID NO: 18751 - protein, 265 aa, Panicum virgatum
  misc_feature: Ceres CLONE 1802055
  misc_feature (33)..(195): Pfam Name: Glyco_hydro_16 Pfam Description: Glycosyl hydrolases family 16
  misc_feature (210)..(262): Pfam Name: XET_C Pfam Description: Xyloglucan endo-transglycosylase (XET) C-terminus
  misc_feature (127)..(264): SWISSPROT Homolog: EC 2.4.1.207 Xyloglucan:xyloglucosyl transferase
  misc_feature (21)..(116): SWISSPROT Homolog: EC 3.2.1.73 Licheninase
  misc_feature: Functional homolog of the protein sequence given in SEQ ID NO 50817
  misc_feature: Useful for making plants with altered cell wall content and/or composition
  misc_feature: Functional homolog of the protein sequence given in SEQ ID NO 50818
  misc_feature: Useful for making plants with altered carbohydrate content
HGSIHLSFALSLQFNRLTELFPRDRDNPAAGRIDDGLEVTWGDGRGSVSPDGQVLTLSLDRTSGSGFRSRDTYLFARADVQIKLVPNNSAGTVTTFYFISEGPWDVHDEVDLEFLGNVSGQPYTLHTADFHTYSIEWTQQHILVLVDGTPIREFKNHADRGVAYPSTQRMRLYGSLWDAEDWATQGGRVKTDWSQAPFAAQYRNFTAADASSSSASPAAAGGYGQEMDAAAQQAMKWARDNYMVYDYCADGKRFPQGVPPECSMP

SEQ ID NO: 18752 - DNA, 611 bp, Panicum virgatum
  misc_feature: Ceres CLONE 1802066
  misc_feature: Encodes the peptide sequence at SEQ ID NO. 18753
caaatggggtgtcggtgttccaatcgccattctggtcgacacacaagattggagccaaatcaggaggatgactctgccaatgcatcaaacacaaacattaggctgcgtttcctgaacgatttcaagctgcctatttacacagacaagaacatagtagacaagaacaacgcagctatcaaagtggccatgtttgaaggtgggagcaagatcacatccggccccctttcgaaagtgaaagttgaggtcttggtcctccgtggtgagttctgcaacaatgagcgcgacgactggactgaagaggaatttgacaaccacatactgcaaggtcgagatgagcaaggtctattaggaactgtgcagttgacgaaaggagaggcagaactcagccagatccgtttcaagaaagggacatgtaggaaaaaagtcataatggcagcaagagtttgcaagggtgaaaatatcgctcttcaggttcagggagccatcatgaagcctgttgttgttcaggaccgcagaaatgaagcaaatgagaagaggcaccctccaagtttagatgatgatgtttttcgtttagaggagattgccagaaatggagaataccgcaaaagact

SEQ ID NO: 18753 - protein, 203 aa, Panicum virgatum
  misc_feature: Ceres CLONE 1802066
  misc_feature (31)..(202): Pfam Name: Calmodulin_bind Pfam Description: Calmodulin binding protein-like
QMGCRCSNRHSGRHTRLEPNQEDDSANASNTNIRLRFLNDFKLPIYTDKNIVDKNNAAIKVAMFEGGSKITSGPLSKVKVEVLVLRGEFCNNERDDWTEEEFDNHILQGRDEQGLLGTVQLTKGEAELSQIRFKKGTCRKKVIMAARVCKGENIALQVQGAIMKPVVVQDRRNEANEKRHPPSLDDDVFRLEEIARNGEYRKR

SEQ ID NO: 18754 - DNA, 927 bp, Panicum virgatum
  misc_feature: Ceres CLONE 1802088
  misc_feature: Encodes the peptide sequence at SEQ ID NO. 18755
ggtagcagccggttcacttctccaggtaaggtaaagggttgggactcatggcgccgacgcagcccaagtccggcctcttcgtgggcatcaacaagggccatgtcgtcaccaagcgcgagctgccgccgcgcccgtcccaccgcaaggggaaagcaacgaagcgggtgaccatggtcaggggcctgatcagggaggttgctgggtttgctccttatgagaagcgaatcactgagcttctgaaggttggcaaggacaagcgtgctctgaaggttgctaaaagaaagctcggaactcacaagagggcaaagaagaagagagaggagatggccaatgtcctcaggaagatgaggtgtgtaaacctgaaaccttattgttctatactgcattgtgttttgtatttttttaatgttctgctccactaaatgatttctaaatactaattcatttatacatatatcctgtaagtaaagagtgttgaaaactgctagtttatccatgtcataatgtgtttttctaccatatgctggatattttgtcatggttaatttgacttggatacttgaaacattttgtcgccttgttattacagtcttctaacctggcttgtgcatacttgttatgatttatgaagcattatcttgatagacttgaaaagatatttttctctccaatctaacttttaattctctctctaatctaaatttctgattggatgtgcagatctgctggtacccacactgataagaagaaatagagcatctcaagtccgtgaagctgggggcaacattctcctgtgtcggttttccctacctgtagaacctaatagacttgtcaaagtacctgccagcaaaacatcgtgttgttagttatgtgttgaaccaccccatgagtttttgatccaactttgaatgcatctatggtttgtct

SEQ ID NO: 18755 - protein, 124 aa, Panicum virgatum
  misc_feature: Ceres CLONE 1802088
  misc_feature (5)..(103): Pfam Name: Ribosomal_L36e Pfam Description: Ribosomal protein L36e
MAPTQPKSGLFVGINKGHVVTKRELPPRPSHRKGKATKRVTMVRGLIREVAGFAPYEKRITELLKVGKDKRALKVAKRKLGTHKRAKKKREEMANVLRKMRCVNLKPYCSILHCVLYFFNVLLH

SEQ ID NO: 18756 - DNA, 729 bp, Panicum virgatum
  misc_feature: Ceres CLONE 1802103
  misc_feature: Encodes the peptide sequence at SEQ ID NO. 18757
gacgggaaggtttgggcaagcaggcggaccagcacatttttcattacaccaccagcagcaaagccatcatattagttaatctttcgcggcttcgcgggtgatcaccggcggcaggatcgagaggaaagatgtcgcagggcgcgtcgaggtgcgcggcggcgtgggcgcaggccgagcggcggccgttcacggagccgatcgagatccccggggtcgcccggggcgcgcgggaggcgttccgggaggagggggaggacgagggcggcgaggtggtcccgccgcacgtgctgctggcgcggcgcagggcggccggtgcctcctcggtgtgctccgggcagggccggacgctcaagggccgggacctgcgccgcgtccgcgactccgtcctgcggatgaccggcttcatcgagagctaacccccagccggcggcgcgcgtcgatctggctgcctcgacctcgtcggttaccttagcttcaaatgcagcagcgtgcagttccaaacggttgaatactagctactgtttgagtcagtccttcatcattggttatttcccctttcgtggaatgtggtttgaggccagaaagatttgatgcggcgaggcattttgcattattcctttgtaaattcaaagaaagtgaggtgaattcagtcgtagacgtgtggtgtgtaagtgtgttgatgtaagatacacatgtgcaccagtgcatattcaccaatttggttcagac

SEQ ID NO: 18757 - protein, 95 aa, Panicum virgatum
  misc_feature: Ceres CLONE 1802103
  misc_feature: Functional homolog of the protein sequence given in SEQ ID NO 50819
  misc_feature: Useful for making plants with modulated heat sensitivity
MSQGASRCAAAWAQAERRPFTEPIEIPGVARGAREAFREEGEDEGGEVVPPHVLLARRRAAGASSVCSGQGRTLKGRDLRRVRDSVLRMTGFIES

SEQ ID NO: 18758 - DNA, 958 bp, Panicum virgatum
  misc_feature: Ceres CLONE 1802120
  misc_feature: Encodes the peptide sequence at SEQ ID NO. 18759
aggcagcagtgtcaccgaggacaggagaggggggagagacgacgaagcagtgggatctgggggggatcgatctctcctccgcgcccgcacccgcggcaccccgaaattttattggggtttggaggggaaggatccatagagtccgttcgcgggggcaccatgagctcggcgcaagatccattctacatcgtccgggaggagatccaggactcgattgataaactgcaaagtgccttccaccgctgggagcaaactgcttcctacacaggagaatatgttcatctgacaaaggagcttcttaccagctgtgaaagcatagagtggcaggtagatgagctggaaaagacaatcacagttgcatcacgggatccagcatactatggacttgatgaagtcgagctttctagacgaagaaactggactggttctgcccgtaatcaggttggtacagtcaggagagctgttgaaaaggggaagagcaattcagcaacttcaaaataccaggacacaagcaggattaacctctattctgcccaagacaatgatgacttcatttcttcagaatcagatagacagcagctactcatgaggcagcaggatgaagaacttgatgagctcagtgcaagtgtccaaaggattggtggtgtagggctaaccatacatgaagagctgtctgggcaggaaaggatcttaaacgacctaagcttggagatggagactacttccaaccgacttgatttcgtgcagaaaagagtggccatggtgatgaagaaggctggcatcaaggggcagattatgttgattgcgttcctggtcgttctatttattattctctttgttttggtgttcttgacatagccacaacggcaccagaggcatcatcagtttctcccatttgtgatatctgctttatgtaatgtgtggtgaaaccttagtatacgagctacccatcctttat

SEQ ID NO: 18759 - protein, 232 aa, Panicum virgatum; identical to SEQ ID NO: 12897
  misc_feature: Ceres CLONE 1802120
  misc_feature (6)..(99): Pfam Name: Syntaxin-6_N Pfam Description: Syntaxin 6, N-terminal
  misc_feature (145)..(207): Pfam Name: SNARE Pfam Description: SNARE domain

SEQ ID NO: 18760 - DNA, 907 bp, Panicum virgatum
  misc_feature: Ceres CLONE 1802121
  misc_feature: Encodes the peptide sequence at SEQ ID NO. 18761
gcaacaaaccacagctcaacttcatcagcgagttgcagcagagatcgagatggagatccgcggcatgggcaccaccgccgtcctcgctctcctcgtcgccggcctcgccgccgccgccgccgccgcgaggccctcccacgccggcgccatcatccgtctccccaccagcggcggcggccggccgtgggagtgctgcgacttcgtcgtgcgggacccggacttccggccgccgcggtggcagtgcaacgacgtggcggccgagtgccccgccgcctgcagccggtgcgaggaggcgccgggcggcggcggcggctacgtgtgccgcgactgggtcgtgagcctgctcgagccgcccgtgtgcacgccgaggccgtgggactgctgcgacgccgccgtctgcaccagggagtacatccccttctgccgctgcgccgacgaggtggaggcgtgccccagcaactgcagcgagtgcgagctggcggaggcggacccgccccgctaccgctgcctcgaccagttccacggctaccctgggcccaagtgcacgccgttgccgtggatgggcaactagcccagcacgtacacgcccgatcagctatatctacggacacgtacgtacgtccacaaataaataaaattagctactgtagcaagtgattgttcatccgacgtggacaattagctaccctagctcgctggctgctgctactgtatttaattttcgtgccactaaataagtgacgaggccaagttgacctctcggtcccaagtgcagatcagagatatgaatatgatcaaccgactacagtactacactgtcacgttgatcatcgtcgagtgctgtgttgctttaatttatcgtcaagaatcgatgaaataagatggatacacattaatacttgggatt

SEQ ID NO: 18761 - protein, 173 aa, Panicum virgatum
  misc_feature: Ceres CLONE 1802121
  misc_feature (137)..(161): Pfam Name: Bowman-Birk_leg Pfam Description: Bowman-Birk serine protease inhibitor family
  misc_feature (111)..(135): Pfam Name: Bowman-Birk_leg Pfam Description: Bowman-Birk serine protease inhibitor family
MEIRGMGTTAVLALLVAGLAAAAAAARPSHAGAIIRLPTSGGGRPWECCDFVVRDPDFRPPRWQCNDVAAECPAACSRCEEAPGGGGGYVCRDWVVSLLEPPVCTPRPWDCCDAAVCTREYIPFCRCADEVEACPSNCSECELAEADPPRYRCLDQFHGYPGPKCTPLPWMGN

SEQ ID NO: 18762 - DNA, 823 bp, Panicum virgatum
  misc_feature: Ceres CLONE 1802130
  misc_feature: Encodes the peptide sequence at SEQ ID NO. 18763
ggcccagcaccccctcgcttcctttcccttcccctcgtcgctccgctcgctcgtctgcacagcggaatcccccctccttcgccgccgctcctcccgacttcggaactctgccgagatggcaaacgcaagatcaggagtcgcggtgaatgatgactgcatgctgaagttcggcgagctgcagtcgaagaggctgcaccgtttcatagtttacaagatggacgacaagttcaaggagattattgtggataaggttggggatcgtgagaccagctatgaggatttcaccaacagcctacctgaaaatgactgccgatatgctatctatgattttgactttattactgcagaggatgtccaaaagagcaggatcttctatatcctatggtccccatccaccgccaaggtgaagagcaagatgctttacgcgagttcaaaccaaaaattcaagagtgggctcaatggcatccaggtggaactgcaggctactgatgctagtgaaatcagccttgatgagatcaaggatcgagcgcgctaggtgtcatcgcgtgtctcatgatcatgcatcgtggacttgcctactgctgtggatttgtatgccattatagactttgtgctatgaaagaccgcttggtgatttatgggtttgttgctgtgtaaaaagatcctcgtggcttttccagaaagaccatgaaggtttggatctaccatgtacttccttgttgtctgccaaatgatgtatggactatgccactatggacatgtgttgtgctgttcaagttactaaaataagtaatcgatatgttccctactcgttattctgtgg

SEQ ID NO: 18763 - protein, 139 aa, Panicum virgatum; identical to SEQ ID NO: 13993
  misc_feature: Ceres CLONE 1802130
  misc_feature (12)..(139): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence

SEQ ID NO: 18764 - DNA, 775 bp, Panicum virgatum
  misc_feature: Ceres CLONE 1802131
  misc_feature: Encodes the peptide sequence at SEQ ID NO. 18765
ctcctccgcctccgctccccgattcgaaagccaccgtcctgccccccgcaaaaccctagctccagccaccatgaagggcaaggccgacacctcgaagaagggcgacggcaggctcaaggccggcggcggcgccggaaagcggaagaaggccgccgccagcggcaagccgaagcgcccgccctccgccttcttcgtcttcatgtctgaattcaggcagcagtacaatgcacagcaccctgacaacaagagcgtcgccgccgtgagcaaagcagcagggggaaagtggcgttcaatgtcagacgaagagaagcaaccatacgtggaccaagctgggcagaggaagcaggactatgagaagactaaagccaactttgataagaaggagagcacaagctcaaagaaggctaagactcaggatgacgagggttctgacaaatcgaagtctgaggttgatgatgaggatggcagctgtgatgaggaaaacggtgaagatgagtaaatagcgtctccattgtcgtgaggtagcaaatggagtgttaggtccccgattagcttacttgtttgctatctttaatattaagttgtttggaacaggtgtgtatgaaggggatctatcagacttgtgtttcatgaggttgttagtttagtgcattagcaaagaaaaagctgaatgctgttagctgttctgttgcttttcttttgctaaccacttgtggctcaacttgctggtacctgtttcattcaccaatctaatgactagtcagttattagcttg

SEQ ID NO: 18765 - protein, 142 aa, Panicum virgatum
  misc_feature: Ceres CLONE 1802131
  misc_feature (33)..(102): Pfam Name: HMG_box Pfam Description: HMG (high mobility group) box
MKGKADTSKKGDGRLKAGGGAGKRKKAAASGKPKRPPSAFFVFMSEFRQQYNAQHPDNKSVAAVSKAAGGKWRSMSDEEKQPYVDQAGQRKQDYEKTKANFDKKESTSSKKAKTQDDEGSDKSKSEVDDEDGSCDEENGEDE

SEQ ID NO: 18766 - DNA, 942 bp, Panicum virgatum
  misc_feature: Ceres CLONE 1802144
  misc_feature: Encodes the peptide sequence at SEQ ID NO. 18767
aacaataaaggctgggtcgaagagggaggaggagcttggagccttggactgagcgagcgagagagggagagggattaatgggtgaggaggccagcggcaacgccgtcagcgtggtggaggccgccaagcagccgcagcccaaggggaacggcctcgccgcgtgccgggtcggccgcggccgcggccgacccccggctgcagggcatctccgacgccatccgcgtcgtcccccacttccccaaggaaggcatcatgttcaacgacatcaccacgctgctgctgcgccccggggtgttcaaggacgccgtcsacctcttcgtcgagcgctaccgcggcatgggcatcgacgccgtcgccgggattgaggccaggggctttatatttggcccggcaatcgcattggccattggcgccaagttcataccgctgcgcaagcccaggaagctcccaggtgaggtgatatccgagaaatatgttcttgagtacgggactgattgtttagagatgcacgttggagccatcgtgcctgctgagcgtgtcatcatcgtcgatgacttggttgcgaccggtggtaccctttgtgctgcgattaggcttcttgaacgtgctggagctgatgtggtcgagtgtgcatgcctcattgggcacccaaaatttaagaatctctacaagctcaatggaaagcctgtctacgtactggtggagtcccgtgaatctgataaataagagtcaggtatgctggtgggttcattccgcgctactgcatccaattgaacggtggaggggcatcgacaactatgccgtacattactatggtgaggggagagggtagagagtgcagacttgtaggcttggtagttttttttttcagagtactcaaggagcttgtagttctgctgccgggaacatggttattagctgaatcaaggttgctgctgttcc

SEQ ID NO: 18767 - protein, 157 aa, Panicum virgatum
  misc_feature: Ceres CLONE 1802144
  misc_feature (4)..(150): Pfam Name: Pribosyltran Pfam Description: Phosphoribosyl transferase domain
  misc_feature: SWISSPROT Homolog: EC 2.4.2.7 Adenine phosphoribosyltransferase
  misc_feature (20)..(20): Xaa is any aa, unknown, or other
MFNDITTLLLRPGVFKDAVXLFVERYRGMGIDAVAGIEARGFIFGPAIALAIGAKFIPLRKPRKLPGEVISEKYVLEYGTDCLEMHVGAIVPAERVIIVDDLVATGGTLCAAIRLLERAGADVVECACLIGHPKFKNLYKLNGKPVYVLVESRESDK

SEQ ID NO: 18768 - DNA, 900 bp, Panicum virgatum
  misc_feature: Ceres CLONE 1802147
  misc_feature: Encodes the peptide sequence at SEQ ID NO. 18769
attccaacctcagaaaaacaatctcctacctgccctagacgccaaggcgacaatcctgctcaacagtgtcgcttgcaccactccactcagctctcagcttcgccaatcgccatggccacgctcgccatgcgcctcatcctctgctcctccacctcctcgtccccctcgcagcgccgccgacggcccctgcctcccggcgccaccggcgcgggcggctcggacaagccgccgcagcagcagcagcaggaggcgccggcgccacactccgccacgcggcggctggcggtggccgcgtccacggcgctggccgcctcggccgcgctcgccgcgcgccggcccgcggcgcccccgcccgcgatggccgcggaggcggcgttcgtgcccgcgccgacgccgcccggggccgtgccgcggtggggcaccaagtcgtacgtgcgggagcgcttcttcgagaaggggctgaccgcggaggaggccgccgcgcgcatccggcagaccgcggagggcatgcgcacgctgcggcccatgctggagaccatgtcctggaagtacgtgctcttctacgtccggctcaagtccaagtacctcgacctcgacctcaccaccgccatggccggcgtccccgccggccgccgcgccgactacgtccgcgtcgccaacgagctcgtcgacaacatgacggagttcgatcgcttcgtgcggacgcccaaggtctacgagtcctacctcttctacgagaagacgctcaagtcgctggatgacgtggcagagttcttcgtctgacgtacatatactgtataagttgttctaggatatatgttgttgtaatttggctttcgatgaagccttcgaacacaattcttttagaacaaaaagaaacataattaattattttcgcgc

SEQ ID NO: 18769 - protein, 223 aa, Panicum virgatum
  misc_feature: Ceres CLONE 1802147
  misc_feature (15)..(223): Pfam Name: PsbQ Pfam Description: Oxygen evolving enhancer protein 3 (PsbQ)
MATLAMRLILCSSTSSSPSQRRRRPLPPGATGAGGSDKPPQQQQQEAPAPHSATRRLAVAASTALAASAALAARRPAAPPPAMAAEAAFVPAPTPPGAVPRWGTKSYVRERFFEKGLTAEEAAARIRQTAEGMRTLRPMLETMSWKYVLFYVRLKSKYLDLDLTTAMAGVPAGRRADYVRVANELVDNMTEFDRFVRTPKVYESYLFYEKTLKSLDDVAEFFV

SEQ ID NO: 18770 - DNA, 957 bp, Panicum virgatum
  misc_feature: Ceres CLONE 1802152
  misc_feature: Encodes the peptide sequence at SEQ ID NO. 18771
agcacgggaagggagaagggaagagaaggctctcgggcatagctatagccagagggagcagcaacacaggcctcacctgaagctccatcagccatggcattcacgcccgccacggcctgctgcaatccctcgctgctggcggcgccccgggcgccgtcgcgcggctcgtcgccccgcgcgcaggcggcgctcctcggcgcggtctccacctccgcgttccgcggcgtccgggcgcccgcggcagccgcggcggccccgcggtggcgccgcgcggccgcgtctacgggcatcgtctgcggcaaggtgaccaagggcagcgtgccgtccaacttcaccctcaaggaccagaacgggaggcccgtgtcgctgaacaagttcaagggcaagccggtggtggtctacttctaccccgccgacgagacgcccggatgcaccaaacaggcgtgcgcgttccgcgactcgtacgagaagttcaagaaggccggcgcggaggtgctgggcatcagcggcgacgacacggcgtcgcacaaggcgttcgcgcagaagtaccggctgccgttcacgctgctgagcgacgaggggaaccgggtgcgcaaggagtggggcgtgcccggggacctgttcgggacgctgccggggcggcagacctacgtgctggacaagaacggcgtcgtccagtacatctacaacaaccagttccagcccgagaagcacatcggcgagaccctcaagatcctgcagggcctctgagctctgcatccgtcgctgtaaacgtaccggaactgtatgtgatgaatgaagagcctgattgtttgtccagcgattcagtctgtcagactcactcgacccatttgatggtcgaccagcctgttcgtgcttgtcttgggcagcttcaggtgttgtagttcagtgaaccccaacagttctgtatatgcaaatgcaattcatccccattgc

SEQ ID NO: 18771 - protein, 218 aa, Panicum virgatum
  misc_feature: Ceres CLONE 1802152
  misc_feature (72)..(197): Pfam Name: AhpC-TSA Pfam Description: AhpC/TSA family
  misc_feature: SWISSPROT Homolog: EC 1.11.1.15 Peroxiredoxin
MAFTPATACCNPSLLAAPRAPSRGSSPRAQAALLGAVSTSAFRGVRAPAAAAAAPRWRRAAASTGIVCGKVTKGSVPSNFTLKDQNGRPVSLNKFKGKPVVVYFYPADETPGCTKQACAFRDSYEKFKKAGAEVLGISGDDTASHKAFAQKYRLPFTLLSDEGNRVRKEWGVPGDLFGTLPGRQTYVLDKNGVVQYIYNNQFQPEKHIGETLKILQGL

SEQ ID NO: 18772 - DNA, 804 bp, Panicum virgatum
  misc_feature: Ceres CLONE 1802171
  misc_feature: Encodes the peptide sequence at SEQ ID NO. 18773
atccagcacacagagttgagttgatcgataaggcgccatggcttcttccacgaccaccctgtcctttgtcttcgtcctggcgttgctgctctcatgcggtggcgtcagcaacgcggcgcggcggatgcaggagctcccgaagcccgacgtggcgccgctgcccaagcctgaggacccgatgcctgagccgctgccggtgcccccacagcccctgcccaagcccgaggagccgaagccggagccgctgccggtaccaccacagcccctgcccaagcctgagccacttcccgtgccaccacagcccctgcccaagcctgagcccctgcccgtgccaccacaacccctgccgaagcctgagccgcttcctgtgccaccacagcccgtgcccaagcctgagcccctgcccatgccaccacagcccctgcccaagcctgagccgttgcccgtgccaccacagcccctgcccgtgccaccacagccgaagcctgagccgttgcccgtgccaccgcagcccctgccccaaccggagctgccggtgccgccgaagccatgatcgatgagccatggcaactttacaggcgcatattattgacacggcgctcagtgattattttctattgtattttgctcattcgtgtgaccatgcgtgatgctttcaccgatttgtatagcaagtgtatcagatttgcagtgtggaatggtgtgcattgccatgccatctcatctgatccggccgtgatctatgtattctggctgagatccatgtgtataaataaataaatggattcgtttgtacatgtgcct

SEQ ID NO: 18773 - protein, 171 aa, Panicum virgatum
  misc_feature: Ceres CLONE 1802171
  misc_feature: Functional homolog of the protein sequence given in SEQ ID NO 50151
  misc_feature: Useful for making plants with modulated heat sensitivity
MASSTTTLSFVFVLALLLSCGGVSNAARRMQELPKPDVAPLPKPEDPMPEPLPVPPQPLPKPEEPKPEPLPVPPQPLPKPEPLPVPPQPLPKPEPLPVPPQPLPKPEPLPVPPQPVPKPEPLPMPPQPLPKPEPLPVPPQPLPVPPQPKPEPLPVPPQPLPQPELPVPPKP

SEQ ID NO: 18774 - DNA, 382 bp, Panicum virgatum
  misc_feature: Ceres CLONE 1802194
  misc_feature: Encodes the peptide sequence at SEQ ID NO. 18775
acactcccaacctcgaacgccaagctgagcaagcaggccgagcggcaagcgcgcacatccgcctccaatcctccgtgcagccagctcgacctgtccatggcgccgaggaggtccccttcgccggccggaagcagcagcagcggcggcggctgcagcgcggagcgcgcggcggccgaccagcagcagcagacgacgctccgcggcgtgcggaggcgggcgtggggcccgtacccagcggagatgcccgacccggcgcggaaggcgagggtgtggctggcccgagtcgacaccgccaccgagggcgttcgggccgacgaagcccgcgcgcagatcgcactgaggtgaccacgaccccacgatctaccgcaacccagcatatgaa

SEQ ID NO: 18775 - protein, 82 aa, Panicum virgatum
  misc_feature: Ceres CLONE 1802194
  misc_feature: The sequence is a functional homolog of SEQ ID NO 1011 in the 10/412,699 US patent application
  misc_feature: The sequence is a functional homolog of SEQ ID NO 700 in the 10/666,642 US patent application
MAPRRSPSPAGSSSSGGGCSAERAAADQQQQTTLRGVRRRAWGPYPAEMPDPARKARVWLARVDTATEGVRADEARAQIALR

SEQ ID NO: 18776 - DNA, 641 bp, Panicum virgatum
  misc_feature: Ceres CLONE 1802194-R
  misc_feature: Encodes the peptide sequence at SEQ ID NO. 18777
gctgcagcgcggagcgcgcggcggccgagcagcagcagcagccgaggctccgcggcgtgcggaggcggccgtggggccggtacgcggcggagatccgcgacccggcgcggaaggcgcgcgtgtggctgggcaccttcgacacccccgaggaggccgcgcgggcctacgacgccgccgcgcggaagctccgcgggccacgcgccgccaccaactaccccgcggcggccgatgattcgccgtgcctgttcctggacccggcgccgacgaagacggtggtgcggcagttcctgccgccgctgaagggggccgaccaagagcggagctgcgggtacccgggggcggcggcggcgtcggtgggcctcgggctggacctcaacctgcctccgccggccgagatggtgatgtagcggcggaaatggaattggccgatcgagccgcccaagatgatgctcatgcagtcatgctgctagctagctgccacgaatgtactcttagctagtagctcatgcagtaaaaaataggcagctagtagctcctagctcgtgtttcttttgtgcggttaaccttaaccggctactactctaggactgatctctcgcaaatttgcaatgcaaaggaggaggaaattaactttttccccc

SEQ ID NO: 18777 - protein, 134 aa, Panicum virgatum
  misc_feature: Ceres CLONE 1802194-R
  misc_feature (14)..(65): Pfam Name: AP2 Pfam Description: AP2 domain
  misc_feature: The sequence is a functional homolog of SEQ ID NO 1435 in the 11/479,226 US patent application
  misc_feature: The sequence is a functional homolog of SEQ ID NO 2504 in the 10/374,780 US patent application
  misc_feature: The sequence is a functional homolog of SEQ ID NO 618 in the 10/225,066 US patent application
  misc_feature: The sequence is a functional homolog of SEQ ID NO 674 in the 10/412,699 US patent application
  misc_feature: Functional homolog of the protein sequence given in SEQ ID NO 50249
  misc_feature: Useful for making plants with altered lignin content
CSAERAAAEQQQQPRLRGVRRRPWGRYAAEIRDPARKARVWLGTFDTPEEAARAYDAAARKLRGPRAATNYPAAADDSPCLFLDPAPTKTVVRQFLPPLKGADQERSCGYPGAAAASVGLGLDLNLPPPAEMVM

SEQ ID NO: 18778 - DNA, 871 bp, Panicum virgatum
  misc_feature: Ceres CLONE 1802207
  misc_feature: Encodes the peptide sequence at SEQ ID NO. 18779
aactctgaccttcgcaagcttgcagtcaacttgattcccttccctcgtctccactttttcatggttggctttgcgccactcacctcgcgtggctcgcaccattaccgtgccctcactgtccctgagctgacccagcagatgtgggatgccaagaacatgatgtgcgctgctgacccgcgccatggccgctacctcacagcctctgccatgttccgtggcaagatgagcaccaaggaggtggacgagcaaatgatcaaygtccagaacaaraactcatcctacttcgtggagtggatccccaacaatgtcaagtccagtgtttgtgacatcccgccacgcggcctctccatggcttccactttcatcrgcaactccacctccatccaggagatgttccgccgtgtgagtgagcagttcactgctatgttcaggaggaaggctttcctgcattggtacactggtgagggcatggacgagatggagttcactgaggctgagagcaacatgaacgacctggtgtccgagtaccagcagtaccaggatgccactgccgacgaggaggatgactatgaggatgaggaggaggcaatccaggacgagtaaggtggtctggacagtcccatgttgtacccccagatcctggtttgctttaagctggagcttgcctatgtttggttattgtcattctgcgtatgttatgttgagtatgtagtaagtacttaagtggtagcatgctgcatgctacccgcttgtcctctttcgccaccagaaagacatgttcgcctgcactgcttgatatgccatcgcttatatgggtggagtattggattattattgtatctacttgtttgtgtgatgggtcttcccattc

SEQ ID NO: 18779 - protein, 200 aa, Panicum virgatum
  misc_feature: Ceres CLONE 1802207
  misc_feature (1)..(137): Pfam Name: Tubulin_C Pfam Description: Tubulin/FtsZ family, C-terminal domain
  misc_feature: Functional homolog of the protein sequence given in SEQ ID NO 50258
  misc_feature: Useful for making plants with modulated flowering time
  misc_feature (123)..(123): Xaa is any aa, unknown, or other
NSDLRKLAVNLIPFPRLHFFMVGFAPLTSRGSHHYRALTVPELTQQMWDAKNMMCAADPRHGRYLTASAMFRGKMSTKEVDEQMINVQNKNSSYFVEWIPNNVKSSVCDIPPRGLSMASTFIXNSTSIQEMFRRVSEQFTAMFRRKAFLHWYTGEGMDEMEFTEAESNMNDLVSEYQQYQDATADEEDDYEDEEEAIQDE

SEQ ID NO: 18780 - DNA, 819 bp, Panicum virgatum
  misc_feature: Ceres CLONE 1802209
  misc_feature: Encodes the peptide sequence at SEQ ID NO. 18781
caccactcaagctgacctcatctgtaccctacctagctaggtagctaataaatcactaatacccgctccatggcgaataaccaccaccgatttgtggctctcctgctcgtctcggccacgctggtccctcacctcatcgcgccggccgcgtgctgcccgtcctgcccgacgactaakcctccgccgccgcccccgacgccmgtgccgtgcccaccgccgccgwcgtccgcgccgccgwccacgggcaagtgccccctgaacacgctgaagctgctggcgtgcgtggacgcgctcaacgggttggtgcacgccgtggtcggcgccaaggccagcgagaagtgmtgmccrctgctgcaaggcktggccgacctcgacgccgcgctctgcctctgcaccaccatcaaggtcaaggckctcagcatcaacctcgtgctccccatcgccatcgaggtgctcgtcaacgagtgccacaagaacgtccccgccagcttccagtgcccgtaatcacacactcactcatcactattgygtatgtatgtaccattaattaattatacatctgcatgcatgcatccatgcatgatgggttaaggttatgataaaccagtcatatactcatatatctatatatatcttaagcatgtatagcttaatgcatgagctctttttggcttgtgatataaatggagctgtggattgtccatttgtttttgtaattgtgtatcaatattgtaacatgaaccagtgtgagagttgtgggcttggaacttgtagtgactaaaaagatttatatgaataaagcgtgtgtgtcatacatgt

SEQ ID NO: 18781 - protein, 144 aa, Panicum virgatum
  misc_feature: Ceres CLONE 1802209
  misc_feature (61)..(143): Pfam Name: Tryp_alpha_amyl Pfam Description: Protease inhibitor/seed storage/LTP family
  misc_feature (36)..(36): Xaa is any aa, unknown, or other
  misc_feature (52)..(52): Xaa is any aa, unknown, or other
  misc_feature (57)..(57): Xaa is any aa, unknown, or other
  misc_feature (91)..(91): Xaa is any aa, unknown, or other
  misc_feature (92)..(92): Xaa is any aa, unknown, or other
  misc_feature (98)..(98): Xaa is any aa, unknown, or other
MANNHHRFVALLLVSATLVPHLIAPAACCPSCPTTXPPPPPPTPVPCPPPPXSAPPXTGKCPLNTLKLLACVDALNGLVHAVVGAKASEKXXPLLQGXADLDAALCLCTTIKVKALSINLVLPIAIEVLVNECHKNVPASFQCP

SEQ ID NO: 18782 - DNA, 856 bp, Panicum virgatum
  misc_feature: Ceres CLONE 1802212
  misc_feature: Encodes the peptide sequence at SEQ ID NO. 18783
accgccggcgccgccgacccacccgacccgacccctccctccctcgctgacctccgccgtcgccggaggcgaagcgaccgcaaaggaggctgcagaagaattaggtggtgaaatcactcagagaactgtgcaatagtttcaatggctgctaccaagcttcaggccttttggaaccatcccgctggccccaaaaccattcatttctgggcgccaacgttcaaatggggtatcagcattgccaacattgctgactttgctaagccacctgaaaagatatcttatcctcagcaaattgctgttacttgtactggactcatttggtcaaggtacagcttggttatcaaaccgaaaaactggaaccttttcagcgttaatgttgcaatggctggtacgggcctgtatcaactttcgcggaagataaggcaagattacttgtctggtgagaaggaagctgctccacaactggaagcataatgacaacaacagaccagaataccttgctatatgttccagtttcccgggaggctgggactgcaagggtctctttcaatccaggacatgaatcttttgctttatgttttctcgttctaaagtcatgagcagattaatgtgaaaattttctgccaaaaatgacccatgaagccatgcatttgtgcacctgtgggaaaaaaacccatgcaaatacatgtttatatgttttgtttttgttcagttaatcttatttgggatttcgaaatcgtttgctaagctggttgatcataacccagggttcatagacgtctgtatccttcacagtgtggagatgctctttttgttatgatcataatgaagctcaattgttgtccctggacattag

SEQ ID NO: 18783 - protein, 110 aa, Panicum virgatum; identical to SEQ ID NO: 14895
  misc_feature: Ceres CLONE 1802212
  misc_feature: Functional homolog of the protein sequence given in SEQ ID NO 50575
  misc_feature: Useful for making plants with modulated biomass
  misc_feature: Useful for making plants with modulated flowering time

SEQ ID NO: 18784 - DNA, 913 bp, Panicum virgatum
  misc_feature: Ceres CLONE 1802213
  misc_feature: Encodes the peptide sequence at SEQ ID NO. 18785
acgaatccggaattccggatagagcgccgcccccacctcgacccgctccgtccggcgacgaggaccccgttccggcgccgccacagcgtcgaaccgagagaagggcgaggagggggggcaaacatgacgacgatccggcggttctgctgcgacgacctcctccgcttcgcctccgtcaacctcgaccacctcaccgagacgttcaacatgtcgttctacatgacgtacatggcgcgctggcccgactacttccacgccgccctcagccctggcggccgcgtcatgggttacatcatgggtaaagttgaagggcagggtgagtcttggcatgggcacgtcacggcagtgtctgttgcctcggaatttcggaggcagaaattagccaagaagctcatgaacttgctggaggaaatcagcgataaaatggataaggcctactttgtggatctctttgtaagggcatctaacatgccagcgataaggatgtatgaaaagcttggttatgtggtttatcggagggtgcttcgatactactcaggggaagaagatggccttgatatgagaaaggcgttatcacaagatgtcgagaagaagtccatcataccactcaagaggccaatcacacctgatgaacttgaatatgattgatgttgaagtctaggaagtacagtgtggtgtttgttgcttacctgaacagcatgaatggggaatttaacaagctttgaatctggtctagtggtatcattaagtagggattagtacttgtactgttgtgttttttgcaccagttaggccccatggcattcagtgtttgaattgagagaactgataactgtgatgtaatggaatcaaactgctttgttttgatgtcagaccagccaaataattcttatcctgtgacgttacttgctgt

SEQ ID NO: 18785 - protein, 174 aa, Panicum virgatum
  misc_feature: Ceres CLONE 1802213
  misc_feature (45)..(128): Pfam Name: Acetyltransf_1 Pfam Description: Acetyltransferase (GNAT) family
  misc_feature: SWISSPROT Homolog: EC 2.3.1.88 Peptide alpha-N-acetyltransferase
MTTIRRFCCDDLLRFASVNLDHLTETFNMSFYMTYMARWPDYFHAALSPGGRVMGYIMGKVEGQGESWHGHVTAVSVASEFRRQKLAKKLMNLLEEISDKMDKAYFVDLFVRASNMPAIRMYEKLGYVVYRRVLRYYSGEEDGLDMRKALSQDVEKKSIIPLKRPITPDELEYD

SEQ ID NO: 18786 - DNA, 891 bp, Panicum virgatum
  misc_feature: Ceres CLONE 1802229
  misc_feature: Encodes the peptide sequence at SEQ ID NO. 18787
ttccttctagagtactgggtcctagcctcgcccggggttgcactgcactgcacgccaccgcccaccggaggtcgccgcgagcagagaaccagagccaagcaaagctagcctagtagtagccatggcggaggaggcgtcgtccgcgccagcgccggccggggggaagatgacgatggtggcgggggtggacgagagcgaccacagcttctacgcgctgcagtgggcgctccagcacttcttcccgccggcccagccgcagcagcagcagtaccgcctcgtcgtcgtcaccgccaagccctccgccgcgtccgccgtcggcctcgccggcccgggcgcggcggaggtgctgccgttcgtggaggcggacctcaagcgcgtcgcgctgcgcgtcgtcgacaaggccagggagctctgcgccgccgcgcaggtggccgacgccgagttcgaggcgctcgagggcgacgccaggaacgtcctctgcgacgccgtcgagaggcaccacgccgagatgctcgttgtcggcagccacggctacggtgccatcaaaagggctgttcttggaagcgtgagcgattactgcgcccaccatgcgcactgcaccgtgatgatcgtgaagaagcccaagcccaagcactgagcaccgatcgatgcggcgatctgactcgtcagtattccacaagcaaacatctctatatgtattgtcaagctgcatgtgtgtctgtttgtgcataagcagaagatcaacgagcttcaaataaccggttacttggtcgagtaaccggatatatgtaatcctactacttacggattgacatgtacaaaataattgctgtgcagcacctcaaaaataatgttattttttcttcatggaatgcaatacgtgtgaagtgc

SEQ ID NO: 18787 - protein, 171 aa, Panicum virgatum
  misc_feature: Ceres CLONE 1802229
  misc_feature (16)..(165): Pfam Name: Usp Pfam Description: Universal stress protein family
MAEEASSAPAPAGGKMTMVAGVDESDHSFYALQWALQHFFPPAQPQQQQYRLVVVTAKPSAASAVGLAGPGAAEVLPFVEADLKRVALRVVDKARELCAAAQVADAEFEALEGDARNVLCDAVERHHAEMLVVGSHGYGAIKRAVLGSVSDYCAHHAHCTVMIVKKPKPKH

SEQ ID NO: 18788 - DNA, 813 bp, Panicum virgatum
  misc_feature: Ceres CLONE 1802232
  misc_feature: Encodes the peptide sequence at SEQ ID NO. 18789
aggggagcggggcggggcgcaccgcgggctcaaatgccggcacgagcatcgcgtgcggagcggcggagcctgtccaaatcctgcgattcctcttcgcatcccgtattcccgtgcgccagagccagcgcctgcgcgacgcagccttgacctccccgacggcctccgcctccgtctcgaagcgcggcgcagggcgtagggttctgctatggccagcgacaaggtgtttgagttcgaggaggtcgctaagcacaacgtcaccaaggactgctggatcgtcatcgacggcaaggtttatgatgtcacaccctttatggatgagcatcctgggggagatgaggttttgctagctgtaactgggaaagatgctactgctgattttgaagatattggccacagcgattcggcaagggagatgatggagaagtaccatatcgggcagattgatgcttcaaccatcccagtaaagcgtacttatgtgaatccccagcaagctcccagccacgtggacaaggataacgacttcctcatcaaaatcttgcagtttctcgttcccattctgatcctgggccttgcgtttggtatccggcagtacaccaaatcggagtagctcagctcgtagaggttcacctatgtgaaatgatttggatgaaaatagtgcaataattgtgtatttgtttggtagaagaatgctatctcattgatcataagtattctgtactgtgaacatccatgtttgtgcccgagcgtgtgtgttttcccgtgaactgagatatgagatgatatctaaagcttccttgaaagccgatagcaccg

SEQ ID NO: 18789 - protein, 133 aa, Panicum virgatum
  misc_feature: Ceres CLONE 1802232
  misc_feature (6)..(80): Pfam Name: Cyt-b5 Pfam Description: Cytochrome b5-like Heme/Steroid binding domain
MASDKVFEFEEVAKHNVTKDCWIVIDGKVYDVTPFMDEHPGGDEVLLAVTGKDATADFEDIGHSDSAREMMEKYHIGQIDASTIPVKRTYVNPQQAPSHVDKDNDFLIKILQFLVPILILGLAFGIRQYTKSE

SEQ ID NO: 18790 - DNA, 812 bp, Panicum virgatum
  misc_feature: Ceres CLONE 1802250
  misc_feature: Encodes the peptide sequence at SEQ ID NO. 18791
ctgacaggcccagctgcagcccaaaacccaaacccacccaaaagcttttctgctcctgcgcgtcgcgacccagcacgccaagatagggtcggagagccccgccgccgacggcgccgcccgcaagcggcccggcggcggcgatgcccccgccccggcgcccgccgacaagcgccgccgcccggagcccccgtcgtcctccggctcccgcgaccgccaccaccaggcccgccgcccgcccccggccgaggagaaggtgcgcgcctcccacatcctgatcaaacacgagggctcccgccgcaaggcctcgtggagggaccctgagggcgtcgccatctccgccacgacccgcgacgacgccgccgacctcgcgcgcgcgctccgcgaccagatcgtctccggggagcgcaagttcgaggacatcgccgccgagaactccgactgcaattcggccaagcgcggcggtgacctcggttcatttgggaggggtaagatgcaaaaggcttttgagaaggctgcgtttgctctgaaggtgggggagataagtgacgtgattgatacagagagcggggtgcacatcatcaagaggactggctaattgcgacagtgtcctccggtctcagtccatatagctggaaaatgccctgaagaagctcgatggtttcttgcttcattgaagaccttgtgtgtattctcttatgagcttgataattgatttttttatgcttccgtgacagacatgtagttttaaacggttatcacggcaaggcaagacggaatcagattgtcttgaatgtgacaaagattacgctccc

SEQ ID NO: 18791 - protein, 34 aa, Panicum virgatum; identical to SEQ ID NO: 14728
  misc_feature: Ceres CLONE 1802250
  misc_feature: SWISSPROT Homolog: EC 5.2.1.8 Peptidylprolyl isomerase

SEQ ID NO: 18792 - DNA, 864 bp, Panicum virgatum
  misc_feature: Ceres CLONE 1802252
  misc_feature: Encodes the peptide sequence at SEQ ID NO. 18793
tataataggaagtgacaggagaattaagccaaaggagccagatgagctgcttgagcctctcaaggatcagtgtttctacaggcacgaaggttggtggtcttatgagttctgttatcatgggaaaatccgacaggttcatgtagaaggtgataagcttattcaagaatatgttctaggtgaatatgatgatgatgcaactattgcttaccatgaaaatagcacgtctgaattcgctgacgatgaccatcatgtcaaagatacttctaggagatatcatgtccacttgtacacaaatgggactgtatgtgatctcacagacataccccgggagactgaggttagatttgtctgctcggaacccactgtcctgatcagttcgatcaaggagatctcttcctgcaaatatgttgtaacaattcaaagcccgatgctttgcaaaaacccgctgtttcatcaagaaaaacgcaacctctccatccactgcaacgagttgcctactgaaacagaatcaactgtcattgtggacgatgactcgctgccaaaagaagcgcagatctccatcattcctgatcaggatgaacttcatggtttcacagcttatgccacttgacttccctccaataaagtatgtctgatgtagaagaaacaattattttggaggcgcagtggcaactgagaacactatctttactgtcccatgaaaccctgcagtggcacatggtgctccatgtaaagcaggctgagattactgtctacaaagcatataggggaggattacgaaggaagagagtttctctgtattagtaaagaaacaattttgagacactaacatttgcttgaaatgtctataaaatggattgctgc

SEQ ID NO: 18793 - protein, 202 aa, Panicum virgatum
  misc_feature: Ceres CLONE 1802252
  misc_feature (22)..(99): Pfam Name: PRKCSH Pfam Description: Glucosidase II beta subunit-like protein
IIGSDRRIKPKEPDELLEPLKDQCFYRHEGWWSYEFCYHGKIRQVHVEGDKLIQEYVLGEYDDDATIAYHENSTSEFADDDHHVKDTSRRYHVHLYTNGTVCDLTDIPRETEVRFVCSEPTVLISSIKEISSCKYVVTIQSPMLCKNPLFHQEKRNLSIHCNELPTETESTVIVDDDSLPKEAQISIIPDQDELHGFTAYAT

SEQ ID NO: 18794 - DNA, 828 bp, Panicum virgatum
  misc_feature: Ceres CLONE 1802253
  misc_feature: Encodes the peptide sequence at SEQ ID NO. 18795
aacggtggcaatttaaggtgcttccacttcagtgtgtgcctccgagtcctccatttagccctcggttctcgagtcttccagactcgcgctcgctgctcgctgctcgctgctcgccttcgcttccgacttctccactcgcgtcgcacgcaggggtcgcctgagatcacatagacaatggtgaaggctgtcgctgtcctcgctggcagtgatgtcaagggtaccattttcttttctcaagagggagatggtccaaccaccgtgaccggaagtatctctgggctcaagccggggctccatgggttccatgtgcatgcgcttggtgacaccaccaatggctgcatgtccactgggccacacttcaatcctgctgctaaggagcatggtgcaccagaagatgagaatcgccatgccggtgatcttgggaatgtgacagctggagaagatggtgttgctaatgtcaatattactgactgccagattcccctcactgggccacactcaatcattggccgagctgtagttgtccatgccgatccagatgaccttggcaagggtggacatgagcttagcaagagcacgggaaatgctggtggccgtgttgcttgtggtatcattgggctccagggctagatgctgtggcttcattggtgaacattcacatctgagcacctccggtcttgctgcttcatttcccttatattggatacataattggctactcttaataatcgcctgatcaatagtcagagcgctattcctatcattccgtgtatgaacattgcacaaccatcatttttctttagtgcgatgcgaagtggctgttttggc

SEQ ID NO: 18795 - protein, 151 aa, Panicum virgatum; identical to SEQ ID NO: 9809
  misc_feature: Ceres CLONE 1802253
  misc_feature (1)..(151): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 18796 - DNA, 910 bp, Panicum virgatum
  misc_feature: Ceres CLONE 1802262
  misc_feature: Encodes the peptide sequence at SEQ ID NO. 18797
atgcaccggtgaccaaccagaccccccatccggccatcccctccccagtgtcggagcctccgctccccatcgacttgtccccattcctcagctcccactcgccgccggaccaagcggatggcgtcggcgtccaaggaggaggtgatcgggaagctcaacgtccgcgtgttgcggggcaacaacctgatcatcgccgacccgctcacccacaccagcgacccctacgtcgtcctccagtacggcgcccagaaggtgaagactagtgtccagaagaagaatcctaatccagtctggaatgaagtactgcagctctcagtcacaaatcctacaaagccagtgcaccttgaagtttttgatgaggacaaattcacagccgacgatagcgtgggtgtggctgagatcaacataactgacatatacgatgccgcgaagttggatctgagccatgccactaacggaaccaggatcaagacaatatatccagtcggtgtaaactaccttggcggtgagagccatgttcagtggaaggatggaaaggttgtccaggacttgattctgaagctgaagaaggtcgagagtggcctgattgtggtgcagctggagtgggttcatgttcctggtgtcaagctgtgagcctcgtctgaatgagggttgcaatcgctgctttgatggagctgcagttgtagttggtccctagtttgagtgtgttattgtaaactatatcctgaacgtggtgatttgcaatgtatgagtgatgtgtgttggtttgagtgtgatgttttatttgaggtatttcccggtgacatgatgtgggtgtgcagtctgtggttcacgaataagaaaagccctgtctatgtcaagtcgagcgtgatgtaaattaagaaactgaaatagaagcgctttgggcgtt

SEQ ID NO: 18797 - protein, 171 aa, Panicum virgatum
  misc_feature: Ceres CLONE 1802262
  misc_feature (13)..(94): Pfam Name: C2 Pfam Description: C2 domain
  misc_feature: SWISSPROT Homolog: EC 3.1.1.4 Phospholipase A(2)
MASASKEEVIGKLNVRVLRGNNLIIADPLTHTSDPYVVLQYGAQKVKTSVQKKNPNPVWNEVLQLSVTNPTKPVHLEVFDEDKFTADDSVGVAEINITDIYDAAKLDLSHATNGTRIKTIYPVGVNYLGGESHVQWKDGKVVQDLILKLKKVESGLIVVQLEWVHVPGVKL

SEQ ID NO: 18798 - DNA, 796 bp, Panicum virgatum
  misc_feature: Ceres CLONE 1802263
  misc_feature: Encodes the peptide sequence at SEQ ID NO. 18799
aaaaccctagccccgagcagccgcagcggccagcacttcacgtcacctggcggcggcggcggcagcggcaggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgaccctgactggtactacaccagggctgcctcaattgcaaggaagatctacctcaggcaaggcattggtgtaggtggattccagaagatctatggtggccgccagaggaatggctcccgcccaccacacttctgcaagagcagtggtgccatttcacgtaacatcctgcagcagttgcagaagatgggcatcattgatgttgatcccaagggtgggcggctcatcacctcccagggaaggcgtgatcttgaccaagtggctggaagagttgctgttgacgcttaagcatctctgttttctgttttgttcgtgttcgatggtatggctacactttatttgcagttttgaactaggacttgtcctgccttggttcagagaatttaagatttgatgcatctagttatggaactgcactatgttttcctcaagtacctaatgcagtattggaattcattctggaatgaaagtaaggaattgtgcttgtgatgtgcacccatgtcgtgccatgttgattagatgaatatgttgtcccgtgttaccaaacttttttcgctactggccgttttaccag

SEQ ID NO: 18799 - protein, 145 aa, Panicum virgatum; identical to SEQ ID NO: 12938
  misc_feature: Ceres CLONE 1802263
  misc_feature (7)..(145): Pfam Name: Ribosomal_S19e Pfam Description: Ribosomal protein S19e

SEQ ID NO: 18800 - DNA, 953 bp, Panicum virgatum
  misc_feature: Ceres CLONE 1802281
  misc_feature: Encodes the peptide sequence at SEQ ID NO. 18801
ccaaaacaggagggaaaagacttgtcaactacagaacatccctttgatgatattacctacaatatacctgagaagccagtgacatttactgaaggtgcttcttacagtcttgtaatacttgctggacttggaattgcagctctggctggatatgctgtgttcaaagaacttatatttgaaccaaaagagtacaagatatttgggaaagctttaacaagaattcagagtgatagccaggtcacatcaagaattggccaccctattactggatatggccaggaaactagaaaccgtgcagctcggcaacgaattccatctaagatttggacagacgaggatggtgttgaacatgtagaggtgaactttctcatccgtgggccacatggagcaggaaaggtgtattcagagatgttcaaagataattctgaccggacatggaagttcacatatcttgttgttgaaatcgtgtctccacaacatgcaaaaacacaactgatgctagaatcttacttaccagcataaggatgcaagaaacaaaagctagccgtggcacgatgttgtaagagtttatcacaattggggatcaaaaacaagttttggctaaactgagaatgttacgaacaagtccaggcaggttggtatacttgggaacaagctttcagaatgtactggcaagaaacctgtattatggagtaataacctgttcttgcattactagaaggcaaattggtctcagaattcggacaattgatatctctgaaatgttttgatgtttctttaaaaaggtttgctgtacccctgacccccaattaactggggaaagccctgcattcctggatgttaagggtatttttgatatgttgatctcataagtagcttatattgtccaaacaatgtggactaactctctaagtcatctatgaaacatcgtggcaatttttgttgactgtttc

SEQ ID NO: 18801 - protein, 173 aa, Panicum virgatum
  misc_feature: Ceres CLONE 1802281
  misc_feature (25)..(169): Pfam Name: TIM21 Pfam Description: TIM21
PKQEGKDLSTTEHPFDDITYNIPEKPVTFTEGASYSLVILAGLGIAALAGYAVFKELIFEPKEYKIFGKALTRIQSDSQVTSRIGHPITGYGQETRNRAARQRIPSKIWTDEDGVEHVEVNFLIRGPHGAGKVYSEMFKDNSDRTWKFTYLVVEIVSPQHAKTQLMLESYLPA

SEQ ID NO: 18802 - DNA, 715 bp, Panicum virgatum
  misc_feature: Ceres CLONE 1802290
  misc_feature: Encodes the peptide sequence at SEQ ID NO. 18803
agcaatcgaggaagacagagttctactgattcgagaagcttctacgtacggccacaagccagcaacccgccgaggcatctctgcaagcgaagcaggtccgatcgagagcatgctggttgtcgcgtcgccgtcggcgtcgggcgagctcggctcgctgttcgcggcgttcgacaaggacgccgacggcaggatctccgcggcggagctgcggctctgcatgcgggcggcgctgggcgaggacgtggcgcccgaggacgccgaggcgctggtggcctcggcggacgcggacggcgacgggctgctggacgagggcgagttcgcgcggctggtgcgcgcggaggcggcgggcggcggcgaggaggaggagtggcggcggcgcggggggctcgaggcggcgttcggcatgtacgcggcggagggcgaggggcgcatcacgccggccagcctggggcggatgctcagcaggctcggcgcgcgccgggaggttgacgactgccgcgccatgatccgcaggttcgacctcgacggcgacggggtgctcagcttccacgagttcgagatcatgatgatgaacgcctgaacaagatgcgtcctgctgcaggacagattgtgattgtggtttctctttctggctttgtacagttttttttcttttcttttttaacgaatatgtcaccatttatgtcatttcgagtgattttggtgatcgaataac

SEQ ID NO: 18803 - protein, 156 aa, Panicum virgatum
  misc_feature: Ceres CLONE 1802290
  misc_feature (128)..(156): Pfam Name: efhand Pfam Description: EF hand
  misc_feature (12)..(40): Pfam Name: efhand Pfam Description: EF hand
  misc_feature: SWISSPROT Homolog: EC 2.7.11.1 Non-specific serine/threonine protein kinase
MLVVASPSASGELGSLFAAFDKDADGRISAAELRLCMRAALGEDVAPEDAEALVASADADGDGLLDEGEFARLVRAEAAGGGEEEEWRRRGGLEAAFGMYAAEGEGRITPASLGRMLSRLGARREVDDCRAMIRRFDLDGDGVLSFHEFEIMMMNA

SEQ ID NO: 18804 - DNA, 876 bp, Panicum virgatum
  misc_feature: Ceres CLONE 1802292
  misc_feature: Encodes the peptide sequence at SEQ ID NO. 18805
gagaaatcacagtcgtggtcttgcgtcgactgacagagacacagctaggctgctccacttgtgtattcgcaccacacaattaagtggatccacgccggcgagaccggcagtggttcagacgacatggctctctcgctgcttgcggccgccgccctcctcgccgtcttcatcctgctgccgctctcatacctcctcttccatgccgtcatcaacaagcctgcccctgcctctccgcagctgcactacctcaaggccgtggtgaaggagacgctgcggctgcacgcgcctgtcccgctgctggtgccccgggagccgccggcggacgcggagatcctgggctaccacgtgccggcgcgcacgcgcgtggtggtgaacgcgtgggccgtcggccgggaccccgcggcgtgggaggacgccgaggagttcgtgccggagaggttctcgggcggcgccgccgccgtggacttgaaggaggggcagcagcgcttggagctggtgccgttcggcgccggcaggagggggtgtcccggggccgggttcgccgaggcaagtatcgagacggcgctggcgagcttggtgtgtcatttcgattgggaggcggcaggcaagtcgctggacctgagcgagatgaacggcctgaccgtgcacatcaagtccggcctgccgctcgtagcgaagccgtgggtcccgtgatacacatgcatgcgttttatatattcaggttgtgtgttggtagtagtattgtactatcgttatactgtagctaggcagtacagctgtcacattagttgtttggaaaagaaagagacatgaacatgatagtagtagtcacgttttgatcagattaattagagaataacatcttaggccttgttt

SEQ ID NO: 18805 - protein, 189 aa, Panicum virgatum
  misc_feature: Ceres CLONE 1802292
  misc_feature: SWISSPROT Homolog: EC 1.14.13.68 4-hydroxyphenylacetaldehyde oxime monooxygenase
MALSLLAAAALLAVFILLPLSYLLFHAVINKPAPASPQLHYLKAVVKETLRLHAPVPLLVPREPPADAEILGYHVPARTRVVVNAWAVGRDPAAWEDAEEFVPERFSGGAAAVDLKEGQQRLELVPFGAGRRGCPGAGFAEASIETALASLVCHFDWEAAGKSLDLSEMNGLTVHIKSGLPLVAKPWVP

SEQ ID NO: 18806 - DNA, 712 bp, Panicum virgatum
  misc_feature: Ceres CLONE 1802294
  misc_feature: Encodes the peptide sequence at SEQ ID NO. 18807
aatacgccggcgctagctctagtcttgcgagccacgaaagaaagaagcaaacagatctgcctgcctgcctgccgcttgttcttcctcccctccgggctccggcgatccgatccgaacgatggcgtccgccgccgcggggtcgtggtcgaagcggtggatccggccggaggtgtggccgctcttcttcgcgactggcacggccgtcggcatctgcgggatgcagctcatccgcaacatcaccggcaacccggaagtcagggtgctcaaggagaagagggcggcgggcgtgctggagaaccacgacgaggggaagaggtactcgcagcacggcttcaggaagttcatcgacggcaggaagcccgagatcatggagaacctcaactcgtggatggcggacccgcccaagtagtagatcaatccgtctccatatctaccgcggccgatggctcatctggtcggccgcacaattttaattattcttgacattcagcagctgttaccgtgattgtctgcggtacgtttatttttgtatcaccgtaaacatactcctcctatattcttaacaacaagaacaaatatgtgacagcatgcatgctgtcatggccctggctgtgaacgggcatattcaaagtttttttttcctcattttgggacgcgaatataattcttgttgctctcgttctgaataaccttaacagttgggtgccttgtt

SEQ ID NO: 18807 - protein, 96 aa, Panicum virgatum; identical to SEQ ID NO: 15470
  misc_feature: Ceres CLONE 1802294
  misc_feature (10)..(96): Pfam Name: B12D Pfam Description: B12D protein

SEQ ID NO: 18808 - DNA, 591 bp, Panicum virgatum
  misc_feature: Ceres CLONE 1802296
  misc_feature: Encodes the peptide sequence at SEQ ID NO. 18809
cctttcacctcacctcactctgagtctgagcgcgcggccgcactcaagcgagcgagcacgggcgaaatggcgcgccacgccgggaagcccctcctcgcgctcctcgtgctgtccggcctcctcctcctcccgctcgtcgcctccgtccccttgccaagaagcctgcgcctggggaacccgcagcagcacccgccggctctgaagcttgcttcttctcaggaggcggcgatggcggcgtggaacctcggcagcaggcaggcggcgaggatggccgtggaggtgaacgactaccaaccgtccggccccaacaaccgccatgacccgcccaagggtcccgggagagcgtgaacagtgggggggggggggcctgaacccaaggatgcctgcggattcttcgccatcctgctcatccgcggactcgcttggggcggtgacggtctcggtctcggcaccgccatcacaggacatgaccctggcgctctccggaatggagaccgcgccctattcgcgtctgttgttcttggaaccgggctcgacgagggtggccgcgatgcccgggctgctgttgttcctgccgcccaagaacaacta

SEQ ID NO: 18809 - protein, 93 aa, Panicum virgatum
  misc_feature: Ceres CLONE 1802296
  misc_feature: Functional homolog of the protein sequence given in SEQ ID NO 50820
  misc_feature: Useful for making plants with modulated flowering time
MARHAGKPLLALLVLSGLLLLPLVASVPLPRSLRLGNPQQHPPALKLASSQEAAMAAWNLGSRQAARMAVEVNDYQPSGPNNRHDPPKGPGRA

SEQ ID NO: 18810 - DNA, 848 bp, Panicum virgatum
  misc_feature: Ceres CLONE 1802319
  misc_feature: Encodes the peptide sequence at SEQ ID NO. 18811
tccactgcaagcctatagcattggcgctagagcaccattgccgaagagtgggagagtcactcgatcaatagaggagaagcctcttcttctctttgctctgtagtctgtactgcggtttgaggtgattgtggtggtggtgctgggcggctggtggtgatggagcacacccccaaraagaaggctttgctcgtcctcgtcacgttctcctgcctcctcctcctcctccttcctctggcttcctctgctgcgcctctgtccagaagcatgtccttggcgaaccaccggctcccggaccctgccgatgtggaggtccctcttcagggcgcggagcgaaacctcggcgaggtggcggcgaggatggcgatcgaggtcaacgactaccctgggtccggcgccaacaaccgccacgaacccaggagccccgggagagcttgagacctctgcgtcggcgtggggaagaaggagaagaagaagaatatgctagttaaagagagcatggtgttttgaggggtttcgatcagtaggagcactgctagctagctataaactgtagaggttaacgagtcttgtccggtagtttcgccgtcacgtctcggtggcgatggatcgagccttgagctagctagcgtattgggtccgggtcctcgccggcgtcgtcgatcgccgcccactgtcaggtcggccgagtggacagagctagtcgatctctgtggctgcacctcgatctcgacccaagagaaagaagttttcaagtctttctacgtgtataagcatatgtgttgatgtaastctcaagtccgtgtctgtgactctgtttggcagcgtatagtacatgtttgtttcgcgct

SEQ ID NO: 18811 - protein, 56 aa, Panicum virgatum
  misc_feature: Ceres CLONE 1802319
  misc_feature: Functional homolog of the protein sequence given in SEQ ID NO 50820
  misc_feature: Useful for making plants with modulated flowering time
MSLANHRLPDPADVEVPLQGAERNLGEVAARMAIEVNDYPGSGANNRHEPRSPGRA

SEQ ID NO: 18812 - DNA, 853 bp, Panicum virgatum
  misc_feature: Ceres CLONE 1802324
  misc_feature: Encodes the peptide sequence at SEQ ID NO. 18813
aaccccacccccacaacccgctccggccgcctccgcccgatcgatcgcccggagatcgccggaccccgccgcgaatctaacccctgctgcgttcgtagccttcgacgacgatgtcgggagccggagaggaggacaagaagccggcggagggcggcgcccacatcaatctcaaggtcaagggacaggatggcaatgaggtgttcttccgtatcaagaggtccacccagctgaagaagctgatgaacgcctattgtgaccgccagtctgtggacatgaatgccattgcattcctttttgatggccgcaggcttcgcggtgagcagaccccagatgagctggagatggaggacggcgatgagattgacgccatgcttcaccagaccggaggctacatgcctagtgtttagaaagcccttgtcgcagccttgttttgctgcgctgtgcgctctgccttcagtagtaaactaaagaagtcatgaaggaacttgtgaggctctggccctctttgtgccattgctgaaggacatcggtagtcttgtgtttagtaagatttggtactttggcgtgtcatgactcgtttatctatcccctaatatatcctcccctgtgtgtactcccaatgatcgcccatggtttgtttatcctgcttgaagtgcgcattgctttgctgacctggagctgggggtcatggatagttttgtgttgctgaggtgcaggaaatcgtgcgctgcacgtgtcaccactatcatttcgatgtaataagcctgtgatagcttgtgatcaccatgagcaggccatggggatatcatggcttttatatctttatatatatatatatatatatattgtttgc

SEQ ID NO: 18813 - protein, 98 aa, Panicum virgatum; identical to SEQ ID NO: 12258
  misc_feature: Ceres CLONE 1802324
  misc_feature (21)..(91): Pfam Name: ubiquitin Pfam Description: Ubiquitin family

SEQ ID NO: 18814 - DNA, 613 bp, Panicum virgatum
  misc_feature: Ceres CLONE 1802332-R
  misc_feature: Encodes the peptide sequence at SEQ ID NO. 18815
ggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacggcggcggcggctacggcggcgccgcctcgtgctacgggcgccgcgagggcggcggtggctacagcggcggcggcggctacggtggccgtggaggctacggcggcggcggcggctacggcaactccgatgggaactggaggagctgagcggtggggcccgcgtggccaagttatcctgtccttgctactgttacctgagttatcctgtgccatgatctacctgtgtttggtgcctttcgtgttcgttgttgcccatctgtgtttttgatcgcaagctcgttcgtctagtggtcgtgttgttgtctgtcagagctatcttgacctccatcccatgaaccggagcgtgggaattggatgctgttatcttgtgtaacttggtaccgtttcagttaatcgaatggaaaaaaaaggtgctacttggtgctgcc

SEQ ID NO: 18815 - protein, 109 aa, Panicum virgatum
  misc_feature: Ceres CLONE 1802332-R
  misc_feature (1)..(103): Pfam Name: GRP Pfam Description: Glycine rich protein family
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
SRGFGFVTFSSEQAMRDAIEGMNGKELDGRSITVNEAQSRGGPRSGGGGGGYGRREGGGGYGGGGYGGAASCYGRREGGGGYSGGGGYGGRGGYGGGGGYGNSDGNWRS

SEQ ID NO: 18816 - DNA, 132 bp, Panicum virgatum
  misc_feature: Ceres CLONE 1802332
gacggggccacagccctacaagtccgtccacatcccccttagcacgtctccgaacacggagtctcgtcccaaatccctctcgaccacgagaccatcacgtcccgccggtttttgctttgttttcttctcgaa

SEQ ID NO: 18817 - DNA, 1136 bp, Panicum virgatum
  misc_feature: Ceres CLONE 1802344
  misc_feature: Encodes the peptide sequence at SEQ ID NO. 18818
aagccatctgcaagtcaagtctcactagtcactcctaatcctaaaccacaagacaccttggtgttagaagtgcaatgacgaccagcaccatggccctctcctctacggccttcgccggcaaggccgtcaacgtgccatcgtctctctttggcgaggcccgcgtgaccatgcgcaagaccgcggcgaagcccaagccggctgcctccggcagcccgtggtacggcccagaccgcgtgctctacctcggcccgctctccggcgagcccccgagctacctgaccggcgagttccccggcgactacggctgggacaccgccgggctctcggccgaccccgagaccttcgccaagaaccgggagctggaggtgatccactcccgctgggccatgctcggcgcgctcggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcgttgccggcggcccgctcggcgaggtcgtcgacccgctctaccccggcggcagcttcgacccgctcggcctcgccgacgatcccgaggccttcgccgagctcaaggtcaaggagctcaagaacggccgcctcgccatgttctccatgttcggcttcttcgtgcaggccatagtcaccggcaagggcccgcttgagaacctcgccgaccatctcgccgaccccgtcaacaacaacgcctgggcctacgccaccaacttcgtgcccggcaagtgaggggtcggttcccgaactgttcgatctgtaggaggtccggatgtgagcgcgcattggtttcagtttgtaccatgatataaattactgggttccaacttccaaccgagaaggaaattgcttgctgtgttcgttgtctgaactcgaactgctgcatcgcaaataggcagtgctagttatgcctttggcaacgattagacgagaagttctggttatgtctacatcataagagacgcgaagaaaaaaaaatctatgatctgctctattgcc

SEQ ID NO: 18818 - protein, 259 aa, Panicum virgatum; identical to SEQ ID NO: 10184
  misc_feature: Ceres CLONE 1802344
  misc_feature (58)..(226): Pfam Name: Chloroa_b-bind Pfam Description: Chlorophyll A-B binding protein

SEQ ID NO: 18819 - DNA, 880 bp, Panicum virgatum
  misc_feature: Ceres CLONE 1802348
  misc_feature: Encodes the peptide sequence at SEQ ID NO. 18820
gagccaccagatcttttttcacccctgcctctgcctgcctgctgcttccgtctcgcttccggcttctcaggcacgcccccgaccaacccccgccatggcgctcgcttccggcaccctcctcggccgccccgccggcaccgcgcgtccccacctcgcggtctcctcctcctccgcctcgtcgatccggttcccccgcggcggcggcggcggcagggccgtctcgctccgcggctcgtcccctccagcagtagcagcagcagtagcagcaacatctggtagtattgctccagctatttcgttgaccgaaaaggccttgaaacatctgaacaaaatgagggctgaacggaatgaggatctgtgtttgagaattggagtgaaacagggtggctgctctggcatgtcttacaccatggagtttgaaagtcgagcgaatgccagccctgatgattcagttgtagaatatgatgggttcgcaatagtatgtgatccaaagagccttctcttcatgtttggaatggagctggactacagcgacgcacttatcggcggtggcttctccttccagaatccaaatgcgaccaaaacctgtgggtgcggcaaatctttcgcgaccagcaaagaaactgagaccgccgcaactgcttgcaacaactaagatagatccataatcatgccaagcagtgttgtactaagttgtaacatgccatatagcttgcaccagttggattctggtggctataccacgggtgcatacagaagaccataagggtgactcgatttgtaacatattgcattcaacagtctagtacgtattcagcaatatgttactgctgtatgtaacctgtaaactgctcaatagaattcaaagatggttacctcc

SEQ ID NO: 18820 - protein, 186 aa, Panicum virgatum
  misc_feature: Ceres CLONE 1802348
  misc_feature (67)..(159): Pfam Name: Fe-S_biosyn Pfam Description: Iron-sulphur cluster biosynthesis
MALASGTLLGRPAGTARPHLAVSSSSASSIRFPRGGGGGRAVSLRGSSPPAVAAAVAATSGSIAPAISLTEKALKHLNKMRAERNEDLCLRIGVKQGGCSGMSYTMEFESRANASPDDSVVEYDGFAIVCDPKSLLFMFGMELDYSDALIGGGFSFQNPNATKTCGCGKSFATSKETETAATACNN

SEQ ID NO: 18821 - DNA, 998 bp, Panicum virgatum
  misc_feature: Ceres CLONE 1802359
  misc_feature: Encodes the peptide sequence at SEQ ID NO. 18822
aggtgcaaccgtgcaagacgctcccggctccccaccacgacttctccacaagtccatcccgaactctctagacaggcttctcggtcccccctcgcgagccgcggaaatggcgttgccgaatcagcaggtcgtggattacccaagcttcaagctcgtcatcgtcggcgacggtggaactggtaaaaccacatttgtcaaaaggcatcttactggcgagtttgagaagaaatatgaacccaccattggtgttgaagttcaccctctagattttagcaccaactgtggcaaaatccgcttctattgctgggacactgctgggcaagaaaagtttggtggtctcagagatggctactatatccatggtcagtgtgccatcatcatgtttgatgtcacttcaagactgacatacaagaatgtaccaacatggcacagggacttgtgcagggtttgtgagaacattcccatcgtcctctgtggtaacaaggttgatgtgaagaacaggcaggtcaaagccaagcaagttacattccacaggaagaagaacctgcagtactatgaaatttctgcaaagagcaattacaatttcgagaagcccttcctttaccttgcaaggaagctggcaggggaccagaaccttcactttgtcgaggctgttgctctgaaaccaccggaagtgcagcttgatatggccatgcagcaacagcatgaagctgagcttgcggctgctgcggcacaacccctgcctgacgacgatgatgacttgatcgagtagataatatcatggcccttgttgatgcgagaggaaggacttcactataaaaggccgtagtggctcatccttaggaacctggatgttttcttgttatgtgtctgatgagttgagaacgagttatgacatttctggatttgtttttttttttgaaacgatttctggatttgttggtgactgaacccagctcctttcgagcaatacagtgcttgtcatatgcttgcgcgtg

SEQ ID NO: 18822 - protein, 221 aa, Panicum virgatum
  misc_feature: Ceres CLONE 1802359
  misc_feature (15)..(173): Pfam Name: Ras Pfam Description: Ras family
  misc_feature (15)..(128): Pfam Name: Miro Pfam Description: Miro-like protein
  misc_feature: SWISSPROT Homolog: EC 2.7.11.1 Non-specific serine/threonine protein kinase
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQLDMAMQQQHEAELAAAAAQPLPDDDDDLIE

SEQ ID NO: 18823 - DNA, 631 bp, Panicum virgatum
  misc_feature: Ceres CLONE 1802360
  misc_feature: Encodes the peptide sequence at SEQ ID NO. 18824
gcggcggccaagtcggcgacccacgaggccgcgccggcgacccccggcgaggcgctggcggaggcggcggggtcccgcgggtggctgcgcgagtacgtcgaccgcctcgcctcctcggcgtcgtccctctccgggcggtggagcgcgcggtggagccaggggcaccacagcgcgcggtggagccagggccacggccaccacagccgcagccagagccagagccaccagcccgacgactcgtggcggtgggaccccgaggcggcggcgggggcggcgatgcaccgcgcgccggacgaggaggagcccgggttcgtggccctgtaccgttggatcgtcggggtatagccagctgtaattacgggacctcacgagggcgtttttgccaactccttccgtattctttctttctcttctacgtatttaggactccgttgtaaaaacacaacaaacatccaggaccccaaggtgagcgagagtttatcgtctccgaagcttcttccattccgttcatcgatttgttcgttggctgtgtttagatgaggcgaagaggggagaaaaagtcacatcagtcattgtagcacactgtagcacttttcgtttgttcgtggtaaatattgttctactatgacct

SEQ ID NO: 18824 - protein, 114 aa, Panicum virgatum
  misc_feature: Ceres CLONE 1802360
  misc_feature: Functional homolog of the protein sequence given in SEQ ID NO 50821
  misc_feature: Useful for making plants with modulated flowering time
AAAKSATHEAAPATPGEALAEAAGSRGWLREYVDRLASSASSLSGRWSARWSQGHHSARWSQGHGHHSRSQSQSHQPDDSWRWDPEAAAGAAMHRAPDEEEPGFVALYRWIVGV

SEQ ID NO: 18825 - DNA, 976 bp, Panicum virgatum
  misc_feature: Ceres CLONE 1802372
  misc_feature: Encodes the peptide sequence at SEQ ID NO. 18826
acttcgcatcacgcaacgcccccaggcactcgtcacgcacatccaaacccacttcccgatccgacccggaggttcggagcggagatgaagtcgagggcgaggtccagcggagccgactccaggctctccgtgaggaagtccaaggccgagaaggacccgaacaagcccaaaaggcctccgagcgccttcttcgtcttcatggaggagttcaggaaggactacaaggagaagcaccccaatgtcaagcaagtctccgtgattggcaaggctggtggcgacaagtggaagtccctgtccgatgctgagaaagctcccttcgtgtccaaggctgagaagctcaaagctgagtacaccaagaagatggatgcctacaataacaagacggctggaggccctacagcttctggtgactctgacaagtccaagtccgaggtgaacgacgaggatgaggagggtgacgagtgatgcatccatgtctccagccaagtcgtcgcagtcagtagtagggaagtcttcgtcgtcggcctaaccgggcattgctgctccttagcctctggatgctgtcggtctctctagatgtagcagtagtagcttggtagttgcaagtgtcgtccctgaagtgaagcagtttagtggtagtgtgttcgcttcttcggcacttaaccgttgttggaatttatgtcgccctgcagtctgtacttaccccaagcatcagttcctgtttaaatctcagatctgaatagatgagttattttgctgaactgaattctctgtttctcttgtttgcatttctgcttgatgtctactgttcgatgacagcgattctggcctctgggctgttcttggccgtgatgtgagatcgtgaagattaggttgtccatctgaatattttgcagtcatcagtctgattggctgttgttatctggtctcaattgtttcttcctgcaactggatgttggaatgacctgagatgacc

SEQ ID NO: 18826 - protein, 126 aa, Panicum virgatum
  misc_feature: Ceres CLONE 1802372
  misc_feature (28)..(97): Pfam Name: HMG_box Pfam Description: HMG (high mobility group) box
  misc_feature: Functional homolog of the protein sequence given in SEQ ID NO 50397
  misc_feature: Useful for making plants with altered lignin content
  misc_feature: Useful for making plants with altered terpenoid content
  misc_feature: Functional homolog of the protein sequence given in SEQ ID NO 50396
  misc_feature: Useful for making plants with altered alkaloid content
MKSRARSSGADSRLSVRKSKAEKDPNKPKRPPSAFFVFMEEFRKDYKEKHPNVKQVSVIGKAGGDKWKSLSDAEKAPFVSKAEKLKAEYTKKMDAYNNKTAGGPTASGDSDKSKSEVNDEDEEGDE

SEQ ID NO: 18827 - DNA, 700 bp, Panicum virgatum
  misc_feature: Ceres CLONE 1802373
  misc_feature: Encodes the peptide sequence at SEQ ID NO. 18828
gaaactcctatgggaaaacaaggtaaaacaactgtagaggatgaggatgaagaactagcaagggcagttgcagcttccctggaggacaataaacaagtcgttgaaggatcagatgctacagatgacatggctgaagctgaacccgaggaagaaaatgagaccagcttaaatatcaagttggattatcctcctctccctgaagaacctaccggaagcagggaccttctctgcagggttgcgattcggctaccgaacaatcggaggatacaaagaaattttcttcacacagatcctattaagctcctatggtcattctgtgctactcaggttgaggatggggagaagcgggctttccactttgtgcagcccattcctggagcatcaaagaacctggagtttgcaagtgatctcactttcaaagaagctggattggccaactcaatgatcaacctcacgtgggactgagcctgcttccatcttgcgctttgaagccgcggcgtatttcagcctgggcttgaagatggttttagttgttttctttccttgaggcttaactctttatcttgcgctctgctggagcttggagtcagggacaaatctgtggcctgggctgtgtgtggaaatgctcgttttgccgttggttcttgtgtctataaacacccatggtaggacttagctctatttaatgcacatatttgtc

SEQ ID NO: 18828 - protein, 154 aa, Panicum virgatum
  misc_feature: Ceres CLONE 1802373
  misc_feature (72)..(153): Pfam Name: UBX Pfam Description: UBX domain
ETPMGKQGKTTVEDEDEELARAVAASLEDNKQVVEGSDATDDMAEAEPEEENETSLNIKLDYPPLPEEPTGSRDLLCRVAIRLPNNRRIQRNFLHTDPIKLLWSFCATQVEDGEKRAFHFVQPIPGASKNLEFASDLTFKEAGLANSMINLTWD

SEQ ID NO: 18829 - DNA, 472 bp, Panicum virgatum
  misc_feature: Ceres CLONE 1802386
  misc_feature: Encodes the peptide sequence at SEQ ID NO. 18830
cagacaagctcatcatcttcctccttcctgatgaggcaggatcagcagccactgcaggctccacaaaacatctgctacccgccggtgacgatgggagagagaggcgaagaggctgctgcagcggcgcagcagcagcagcagccagggcaggcgcaaccgcaacttcgcatcgggggccttccaccatggatgatcagccacctcaatgcttgaacaggcgacgagcacgtcgaactcgacgctactaccccatgatcaattgccgtgcctatccagcgattgcgagcaactgcgcctgcaaagtggttgctcaccgttgagtcctagcataagttcatggcagcgattaagctaaactattgttatgtttgcaacaagaagggtaagcactgtataatcttgtccagcatgtgtgtatcaactgatgcatgccccctatatgtgtgagaaccgcccaatttgatactatttt

SEQ ID NO: 18830 - protein, 70 aa, Panicum virgatum
  misc_feature: Ceres CLONE 1802386
  misc_feature: Functional homolog of the protein sequence given in SEQ ID NO 50822
  misc_feature: Useful for biocontainment applications
  misc_feature: Useful for making plants with modulated flowering time
  misc_feature: The sequence is a functional homolog of SEQ ID NO 731 in the 10/666,642 US patent application
QTSSSSSSFLMRQDQQPLQAPQNICYPPVTMGERGEEAAAAAQQQQQPGQAQPQLRIGGLPPWMISHLNA

SEQ ID NO: 18831 - DNA, 981 bp, Panicum virgatum
  misc_feature: Ceres CLONE 1802406
  misc_feature: Encodes the peptide sequence at SEQ ID NO. 18832
acacacacatcgaactatccaaactttcaccagcgtagtaagtcgttgccatggccaagacggtgttgctccccgtgctcctctccttcctcctccccttcgcctccctcgctctgacgcaggacttctgcgtcgctgacctctcctgcagcgacacgccgtccggctacccgtgcaagtctagcgtcaccgccaacgacttctactaccacggcctggctgccaaaggcaaaatcaacgacctcatcaaggccgccgtgacgcctgccttcgtcggccagttcccgggcgtcaacgggctcggcatctccgcggccaggctcgacatggaggtgggtggcgtcgtgcctctgcacacccacccggctggctccgagctcctctttgtcacccagggcaccgtcgccgctggcttcatcagctccggagcgaacaccccctacaccaagacgctgtaccccggcgacatcatggtgttcccacaaggattgctccactaccagtacaacgccggcactggccctgcagtggcgctcgttgccttcagcagccctaaccccggcctgcagatcaccgacttcgcgctcttcgccaacaaccttccgtcggccgtcgtcgagaaggtcaccttcttggacgacgcgacggtgaagaagctcaagagtgtgctcggcggcagcggctaagttgctcaagagttgagcaagctcgtcaactgatcgtggtcttggtcgtcgcttgtgcgtgtatgcatgatcgaacatgtcgtcatttcatcaaagtcatgtggtcttttcaagttaatctttgactctttgttcatgttatcttcattatccaaggttgtcttcgattagcatagttgtaattgttgaaggatgaacgactgatttgtggtaaatcaccaagaatcagagattttcagtcgtattgtagtatccgtcagccccaataattatatatcccaccataattgtcatt

SEQ ID NO: 18832 - protein, 211 aa, Panicum virgatum
  misc_feature: Ceres CLONE 1802406
  misc_feature (54)..(201): Pfam Name: Cupin_1 Pfam Description: Cupin
  misc_feature: SWISSPROT Homolog: EC 1.15.1.1 Superoxide dismutase
  misc_feature: Functional homolog of the protein sequence given in SEQ ID NO 50823
  misc_feature: Useful for making plants with modulated nitrogen use efficiency
MAKTVLLPVLLSFLLPFASLALTQDFCVADLSCSDTPSGYPCKSSVTANDFYYHGLAAKGKINDLIKAAVTPAFVGQFPGVNGLGISAARLDMEVGGVVPLHTHPAGSELLFVTQGTVAAGFISSGANTPYTKTLYPGDIMVFPQGLLHYQYNAGTGPAVALVAFSSPNPGLQITDFALFANNLPSAVVEKVTFLDDATVKKLKSVLGGSG

SEQ ID NO: 18833 - DNA, 657 bp, Panicum virgatum
  misc_feature: Ceres CLONE 1802407
  misc_feature: Encodes the peptide sequence at SEQ ID NO. 18834
attcccatcccttgctacctgcatccatcgaccttagcgagctcacagttcaatcaggtccggttcggcttcaggccgggctcgtcaccgaggagatggcgctctctcgccgcatggccgcgccggttctcgtcttcctgctcctcctcgtcgccacaggtacactgccaacagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcctctcgtctcttgttctctttacctggaataaattaaactcggtgctggtgtctggtgatgcctgtgcgtgtggaacatctcactgttgttctgcacccgtatgcactccattattagtgtagtaggcaagatgatgtaaggtcctcctttcaacattgatgtaataatgtgatgcagcttcgtgctagttcagctt

SEQ ID NO: 18834 - protein, 85 aa, Panicum virgatum
  misc_feature: Ceres CLONE 1802407
  misc_feature (37)..(85): Pfam Name: Gamma-thionin Pfam Description: Gamma-thionin family
MALSRRMAAPVLVFLLLLVATGTLPTEMGPATVAEARHCLSQSHHFKGLCVSSSNCANVCRTENFPGGECKTEGATRKCFCKRIC

SEQ ID NO: 18835 - DNA, 621 bp, Panicum virgatum
  misc_feature: Ceres CLONE 1802415-R
  misc_feature: Encodes the peptide sequence at SEQ ID NO. 18836
cgcgccatggccaccgggtctctgtccgccgtcgcgtggccgctgtcggtcgccgggctcaggaagccgctcggcgccgcggcgtcgtcgttccagcccttgcagccgagggcgaggccggccgccaggatggccgtgcgggcgtcggcggcgtccatgaaggagaaggcggcggccgggctgaccgcggcggccgtggcggcggctctcgtgctgcctgacgtcgctgaggccgcgcagtccgggctgacgctgtcgctcaagaacttcctgctcagcatcgtgtccggcggggtcgtcctcgtggccatcgtcggtgccgttgtcgccgtctccaactttgacccggtcaagcgggcctgagggatcattcgttcgttaggaggcacgtctccccctgtatcatgtatccagcggtaaaccgttttgtgttattttggagaatgttcgaacttatttatgatacggagttcgagttaaaccatcgttgctttttgttcaatttatgcgattttgatgcttcgatgcgtgcatgctgtataaagttttaaaggtgtttgtactgatgttttactttggaagttcttattattatattggaagattattaggaacatgcag

SEQ ID NO: 18836 - protein, 118 aa, Panicum virgatum
  misc_feature: Ceres CLONE 1802415-R
  misc_feature (81)..(118): Pfam Name: PsbX Pfam Description: Photosystem II reaction centre X protein (PsbX)
  misc_feature: Functional homolog of the protein sequence given in SEQ ID NO 50416
  misc_feature: Useful for making plants with modulated nitrogen use efficiency
MATGSLSAVAWPLSVAGLRKPLGAAASSFQPLQPRARPAARMAVRASAASMKEKAAAGLTAAAVAAALVLPDVAEAAQSGLTLSLKNFLLSIVSGGVVLVAIVGAVVAVSNFDPVKRA

SEQ ID NO: 18837 - DNA, 433 bp, Panicum virgatum
  misc_feature: Ceres CLONE 1802415
tcatgaagccgctcgtcgccgcggggacatcgctccaggccctgcagccgatggcgaggccggacgctatgatggccgaggggggatcggtggcgtccctgactgagaaagacgcagtgcgtctgactgcggcggccctggcagcggctctcgcgttgcctgacgtcgctgatgccgcgcaggcagggctgacgccggcactcaagaatgttactgctcacgtgtcgagtccggaggggtcttcgttgtggtcatcgtcagagccggcgtcgacatctccatgctttgacccgtgtcgagcgggcctgatggatcctttgttggttaggaggcacggctccccctgtatcatttgtcccgcgtctaaccgatatatgttattatggacaatgaacaatcttagttatgatgcggagttctagtgaaagcatcc

SEQ ID NO: 18838 - DNA, 912 bp, Panicum virgatum
  misc_feature: Ceres CLONE 1802430
  misc_feature: Encodes the peptide sequence at SEQ ID NO. 18839
atgctcagatcccactctttttgttgctgcctagctagcccgtctatcttctttcctgcgagcattgcattggcaattgaacaaccaccggcaggctccaaccctttctacctccgccatccatcatcagtttctcccatccctgtcaaagtcaccacaaagcaaaatgggctcggagacagacacggtcaccgtggaaggcatcccgttcccggcggagatcacattcaccgccgccaaccctgctctgaccctcgtagctaacggcatcacggacatcgagatccacttcctgcagatcaagtacaacgccatcggcatctacctccacaacagcgacgtcctgctcgaccacctgcacggctggaagggcaagtcggccgacgagctgctcggagacgacgccttcttccaggccctcgtcgcggctcccgtggagaagctgttccgggtcgtcgtcatcaaggagatcaagggctcgcagtacggcgtgcagctcgagagctccgtgcgcgaccgcctcgttgccgccgacaagtacgaggaggaggaggaggcggcggtcgagaagatcaccgacttcttccaggccaagtacttcaagcctggctacgtcatcaccttccacttcccggccacttcagcagctggggctgcggagatatcgttcgcgacggagggcaaggacgaggccaagatgaaggttgagaacgagaacgtggccaggatgatccagaagtggtacctcggcggcgactccgcggtgtctccgaccaccgtccggagcctggcagatcgtttcgcggcgctgctttccgccgccgcctgatcaatttgctgcggatgctaattacgtaataatttccagcttccaccggaattgaactcgttattaataaattattatgtccc

SEQ ID NO: 18839 - protein, 220 aa, Panicum virgatum
  misc_feature: Ceres CLONE 1802430
  misc_feature (3)..(217): Pfam Name: Chalcone Pfam Description: Chalcone-flavanone isomerase
  misc_feature: SWISSPROT Homolog: EC 5.5.1.6 Chalcone isomerase
MGSETDTVTVEGIPFPAEITFTAANPALTLVANGITDIEIHFLQIKYNAIGIYLHNSDVLLDHLHGWKGKSADELLGDDAFFQALVAAPVEKLFRVVVIKEIKGSQYGVQLESSVRDRLVAADKYEEEEEAAVEKITDFFQAKYFKPGYVITFHFPATSAAGAAEISFATEGKDEAKMKVENENVARMIQKWYLGGDSAVSPTTVRSLADRFAALLSAAA

SEQ ID NO: 18840 - DNA, 753 bp, Panicum virgatum
  misc_feature: Ceres CLONE 1802439
  misc_feature: Encodes the peptide sequence at SEQ ID NO. 18841
agccgtccgcccctgaatccccaaccttctccgccgccgccggcacgcaccgcgcagtctccagaggaatcggaggggggcgagcgatggaggaggactcgccgctgacgaagacggtgaagggcgccgtgacggggctagccgcggggaccatctggggcaccgtcgtcgccacctggtacgacgtgccccgggtggagcgccacgtcgcgctcccggggctcatccggacgctcaagatgtgcgggacctacggggccaccttcgccaccatcggcgggctctacatcggcgtcgagcagctcgtgcagagccagcgcaagaagcgcgacttcgtcaacggggccgtcggcgcgttcgtcgccggagcctccgtctgcggctacagaggaaagagcattcagtctgccctcatcggaggctcctgcctggcgttcacatctgctgtgctggacattggtggcaatacaacgagagtggacaacggcaaagagtactatccctacacaaccgagaagaagtcccctcattgatttaagcttgtgtacttgtagcacaaatctttcaaggcatcagctcagtgaattttaaagctgatgcgcgtttttatgtctgttttgctgatgcacttagttcctctgcaaatccatggcaacttgtttgcctctgatcgagagggacgaacataacgttcaaaataaatctttgatttcctttcttgttatcgtcgacgacagtaaacacacgtggcac

SEQ ID NO: 18841 - protein, 148 aa, Panicum virgatum
  misc_feature: Ceres CLONE 1802439
  misc_feature (2)..(129): Pfam Name: Tim17 Pfam Description: Tim17/Tim22/Tim23 family
MEEDSPLTKTVKGAVTGLAAGTIWGTVVATWYDVPRVERHVALPGLIRTLKMCGTYGATFATIGGLYIGVEQLVQSQRKKRDFVNGAVGAFVAGASVCGYRGKSIQSALIGGSCLAFTSAVLDIGGNTTRVDNGKEYYPYTTEKKSPH

SEQ ID NO: 18842 - DNA, 849 bp, Panicum virgatum
  misc_feature: Ceres CLONE 1802467
  misc_feature: Encodes the peptide sequence at SEQ ID NO. 18843
caggccaccagcgtgcggagcgcatcaccaccacctacacggctacacggcaacactagacagctcgtagcgcaggagtaggtagagctcaggtgtgcaagctacaatggcgtccaagaccgagctggtggtggaggtgaagtccccggcggacaagctgtgggcggcgctgcgcgactccacggagctgttccccaggatcttcccccagcagtaccagagcatcgagaccgtcgagggcgacggcaagtccgccggcaccgtccgcctcctcaagtacaccgagggggtgccgatgctgacgttcgccaaggagaaggtggagctggcggacgacgagaacaaggtggtgtcgtacagcgtggtggacggcgagctggtgagcttctacaagaacatgaagatcacgctgaaggtgtcccccgccgccaaggagggcgaggccggcgccgtcgtcaactggtccatggagttcgacaaggccaacgaccaggtgcccgacccggacgtcatcaaggagaccgccaccaagacgttccacgacctcgacgactacctcctcaagaactagcaggcagccggcgcgcggcgggggtcgtccgaccgccgaggcatcggcggtcggtcgcggtcgttgagcacgctagctagtgcatgtcgttggtggtggtgtccgagtccgtgttggtgttggtgttggtgtcatagctacggcgggccgtgtcctcgaattgtctccggttgatgttgctgcggcgatcatgtgcgtctgcactctgcagatggcaatctagtcccagtcaataataaagctatacgtgtgtcatcgtgcacccgatgagttgcttc

SEQ ID NO: 18843 - protein, 154 aa, Panicum virgatum
  misc_feature: Ceres CLONE 1802467
  misc_feature (1)..(154): Pfam Name: Bet_v_I Pfam Description: Pathogenesis-related protein Bet v I family
MASKTELVVEVKSPADKLWAALRDSTELFPRIFPQQYQSIETVEGDGKSAGTVRLLKYTEGVPMLTFAKEKVELADDENKVVSYSVVDGELVSFYKNMKITLKVSPAAKEGEAGAVVNWSMEFDKANDQVPDPDVIKETATKTFHDLDDYLLKN

SEQ ID NO: 18844 - DNA, 861 bp, Panicum virgatum
  misc_feature: Ceres CLONE 1802468
  misc_feature: Encodes the peptide sequence at SEQ ID NO. 18845
gagcttatcgcttatcatctgcgcctccccatctctcccctgctcctccgcttcctcgtgatccatccaaaccagaggtagctatgtcggattccgaggagcaccacttcgagtcgaaggccgacgctggggcgtccaagacctacccgcagcaggctggtaccatccgcaagaacggcttcatcgtcatcaagggccgcccctgcaaggtggtggaggtttctacctcaaagactggtaagcacggtcatgctaaatgccactttgttgctatcgacatattcaatgggaaaaagcttgaagatattgtcccgtcttcccataattgtgatgtgccacatgtgaaccgcactgagtaccagctgattgacatatctgaggatggatttgtgagccttcttacttctgatggcaacaccaaggacgatcttagactcccaactgatgagactctcctgggtcagatcaaagaaggatttgacagcgggaaggaccttgtggtgactgtccagtcctccatgggggaggagcagatctgcgcgctgaaggatgttggccccaagtagcttccctaaagaaggcctggaacagagggagcaactgtatctcaaaacttaaatcgaaaaaggcgtgtatcgccacgaaggattggtaccgagacattcaccctagcttgagctggcttttgctgtagtaaactcaagtgcagtgattgctgggcgtggcatcgtatctgactatcattatctctgtggttacatttgggaccctgtattttctatggttttatgccctctgcttagtatcaataataaatattggtttggaacggttgaattgcatttgcttggattttttccc

SEQ ID NO: 18845 - protein, 160 aa, Panicum virgatum
  misc_feature: Ceres CLONE 1802468
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTDETLLGQIKEGFDSGKDLVVTVQSSMGEEQICALKDVGPK

SEQ ID NO: 18846 - DNA, 1028 bp, Panicum virgatum
  misc_feature: Ceres CLONE 1802469
  misc_feature: Encodes the peptide sequence at SEQ ID NO. 18847
gcagcaagccacagctcaacttcatcagcgagttgcagcagagatcgagatggagatccgcggcatgggcaccaccgccgtcctcgctctcctcgtcgccggcctcgccgccgccgccgccgcgaggccctcccacgccggcgccatcatccgtctccccaccagcggcggcggccggccgtgggagtgctgcgacttcgtcgtgcgggacccggacttccggccgccgcggtggcagtgcaacgacgtggcggccgagtgccccgccgcctgcagccggtgcgaggaggcgccgggcgacggcggcggctacgtgtgccgcgactgggtcgtgagcctgctcgagccgcccgtgtgcacgccgaggccgtgggactgctgcgacgccgccgtctgcaccagggagtacatccccttctgccgctgcgccgacgaggtggaggcgtgccccagcaactgcagcgtgtgcgagctggcggaggcggacccgccccgctaccgctgcctcgaccagttccacggctaccctgggcccaagtgcacgccgttgccgtggatgggcaactagcccagcacgtacacgcccgatcagctatatctacggacacgtacgtacgcccacaaataaataaaattagctactgtagcaagtgattgttcatccgacgtggacaattagctaccctgctcgctagctcctactgtatttcgtgcaactcaataagagacgtggccaagtagacctcggtcccaagtgcagatcagagtggagatagatatgatcaaccgactacagtactacactactactgcccgttgatccattgtgcaagtacgtactccctcgtactaatgcgtccatgcgacaccgtgttgtgggccgcgaacgatgtgggctgtctactcgtgcattttagatgtactccagatgtgtgttgggctgaaccgatttttctcagccttgttagttcttgcacgtgtttttcctgcttttcggtggagtgaaggcaacatttcaattttcaagc

SEQ ID NO: 18847 - protein, 172 aa, Panicum virgatum
  misc_feature: Ceres CLONE 1802469
  misc_feature (136)..(160): Pfam Name: Bowman-Birk_leg Pfam Description: Bowman-Birk serine protease inhibitor family
  misc_feature (110)..(134): Pfam Name: Bowman-Birk_leg Pfam Description: Bowman-Birk serine protease inhibitor family
MEIRGMGTTAVLALLVAGLAAAAAARPSHAGAIIRLPTSGGGRPWECCDFVVRDPDFRPPRWQCNDVAAECPAACSRCEEAPGDGGGYVCRDWVVSLLEPPVCTPRPWDCCDAAVCTREYIPFCRCADEVEACPSNCSVCELAEADPPRYRCLDQFHGYPGPKCTPLPWMGN

SEQ ID NO: 18848 - DNA, 844 bp, Panicum virgatum
  misc_feature: Ceres CLONE 1802473
  misc_feature: Encodes the peptide sequence at SEQ ID NO. 18849
attgccccagcatcatcctgccgccgcgcgccccagcttcgaagccgccgccagctcctccaagagctagtaattaagccgatggccatggccacgcaagcctccgccgcgacgcgccacctgctggcggcggcctggtcgccggtgaaggcgccgcggtcgtcgcagctcgcgctcccgtcgccctcccgcgggccggccccgctccgcgcggccgccggggagcccgcggcggcgaccgaggaggcgcccaaggggttcgtgcccccgcagctggaccccaacacgccgtccccgatcttcggcggcagcacggggggcctgctccgcaaggcgcaggtggaggagttctacgtgatcacgtggacgtcccccaaggagcaggtgttcgagatgccgacgggcggcgccgccatcatgcgggacggccccaacctcctgaagctggcgcgcaaggagcagtgcctggcgctgggcaccaggctgcgctccaagtacaagatcaactaccagttctaccgcgtcttccccaacggcgaggtccagtacctgcaccccaaggacggcgtctacccggagaaggtcaacgccggcaggcagggcgtcggccagaacttccgcagcatcggcaagaacgtcagccccatcgaggtcaagttcaccggcaagaccaccttcgacctgtgatgtgtcgtcgttactattaactgttgccccggtggttgatggatatgtaattttactatcaagcttcccttggtgattgtggagaggtgttgtatggaatcccttaattatatgtacatgtttatttggtgatgcgatgctgcccatgttaacctcg

SEQ ID NO: 18849 - protein, 201 aa, Panicum virgatum
  misc_feature: Ceres CLONE 1802473
  misc_feature (63)..(200): Pfam Name: PsaD Pfam Description: PsaD
MAMATQASAATRHLLAAAWSPVKAPRSSQLALPSPSRGPAPLRAAAGEPAAATEEAPKGFVPPQLDPNTPSPIFGGSTGGLLRKAQVEEFYVITWTSPKEQVFEMPTGGAAIMRDGPNLLKLARKEQCLALGTRLRSKYKINYQFYRVFPNGEVQYLHPKDGVYPEKVNAGRQGVGQNFRSIGKNVSPIEVKFTGKTTFDL

SEQ ID NO: 18850 - DNA, 678 bp, Panicum virgatum
  misc_feature: Ceres CLONE 1802501
  misc_feature: Encodes the peptide sequence at SEQ ID NO. 18851
gcagcggcaatccggctccagcagtaggccggagccagccgttccggtgccgcccaggtcctggggattgggtgtagggatcggggaccggaatggggaagcgggtcctcgccgccgtgctcctcgtcgcggctctcgcctgcggcggcgcccacgccaagttcgacaggcacagcttccccaagggcttcgtcttcggcaccggctccgcggcgtaccagtacgagggcgcctacaaggaaggaggcaaagggctcagtatatgggacaacttcactcacatcccaggaaaaatcatgaacaacgataatggcgacgtggcagaggacatgtaccatcgatacaaggaggatgtgcaactcctcaaggacatgaacttggacgccttccgcttctccatcgcctggaccaggatcctgccaagttagcaytgctcagctctcaacgcacagcctcccatcgccaataactgctgttttatgaacccagcattatgcatggtccccgggatagtgatgtcacacccggttttaagaacaaaaccgaatgcataactatatgtatgccaggatcaagtttcatacatatagagacatcataagtgaataatcagtaacagtatcacgaaaagaaaactaaacaaataaaagactatcagagttatacagcttatcctgg

SEQ ID NO: 18851 - protein, 111 aa, Panicum virgatum
  misc_feature: Ceres CLONE 1802501
  misc_feature: SWISSPROT Homolog: EC 3.2.1.21 Beta-glucosidase
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50615
  misc_feature: Useful for making plants with modulated biomass
  misc_feature: Functional homolog of the protein sequence given in SEQ ID NO 50359
  misc_feature: Useful for making plants with altered cell wall content and/or composition
  misc_feature: Functional homolog of the protein sequence given in SEQ ID NO 50360
  misc_feature: Useful for making plants with modulated flowering time
MGKRVLAAVLLVAALACGGAHAKFDRHSFPKGFVFGTGSAAYQYEGAYKEGGKGLSIWDNFTHIPGKIMNNDNGDVAEDMYHRYKEDVQLLKDMNLDAFRFSIAWTRILPS

SEQ ID NO: 18852 - DNA, 1023 bp, Panicum virgatum
  misc_feature: Ceres CLONE 1802506
  misc_feature: Encodes the peptide sequence at SEQ ID NO. 18853
cattgagcgttataaagatgatcttttgagtacttctacaaaggcctcaggtgaatcacatggtgtagctgagcttggtgcaattctggctgctgcatgcctttgcaagaaggatcacattacatctaaagaatcaatacgagctgacaagacattgtctgtatggtacaataatataccttttaggatgcatcactctgctaggcaacttctggaattggagttggaagaacatgatggattcagtgagaaactgcttaaactattcgttacatataagtgtgatggaacctacttcatcgagacagaagagggcacttctggttttgatgtcaaagttgatcacaagggtggccatgattttcgtgtagatgctgctggtctgcaaactgatgtgactctagcttattattcaaaggataatagcaaacatatacacatctggcatgggaagcaccactaccattatagacagactctgagagctgagcacgtagctgatgatagctcccagcctagtcatgcttctgaggggaagtcacatccaaaaggcagtgttctggcaccgatggctggtttggttgtgaaggttttgcttgaagatggggcacaggtggaggcgggacagcctgtcatggttatggaagcaatgaagatggagcatgtggtgaaggcgccgcgtgctggatatgtagagggcctgaaggtcactgctggccaacaagtttttgattccagtgtcctcttcacaatcaaggacaactctgcaaactgagagggagcgaatacagtcctgccgtggagataagataggaaagaaaattgaaggaataaatatctgggatccatctgcgggcgagcaaccagctcggccattatctccctgcccgatccggtcgaacccaacattcgcccaacgattccattacgctacgtacatgaaactggtgtcgcattgtaaatgatgaaagggaataagcaaatggaagccgattagtttttctgccagcggcaggcacgcac

SEQ ID NO: 18853 - protein, 257 aa, Panicum virgatum
  misc_feature: Ceres CLONE 1802506
  misc_feature (184)..(251): Pfam Name: Biotin_lipoyl Pfam Description: Biotin-requiring enzyme
  misc_feature: SWISSPROT Homolog: EC 6.4.1.4 Methylcrotonoyl-CoA carboxylase
IERYKDDLLSTSTKASGESHGVAELGAILAAACLCKKDHITSKESIRADKTLSVWYNNIPFRMHHSARQLLELELEEHDGFSEKLLKLFVTYKCDGTYFIETEEGTSGFDVKVDHKGGHDFRVDAAGLQTDVTLAYYSKDNSKHIHIWHGKHHYHYRQTLRAEHVADDSSQPSHASEGKSHPKGSVLAPMAGLVVKVLLEDGAQVEAGQPVMVMEAMKMEHVVKAPRAGYVEGLKVTAGQQVFDSSVLFTIKDNSAN

SEQ ID NO: 18854 - DNA, 630 bp, Panicum virgatum
  misc_feature: Ceres CLONE 1802524
  misc_feature: Encodes the peptide sequence at SEQ ID NO. 18855
accaaacccgcagcgcccgtccatcgacgagactacctccccggcgagagagaaggggagacagtgaccgatggaggcggcggcggcagcggcagcggcagcggccggcgtgcagctcggctcctccaagccccagatcgccacgcaggaggagatggcggaggcccgggtgccgctcgcctaccgcgaccagtgcgcgcacctcctcatcccgctcaacaagcgccgcgtctccgactgctacctcccatggaagtgcgagcccgagcgccacgcctacaagaagtgcccgtaccagctcttcatggagccgatgctccatatgcacaggatccgcgaggcgcccgacgccaacgtctagggcggcgcctccctccgcctcatcccggccaccgccaacctcgcctgatccggccccgctcccatccggttgatttaggtctgctggttatcacagcgtgcagaggcattgtgcaagaatcctgaatgtttgttgtatgaacaaacatctgttgaatttggcataaagttaactgttgtcttctccccctccaccttttctccttgatgggcatcttcaagtttcatttgatggaataacgaaacctactgtcctacgcccgaagaccg

SEQ ID NO: 18855 - protein, 96 aa, Panicum virgatum
  misc_feature: Ceres CLONE 1802524
  misc_feature (1)..(94): Pfam Name: NDUF_B7 Pfam Description: NADH-ubiquinone oxidoreductase B18 subunit (NDUFB7)
MEAAAAAAAAAAGVQLGSSKPQIATQEEMAEARVPLAYRDQCAHLLIPLNKRRVSDCYLPWKCEPERHAYKKCPYQLFMEPMLHMHRIREAPDANV

SEQ ID NO: 18856 - DNA, 782 bp, Panicum virgatum
  misc_feature: Ceres CLONE 1802534
  misc_feature: Encodes the peptide sequence at SEQ ID NO. 18857
gctttcttgccacccctcgccgccgccgcagacgcctcccatccgcctcgaggcttccgctcgccggtcccagccatggtgaagtactcgagggagccgaccaaccccaccaagtccgccaaggccatgggccgggacctccgtgttcacttcaagaacacccgtgagacagcttttgccctcaggaaattgccactcactaaggccaaaaggtaccttgaggatgtgattgcccacaagcaggccatccccttccgcaggtactgtggcggtgttgggcgtactgctcaggctaagtcgcaccactcaaatggacagggacgctggcccgtcaagtctgctagattcattcttgatcttctaaagaatgctgagagcaatgctgaggtcaaaggtctcgatgtcgataccctgtatgtgtctcacattcaagtgaaccaggctcagaagcagcggcgcaggacctaccgtgcccatggacgcatcaacccttacatgtcctccccgtgccacattgagctgatcttgtcggagaaggaagagccagtgaagaaagaggcggagtctcagattgcgaccaggaaggcttaaggaagggagctccgcagttttagagtgggttgtaggttgtcgttgcctaattgaaaattttggctggttatctgtcgcctcctttatcagtgtactgctagctcgttctgtcaccttgatcagtttctgtactgcctatgcaattcgaagctatgaatgaagtgtttgtggattctttccatatttatatt

SEQ ID NO: 18857 - protein, 171 aa, Panicum virgatum
  misc_feature: Ceres CLONE 1802534
  misc_feature (17)..(153): Pfam Name: Ribosomal_L22 Pfam Description: Ribosomal protein L22p/L17e
MVKYSREPTNPTKSAKAMGRDLRVHFKNTRETAFALRKLPLTKAKRYLEDVIAHKQAIPFRRYCGGVGRTAQAKSHHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 18858 - DNA, 705 bp, Panicum virgatum
  misc_feature: Ceres CLONE 1802550
  misc_feature: Encodes the peptide sequence at SEQ ID NO. 18859
acgcacgttctccccggaacactagctagcaccggtcacagcaccaaccgtaccgccatggcctccctcgccgccgtctccgtgcagccggtcgccgtaaagggcctcgccggcagctccatctccggcaggaggctcgccgccgctaggccgtcgcgcgccggcgcctgccgctccgcccgcaggccccgcggcgccgccgtggtggccaagtacggcgacaagagcgtctacttcgacctcgacgacatcggcaacaccaccgggcagtgggacctctacggctccgacgcgccctcgccctacaacccgctccagagcaagttcttcgagacgttcgcggggccgttcaccaagaggggcctgctgctcaagttcctgctgctgggcggcgggtcgctgctggcctacgtcagcgcgtcggcgtcgccggacctgctgccgatcaagaaggggccgcagcagccgccgcagccggggccgcgcggcaagatctaagctcagttgttccttctcctccatctgtctctactagctgcttgcttgtaccaccattggctccggacgccatggatcgtcgtccctgctgcctgttgtgctgctgatatttgatcgcgctgcctgtttatcgatgttgatactgttgtatttatactctggcatacgattacaaatttacaatggtgttgcgtacgtgcttacctt

SEQ ID NO: 18859 - protein, 146 aa, Panicum virgatum; identical to SEQ ID NO: 14493
  misc_feature: Ceres CLONE 1802550
  misc_feature (5)..(146): Pfam Name: PSI_PsaH Pfam Description: Photosystem I reaction centre subunit VI

SEQ ID NO: 18860 - DNA, 909 bp, Panicum virgatum
  misc_feature: Ceres CLONE 1802555
  misc_feature: Encodes the peptide sequence at SEQ ID NO. 18861
attcgcaaagctccaacagcaatcaagctagcgagaagctacgacaagaagccagcaagcggcgagatcactcggatcaaagtgatccatggggccgaggaggtcgacttcgccggccgggagcagcgggggcagcggcgcagagcagcagccgaggctgcgcggcgtgcggaagcggccgtggggccggtacgcggcggagatccgagaccccgtgcgcaaggcgcgcgtgtggctcggcaccttcgacacgcccgaggaggcggcgcgcgcctacgacgccgccgcgcgcaggctccgcgggcccggcgccgccaccaactaccccgcccagggcgcaaaggcaccggcggcgagcgcgagcgggagcatcgggttgtcggtggacgcgtcgtcatcctgctcctcccgggactcgccgcgggcggtgacggcgtccgtcgcggcgcccccgtcgctggacctgagcctggcgctcccggccatggtgaccacaccgtcgtcgcaccacgtgttcatggacccggcctcgacgatggtggccgtggcgccggcgctgctgcagttcctgccgcccaagagcgaggaagagcagagcttgtcagggtcgtcctcgtggtcgtcgtcggtggtgttcgacgcggcgccggccgtgggccggggcctggacctcaacctggcgctgccggccgggatggtgatgtagagacggacaaatcgtttggtcaatttagctcctaggctcctagctcactcaacgatccagatgttggtcaggtgtgaataggcggcagagatttgtttgtgcatcttcgcagccttcgtttctttactttctttgtactggcagattttgcgtctcgcaatgatgcgccaccgcaagaacgaagaaactttttcctcagcctc

SEQ ID NO: 18861 - protein, 205 aa, Panicum virgatum
  misc_feature: Ceres CLONE 1802555
  misc_feature (22)..(73): Pfam Name: AP2 Pfam Description: AP2 domain
  misc_feature: Functional homolog of the protein sequence given in SEQ ID NO 50824
  misc_feature: Useful for making plants with altered alkaloid content
  misc_feature: Functional homolog of the protein sequence given in SEQ ID NO 50343
  misc_feature: Useful for making plants with altered carbohydrate content
  misc_feature: The sequence is a functional homolog of SEQ ID NO 1435 in the 11/479,226 US patent application
  misc_feature: The sequence is a functional homolog of SEQ ID NO 2504 in the 10/374,780 US patent application
  misc_feature: The sequence is a functional homolog of SEQ ID NO 618 in the 10/225,066 US patent application
  misc_feature: The sequence is a functional homolog of SEQ ID NO 674 in the 10/412,699 US patent application
  misc_feature: The sequence is a functional homolog of SEQ ID NO 1157 in the 10/374,780 US patent application
  misc_feature: The sequence is a functional homolog of SEQ ID NO 1360 in the 10/412,699 US patent application
  misc_feature: Functional homolog of the protein sequence given in SEQ ID NO 50249
  misc_feature: Useful for making plants with altered lignin content
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: Functional homolog of the protein sequence given in SEQ ID NO 50825
  misc_feature: Useful for making plants with altered cell wall content and/or composition
  misc_feature: Useful for making plants with altered terpenoid content
  misc_feature: Useful for making plants with modulated biomass
  misc_feature: The sequence is a functional homolog of SEQ ID NO 16 in the 10/903,236 US patent application
  misc_feature: The sequence is a functional homolog of SEQ ID NO 2209 in the 10/666,642 US patent application
  misc_feature: The sequence is a functional homolog of SEQ ID NO 76 in the 10/714,887 US patent application
  misc_feature: The sequence is a functional homolog of SEQ ID NO 76 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 1462 in the 10/666,642 US patent application
  misc_feature: The sequence is a functional homolog of SEQ ID NO 2134 in the 10/374,780 US patent application
  misc_feature: The sequence is a functional homolog of SEQ ID NO 34 in the 10/714,887 US patent application
  misc_feature: The sequence is a functional homolog of SEQ ID NO 34 in the 11/435,388 US patent application
  misc_feature: The sequence is a functional homolog of SEQ ID NO 364 in the 10/225,066 US patent application
  misc_feature: The sequence is a functional homolog of SEQ ID NO 4 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MGPRRSTSPAGSSGGSGAEQQPRLRGVRKRPWGRYAAEIRDPVRKARVWLGTFDTPEEAARAYDAAARRLRGPGAATNYPAQGAKAPAASASGSIGLSVDASSSCSSRDSPRAVTASVAAPPSLDLSLALPAMVTTPSSHHVFMDPASTMVAVAPALLQFLPPKSEEEQSLSGSSSWSSSVVFDAAPAVGRGLDLNLALPAGMVM

SEQ ID NO: 18862 - DNA, 942 bp, Panicum virgatum
  misc_feature: Ceres CLONE 1802567
  misc_feature: Encodes the peptide sequence at SEQ ID NO. 18863
agagtcgggagtcctccattctccagcgaccatctcaatggcggcggctgctacctccttcgctaccctcgccatcgcgcggccggcgacggcagcggcggcggcatccgggcagcgggccctccacgcctccaaggcctcctcgccgctcctatcctcccgcggtgcccgcctcccacagccgcgcgcgcttcgtcacatccgccagcgccgaacccaaggaagcagaaatccagtccaaaatcacaaacaaggtgtactttgacataagcatcgggaaccctgtggggaagaatgttgggaggattgtcatcggcttgtatggggatgatgttccccaaacagcagagaacttccgtgctctttgcactggagagaaagggtttggatacaagggatccagtttccaccgtgtcatcagggatttcatgattcaggggggagattttgacaagggaaatggtactggcgggaaaagcatatatggacgaaccttcaaagatgagaacttcaaattggttcacactggacctggagcggtcagtatggctaacgctggaccaaacaccaatggcagccagtttttcatctgcactgtcaagacaccttggttggacgggaggcacgtcgtgtttggccaggttctggaaggcatggatgtcatgaagctgatcgagtcacaggagactgacagaggtgaccgtccgaagaagaaagtagtcatcagcgattgtggggagcttccggtggtctaagttttacatgtcttacctcggacgagaagttgatatccccccacttgagttgacatgaaatatcatgatactttacttatcgtgctatctcccactagttatagagattattttgagttaaagccaaggtcacaaatctgaggcatactgttgcttctcggctggaataaatgtgctagttttcctc

SEQ ID NO: 18863 - protein, 250 aa, Panicum virgatum
  misc_feature: Ceres CLONE 1802567
  misc_feature (84)..(247): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
SRESSILQRPSQWRRLLPPSLPSPSRGRRRQRRRHPGSGPSTPPRPPRRSYPPAVPASHSRARFVTSASAEPKEAEIQSKITNKVYFDISIGNPVGKNVGRIVIGLYGDDVPQTAENFRALCTGEKGFGYKGSSFHRVIRDFMIQGGDFDKGNGTGGKSIYGRTFKDENFKLVHTGPGAVSMANAGPNTNGSQFFICTVKTPWLDGRHVVFGQVLEGMDVMKLIESQETDRGDRPKKKVVISDCGELPVV

SEQ ID NO: 18864 - DNA, 911 bp, Panicum virgatum
  misc_feature: Ceres CLONE 1802568
  misc_feature: Encodes the peptide sequence at SEQ ID NO. 18865
gctccccttcgattcgagcacacaaaccctctccgccgccgccccgccgccgccgaggaagaggaggaagaagaagcacaagcgccggccaagatgaagaccattctggcgtcggagacgatggacatcccggaggaggtgacggtgaaggtggccgccaaggtggtgacggtggagggcccccgcgggaagctcacccgcaacttcaagcacctcaacctcgacttccagctgcaggagggcggccgcaagctcaaggtcgacgcctggttcggcacccgccgcaccatggccgccatccgcacagccatctcccacgtccagaacctcatcaccggcgtcaccaagggataccgctacaagatgaggttcgtctacgcccacttccccatcaacgcctccatcaccaacgccaacaccgccatcgagatcaggaacttcctgggagagaagaaggtccggaaggtggacatgcttgagggtgtgaccatcttgcgctccgagaaggtcaaggatgagctcatcctcgacggcaacgacatcgagctcgtctcccgctctgccgccctcatcaaccagaaatgccatgtgaagaacaaggatatcagaaagttcttggatggcatctacgtcagtgacaagggtgccattaatgaggagcagtgagcttcattatctgcctagtcattagctaaaaatgcctggagacggtcctcaagtgctgtttctgtatgctgtgtttctatcatcctttgggttgaaattttctgagactgaattttgtactgggttaggatgtgttatggagcatgctatcttatcctacatatctttgcttcatctctgttttaacagtctgaaccttgtttttcatcccctaaatatagtttgactgcaagcattcgtggttg

SEQ ID NO: 18865 - protein, 190 aa, Panicum virgatum
  misc_feature: Ceres CLONE 1802568
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MKTILASETMDIPEEVTVKVAAKVVTVEGPRGKLTRNFKHLNLDFQLQEGGRKLKVDAWFGTRRTMAAIRTAISHVQNLITGVTKGYRYKMRFVYAHFPINASITNANTAIEIRNFLGEKKVRKVDMLEGVTILRSEKVKDELILDGNDIELVSRSAALINQKCHVKNKDIRKFLDGIYVSDKGAINEEQ

SEQ ID NO: 18866 - DNA, 886 bp, Panicum virgatum
  misc_feature: Ceres CLONE 1802569
  misc_feature: Encodes the peptide sequence at SEQ ID NO. 18867
aagacatctccatcacccaaacgatatacacacaatggctttctcttcttccaccaagcttctcctcatcacggccttcttcgcactggcctcgtggcaacaggtcatcgcctttgatcctagccctctccaagacttctgtgtggctgacatgaaatcgcctgtgcgtgtgaatgggtttccatgcaaggacccgatggccgtcaccccggacgacttcttcaacgcggccatgctcgaccagccacggaacaccatgaacaagttcggctccctcgtcaccaacatcaacgtcacgcagttcccgggcctcaacaccctcggcatctcgtacgcgcgcatcgactacgcgccactgggcgtcaacacgccccacctccacccccgcgccaccgagctcctcaccgtgctcgaggggacgctctacctcggcttcgtcacctccaaccctaacaggctcttctccaaggtggtcaagaagggtgacgtgttcgtgttccccaaggcgatgatccacttccagatgaacctggaccatgagaagcctgcggcagcgctgtcctcgctcagcagccagaacccaggggttattaccattgccagtgcggtctttggatcgaagccgcccatctcggacgatgttttggccaaggcgttccaggtcgagaagaaactcatagattggctgcagaatcagttctgggagaataccaactactaatgatccttgactaatgtaatacagtatgtgaaataactggcgtgtggttgccagcgagccgtggtttgaaaggttctggtggagcgtgctttttttttttacttttcactgcttgattgaaaaataaagtatatggaatatatttacttgtgtaagttttttttc

SEQ ID NO: 18867 - protein, 228 aa, Panicum virgatum
  misc_feature: Ceres CLONE 1802569
  misc_feature (66)..(216): Pfam Name: Cupin_1 Pfam Description: Cupin
  misc_feature: SWISSPROT Homolog: EC 1.15.1.1 Superoxide dismutase
MAFSSSTKLLLITAFFALASWQQVIAFDPSPLQDFCVADMKSPVRVNGFPCKDPMAVTPDDFFNAAMLDQPRNTMNKFGSLVTNINVTQFPGLNTLGISYARIDYAPLGVNTPHLHPRATELLTVLEGTLYLGFVTSNPNRLFSKVVKKGDVFVFPKAMIHFQMNLDHEKPAAALSSLSSQNPGVITIASAVFGSKPPISDDVLAKAFQVEKKLIDWLQNQFWENTNY

SEQ ID NO: 18868 - DNA, 793 bp, Panicum virgatum
  misc_feature: Ceres CLONE 1802576
  misc_feature: Encodes the peptide sequence at SEQ ID NO. 18869
ctaaaagctcctcgcctctcgcacctgacaggcaggcagcagcgacgatacgccattgtcacactcacaccacaacaaggatagatatatagataggcagacccaccagcaggcagggagcagcaacgatacgccgcccatggccgccgccgccgccgtgcccctcctccttttgctggccgccgccgccgcctccccggcgtcggcggcggctggcggcggcaagcagacgcacatcaagctgtactggcacgacgtggtgagcgggccgagcccgacggcggtgcaggtggcgcgcgccgcggtgaccaacacctccaagacgagcttcggcgtcgtggtggtcatcgacgacccgctcaccgagggccccgacctcaactcctccaccacgcccctcggccgcgcccagggcacctacatcgccgccggcaagaacgaggtggccatgctcatgaacatgaacttcgtcttccaggccggcacctacaacggcagcaccgtcgccatcatgggccggaacccggtgttcgacgccgtccgggagatggccgtcggcggcggcaccggcgtgttcaggatggcgcgaggctacgcgcaggcacggacgcacacactcgatctcaacaccggcgacgccaccgtcgagtacaacctctacatcaaccactgatcatgcttccgactgctcggcgttcggcgagcttccaagtagtatcggctttgattgttagcgaatatatatgaacgtcaaattcatggagaaaaataaaactagaatcagctttgtgtt

SEQ ID NO: 18869 - protein, 177 aa, Panicum virgatum
  misc_feature: Ceres CLONE 1802576
  misc_feature (11)..(177): Pfam Name: Dirigent Pfam Description: Dirigent-like protein
MAAAAAVPLLLLLAAAAASPASAAAGGGKQTHIKLYWHDVVSGPSPTAVQVARAAVTNTSKTSFGVVVVIDDPLTEGPDLNSSTTPLGRAQGTYIAAGKNEVAMLMNMNFVFQAGTYNGSTVAIMGRNPVFDAVREMAVGGGTGVFRMARGYAQARTHTLDLNTGDATVEYNLYINH

SEQ ID NO: 18870 - DNA, 997 bp, Panicum virgatum
  misc_feature: Ceres CLONE 1802583
  misc_feature: Encodes the peptide sequence at SEQ ID NO. 18871
gcctgctccgcttctcgttctctcaccggcctcccttctccttcgccgccgtctcccgaccccggcggcgcatcctccccttcctctcctcctcgccgttgatttggtctcgggtaccttggcgagattagtgtcgaccgccctcgtcaggggtctcatgagatcctcccgtccatcaagcgcagctgctgtgtcacaacccgctatccagaagtttatgaactactcgtcaggtcttggtggtgctcctaatgcaattggggactcaactacgacacgagtagctgctgatcctgatacgcatcaagattttcagccaacaagcaaaagttcagaaatgtcttttgatgacatcgttgctcaggatatcaaggagcaccctgttgtaatctatatgaagggttatcctgatgctcctaggtgtggattcagtgcattagcagtcaaggtcctccagcagtatggtgttycgatcagcgctagagatattctgtcagatctcaagctcaaagagactgttaaagcatacagtaactggcctacgttcccacaaatatttatcaaaggagagttcgttggtggatctgatatcatactcagcatgcaccagaagggtgaactgaaggaactgcttggcgacattgcacaaaaaggcgaacaaaatgattcctcatgaaacaagtcatagtatccattgcatagcaaagactggatgtctttctcagacgattttgggtgaccttgcaatgtcagtggctttggatatgaatttttggttctgatcgtgccaattatgatgaagacccctccgggactcaaaacaggagtaaccaaagttatcttgcttgataaataaatgctactgcacgacaccgttctttgatgcatcttgctgactaccttagtttgagcttgataatgcatgggcactaagtttcttttcatttgaagtggatgctcttcgaaatgtataattaatctttgatgcttatacgcg

SEQ ID NO: 18871 - protein, 172 aa, Panicum virgatum
  misc_feature: Ceres CLONE 1802583
  misc_feature (76)..(140): Pfam Name: Glutaredoxin Pfam Description: Glutaredoxin
  misc_feature (105)..(105): Xaa is any aa, unknown, or other
MRSSRPSSAAAVSQPAIQKFMNYSSGLGGAPNAIGDSTTTRVAADPDTHQDFQPTSKSSEMSFDDIVAQDIKEHPVVIYMKGYPDAPRCGFSALAVKVLQQYGVXISARDILSDLKLKETVKAYSNWPTFPQIFIKGEFVGGSDIILSMHQKGELKELLGDIAQKGEQNDSS

SEQ ID NO: 18872 - DNA, 956 bp, Panicum virgatum
  misc_feature: Ceres CLONE 1802592
  misc_feature: Encodes the peptide sequence at SEQ ID NO. 18873
aatccgccttccccaatctctcgccctccttcccccgtgcgccgcagctagaaagctagggtttcgcctgcgatccgatccgtcgagtccaccctccccacccgatcgatggcggccgagggcgagaagaagatgatcacgctcaagagctccgacggcgaggagttcgaggtggaggaggcggtcgccatggagtcgcagaccatccgtcacatgatcgaggacgactgcgccgacaacggcatcccgctccccaacgtcaactccaagatcctctccaaggtcatcgagtactgcaacaagcacgtccacgccgcagccgccgcggccgccgcgtccaaggcaggctccgacgacgcgggggctgccgccgccaacagcaacgccgcctccggcgaagacctcaagaactgggacgccgacttcgtcaaggtcgatcaggccacgctgttcgacctcatcttggctgcaaactatctcaacatcaaggggctgctggacctgacctgccagactgttgccgacatgatcaagggtaagactcctgaggagatccgcaagaccttcaacatcaagaacgacttcacccctgaggaggaagaggagatccgcagagagaaccagtgggccttcgagtagagaggtgcttgagctcctgatctcttgatgcctaggctttgtcgtacctatgcaatgcctgcttttatgtgtcgtcggaatggttgtaagtattttgggagttgctgcggtgttgggtaaaactggtcagttattctaaacaaatgtatctctagtatatcatgacaagactaagtggctgctgccctaagaggtttagttcgatttgccatggcatcatgtttgttatgttcagtttatgttttatgatgggaatttcttcataaatcttgtggctgagagtttccaattaagatatcttcatgggatgttctgct

SEQ ID NO: 18873 - protein, 176 aa, Panicum virgatum
  misc_feature: Ceres CLONE 1802592
  misc_feature (99)..(176): Pfam Name: Skp1 Pfam Description: Skp1 family, dimerisation domain
  misc_feature (8)..(68): Pfam Name: Skp1_POZ Pfam Description: Skp1 family, tetramerisation domain
MAAEGEKKMITLKSSDGEEFEVEEAVAMESQTIRHMIEDDCADNGIPLPNVNSKILSKVIEYCNKHVHAAAAAAAASKAGSDDAGAAAANSNAASGEDLKNWDADFVKVDQATLFDLILAANYLNIKGLLDLTCQTVADMIKGKTPEEIRKTFNIKNDFTPEEEEEIRRENQWAFE

SEQ ID NO: 18874 - DNA, 495 bp, Panicum virgatum
  misc_feature: Ceres CLONE 1802606
  misc_feature: Encodes the peptide sequence at SEQ ID NO. 18875
aggtgatgcccatgaagaatctctctgatgggcagaggagccgtgtcatctttgcatggttagcatacaggcagccacaactgctgctgcttgatgagccgactaaccatctggatattgagaccattgactccctggccgaggcactgaacgaatgggacggtggtttggtgctggtgagccatgacttcaggctgatcaaccaggttgctcaagagatctgggtgtgtgaaaaccaggcagtgactaggtgggaaggtgatatcatggatttcaaggcacacttgaagagtaaggctggtctgtctgtttagaaagccttttatttttctcttcggagaattatagtcaaccatgagcttttaactctgtatcacgaagtcccagttttccagtagcaaattatcggagtttatgttattgtatcggattccttatgactttcatctgaacatgagtattttatagcacttcagatgcttatatattttttcg

SEQ ID NO: 18875 - protein, 103 aa, Panicum virgatum
  misc_feature: Ceres CLONE 1802606
  misc_feature (1)..(79): Pfam Name: ABC_tran Pfam Description: ABC transporter
  misc_feature: SWISSPROT Homolog: EC 3.6.3.41 Heme-transporting ATPase
VMPMKNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSV

SEQ ID NO: 18876 - DNA, 725 bp, Panicum virgatum
  misc_feature: Ceres CLONE 1802622
  misc_feature: Encodes the peptide sequence at SEQ ID NO. 18877
tcggtcctctcttgcctcctctcctcggctcgccatggcgttcttctctcaccaccatctccagcagccgcacccgcagcagcccccgccgccgccgcagcatcagcaacagccggtgcttccttccttcaggtgatttctggacctcaattttcgtttgcgccccttctctcgagaactgctgcaacgtgagaatcgcgctcaatttcctttccggatgctgcaattttgggcaggaacgcgctgccagtgccggtggatggccagatcccggcgccccttgccttcttcaacccgccgcctgccttcccggagcagccgccgcaggcaccgctggtggatgcggtggggttgacggcggccgcgggacttgggtggaggcagccgagggagcaagagctgcttggggagaactcccagatgtcgtccatcgatttcctgcagacgggttcggccgtgtcgacgggggcgggggtgtctctggaggaccggcgccacggcgggggcgggggcgggggcggcggggctgggaactcctcgggcgattccccgctgctcctgctgcccatgctggacgatgacatctcccgcgaggtgcagcggcttgatgctgatatggmccggttcattaaagctcagagtgaacggctgaggcagtctatattggagaaagttcaggcaaagcaatatgaggcactggcctctgttgaggacaagatactacg

SEQ ID NO: 18877 - protein, 101 aa, Panicum virgatum
  misc_feature: Ceres CLONE 1802622
  misc_feature: Functional homolog of the protein sequence given in SEQ ID NO 50826
  misc_feature: Useful for making plants with altered lignin content
  misc_feature (67)..(67): Xaa is any aa, unknown, or other
MSSIDFLQTGSAVSTGAGVSLEDRRHGGGGGGGGGAGNSSGDSPLLLLPMLDDDISREVQRLDADMXRFIKAQSERLRQSILEKVQAKQYEALASVEDKIL

SEQ ID NO: 18878 - DNA, 918 bp, Panicum virgatum
  misc_feature: Ceres CLONE 1802643
  misc_feature: Encodes the peptide sequence at SEQ ID NO. 18879
aaaatatcagaggagagggggcctctccttcctggtcgccacgacaggataaacatcccccaaagcagaccgcgaccaggcaccaaacaaccgcagcgaggcaaaccaaaccgctcctcactctcctctagctccccagcagcagcaggagctcgcaagcaagcaaggcaaggcagcgcacggcggccatgagcgtggtgatcctggacggctcgacggtgcgcgccttcgtggcggacgaggcggcgttcgcgcgcagcgtggacgcgcgcttcgcggcgctggacgccaacggcgacggcgtgctgtcgcgcaccgagctccggcgcgcgctcgagtcgttccgcctcctcgacggcggcggcttcgggtccgccgcgccggcgccgctccccgccgaggtcgccgcgctctacgacgccgtctttgagcagttcgacgccgaccacagcggcgccgtcgaccgcgccgagttccgcgacgagatgcgccgcatcatgctcgccgtcgccgaggggcttggctcgcagccgctccaagtcgccgtcgacgacgagggcggcagcttcctgctcgaggccgccgagcacgaggccgccgcgatcgccgccaaggtcgacgccgagcgcaaggccgaggccgacgccgccaataagtgacgcgtgccgcgtgggggcggtgccggtgggtgacccgtaaccttgtgctctggctctgcgctgctcgctgtactgcttctagatgttggtgtgcttggacgtgtcagccgttgcgctgctacacgtgtacgttaacagaaaaccggccggcggtggcgctcctcctcctgctgctgctgctggtgggaaatgagagttttattctactgtactttagtaacttgtgaacggaataaaacggcttccaagtctcggatgt

SEQ ID NO: 18879 - protein, 156 aa, Panicum virgatum; identical to SEQ ID NO: 10112
  misc_feature: Ceres CLONE 1802643
  misc_feature (24)..(52): Pfam Name: efhand Pfam Description: EF hand
  misc_feature (75)..(103): Pfam Name: efhand Pfam Description: EF hand

SEQ ID NO: 18880 - DNA, 800 bp, Panicum virgatum
  misc_feature: Ceres CLONE 1802648
  misc_feature: Encodes the peptide sequence at SEQ ID NO. 18881
actgcagagctcaactcacactcatcactcctcgccttcgagctaccttttgctagtagcgagcgaggcgtcgtgttgggttagggagagacagagcgggaacatggcggctcagggaaggggcagtgctgctcgtggcaacgccgccgccgtggcggcactggtcctcctctgcgtgctcctccacggcgaggtcgccgagtcggcggtgtacaccgtgggcgaccgcggcggctggggcttcaactccgccagctggcccaggggcaagcgcttccgtgccggcgacgtgctggtgttcaggtacagcccgaaggcgcacaacgtggtgccggtgagcgcggccgggtacaactcgtgcgccgcgcccaggggcgtcagggcgctcacctccggcaacgaccgcgtcaggctgaagcgcggcgtcaactacttcatctgcagcttcccgggccactgccaggccggcatgaaggtcgccgtcaccgccgcctgagtccggcaggccggccggccggccgccgccgcctgggctagaccgctctcgcctgatttctcatcctgtccaaacttaagtgctgcaactaattagacggtttcctgtacgttgttgttcaataatatcatgtcgtcgcgtacggcgtgcgtgctagttgttaggtgttgacagattggctggcgtctgtagaggaggaggaccgatcgaccgagcaatgtacgtagtacgtactgatgtgtgtgcgcgttgatgtgaggtgaggaggagcaataaaagcatatgtatacggctgcgtttgttt

SEQ ID NO: 18881 - protein, 130 aa, Panicum virgatum
  misc_feature: Ceres CLONE 1802648
  misc_feature (45)..(123): Pfam Name: Cu_bind_like Pfam Description: Plastocyanin-like domain
MAAQGRGSAARGNAAAVAALVLLCVLLHGEVAESAVYTVGDRGGWGFNSASWPRGKRFRAGDVLVFRYSPKAHNVVPVSAAGYNSCAAPRGVRALTSGNDRVRLKRGVNYFICSFPGHCQAGMKVAVTAA

SEQ ID NO: 18882 - DNA, 654 bp, Panicum virgatum
  misc_feature: Ceres CLONE 1802661
  misc_feature: Encodes the peptide sequence at SEQ ID NO. 18883
aataatgggaaggcacctgattttctgatgtgcatcggcaacgaccggtctgatgaggacatgttcgaaagcatcaacagtatgacctccaacactttcttatcacccacggtaccagaggtctttgcctgttcagttggccwgaagcccagcaaagcgaagtactacgtcgatgacaccagtgaagtaatcagattgctcaagaacgtcacccgcatctcttctcagcgggaggatgtcatccatggacgtgtgatcttcagagatgtactcgatttcgtggaataggcaccaccagctatttacctgaaattattagccgcaaagcatgtacattccattgtctccagtctctcaatggttcattttaggagggtttgttaatccagaggtctagagtagccgacatgaatcggcaccattacaagaacagcagaaatgcaagccgaagttcgccatttcgagggttcaggtgatttatgtgtaggcgattttgatagggaaggagggctgttgctggaggtttgctgtgtgaaagcaaaggctgtggcttctgcagccattggttgtctgaatctattctcctgctatattgatgattttgttggttcttctaaaacttatcactgcgaaaattgctggagttttgctgac

SEQ ID NO: 18883 - protein, 95 aa, Panicum virgatum
  misc_feature: Ceres CLONE 1802661
  misc_feature: SWISSPROT Homolog: EC 3.1.3.12 Trehalose-phosphatase
  misc_feature: Functional homolog of the protein sequence given in SEQ ID NO 50800
  misc_feature: Useful for making plants with altered carbohydrate content
  misc_feature (48)..(48): Xaa is any aa, unknown, or other
NNGKAPDFLMCIGNDRSDEDMFESINSMTSNTFLSPTVPEVFACSVGXKPSKAKYYVDDTSEVIRLLKNVTRISSQREDVIHGRVIFRDVLDFVE

SEQ ID NO: 18884 - DNA, 678 bp, Panicum virgatum
  misc_feature: Ceres CLONE 1802667
  misc_feature: Encodes the peptide sequence at SEQ ID NO. 18885
actgctgcatcgagggcgaggcatctcagcccaagaaaacagctagctcatcaatggaggacgccaagcccaccatggtcaaggcggccgtggaggtgacgctccgcaagttcgagctgtccgacgtggacgccatgatggcgtgggcgtcggacccgcaggtggccgccgtctgccggtgggacccctacgagtccacggagccgctgctcgccttcatccgcgacgtcgtgctcccgcacccgtggttccgggccatctgcgtcgccggggagccccgccccgagggcgcggtgtcggtgtcgccgacgggggacctgtgccgcgcggagctcggctacgtgctggcgcgcgcgcactggggccggggcgtggcgacggcggccgtgaagcgcacggtggccgcggtgttcgccgaggtgccggggctggagcgcgtggaggcgctggtggatgtggccaacccggcgtcgcagcgcgtgctggagaaggccggcttcacgcgggaggccgtgctccgcaagtacaccgccgtcaagggcgtcgtccgggacatggtcatcttcagcttcatcaacgccgatccagtgcccgagtgaatcacgttgatgcatgcaaatctgttgtcgaataggagtactcctgtaatttgatccgattgaagggacgataagtaag

SEQ ID NO: 18885 - protein, 181 aa, Panicum virgatum
  misc_feature: Ceres CLONE 1802667
  misc_feature (69)..(150): Pfam Name: Acetyltransf_1 Pfam Description: Acetyltransferase (GNAT) family
  misc_feature: SWISSPROT Homolog: EC 2.3.1.128 Ribosomal-protein-alanine N-acetyltransferase
MEDAKPTMVKAAVEVTLRKFELSDVDAMMAWASDPQVAAVCRWDPYESTEPLLAFIRDVVLPHPWFRAICVAGEPRPEGAVSVSPTGDLCRAELGYVLARAHWGRGVATAAVKRTVAAVFAEVPGLERVEALVDVANPASQRVLEKAGFTREAVLRKYTAVKGVVRDMVIFSFINADPVPE

SEQ ID NO: 18886 - DNA, 1061 bp, Panicum virgatum
  misc_feature: Ceres CLONE 1802670
  misc_feature: Encodes the peptide sequence at SEQ ID NO. 18887
gaatccgcgttacacacagatactttccgcttcttttccaacgcaactttcttggccccaagtccccaaccacctggacggtagcaaagagcaaaacgcccacagcgcacacaaccacacaaatccatggaggcgtcgttgaccgccgccgccgtctcgttgccgccgccgcgaatccgcctccgaatcgccaaaccgagtccactcccaccccctcggcggctccaatttggatcctccaagatccggacctccggcacgcggccatgcctggctgcggcttccgcatccacgccgccggccccgggaggcggcctgtactcggcggcgacctacgagatgacgggggaaaacgtcgaccgcgtcctggacgacgtgcgcccgtacctcatcgctgacggcggcaacgtcaccgtcgtgtccgtcgaggacggcgtcatctccctcaagctcgaaggagcgtgcggcagctgccccagctcgacgacgacgatgaatatgggcatcgagcgcgtgctcaaggagaagttcggcgacgctttcaaggaaatccgtcaggtgttcgacggggatcaaccaccggcggagacgacgcccgaggcggtgaaccgacacctggacatactccggccggcgatcgcgaactacggcgggagcgtggatgtgctggccgtcgacggcgaggactgcctggtgaagtacgacgggccggagtccatcgggagcggcatcaaggctgccatcaaagagaaattcccggacatcaccaacgtggtattcacccagtagaacactctctagataagcagatatgcatcaaaaagccgacggcaaataagaagatgaaattatcagatatatacacgggagtagtttgcaaaatgttgctgtgcttgtattgaaattttgaaatgcagcagcgctgtcaatggacggttttgtgcctcatccctgcatttttcatcacctgaattcagatgattcagaattccatacgatctcagcatatgtgcactggaatgtactgtgtactgactttcaatccaagcatatcttgcagc

SEQ ID NO: 18887 - protein, 149 aa, Panicum virgatum
  misc_feature: Ceres CLONE 1802670
  misc_feature (6)..(74): Pfam Name: NifU Pfam Description: NifU-like domain
MTGENVDRVLDDVRPYLIADGGNVTVVSVEDGVISLKLEGACGSCPSSTTTMNMGIERVLKEKFGDAFKEIRQVFDGDQPPAETTPEAVNRHLDILRPAIANYGGSVDVLAVDGEDCLVKYDGPESIGSGIKAAIKEKFPDITNVVFTQ

SEQ ID NO: 18888 - DNA, 846 bp, Panicum virgatum
  misc_feature: Ceres CLONE 1802673
  misc_feature: Encodes the peptide sequence at SEQ ID NO. 18889
gaagcaccaaagtctgttaaagaagcatctaaatctttcactgtgtcagatcgtcggacctcgaagcgttcccgaagaacaaactctggaaattcaatcagtttgaaagtctctggttctacatctgtctatcagttgaaactcatgatatgggaatctttagggatcgtgaaggagaaccagaagcttcacaaaggctctgttgagattgaagatgacttggcaactcttgctgacaagagtatttttcccggtgatgttctttgggtcagagattctgaaatctatgagaaccgtgacatagcagatgagatttcagagcagaaggctgatatgctacagacagaggaaggctttcgaggaactctgttgacatcaagtgtttcagctcagctttgtcaggatgtagcatttagtgaatgaattcctgcatcagatgtatagctgcatatatgctgactgaaatggttaagcttgctgggagaaattgtaattgctttgcagagtgtcgtatggaattgtggcggtcctggcagccgtcctggcgggaatttttgtcaacccctttatcgcaagctgtgtttttcagtgaggaaaacagaagaggctcctcctgaagctgtccgtctacccctgatgtaattacatgacaagtaggaagttgtctatttgatgcatgcgtagtttcttttttactctcttttggctgtgagggctatgggtgattcgcctcttacatggtggccaatgcaagaggtttgttgaaaggctggagccttgaactgatgctgaggtagtagtggtcggtttgctagatgagaatgagatcgtagtgcctgctggctt

SEQ ID NO: 18889 - protein, 140 aa, Panicum virgatum
  misc_feature: Ceres CLONE 1802673
  misc_feature: SWISSPROT Homolog: EC 3.1.2.15 Ubiquitin thiolesterase
EAPKSVKEASKSFTVSDRRTSKRSRRTNSGNSISLKVSGSTSVYQLKLMIWESLGIVKENQKLHKGSVEIEDDLATLADKSIFPGDVLWVRDSEIYENRDIADEISEQKADMLQTEEGFRGTLLTSSVSAQLCQDVAFSE

SEQ ID NO: 18890 - DNA, 555 bp, Panicum virgatum
  misc_feature: Ceres CLONE 1802676
  misc_feature: Encodes the peptide sequence at SEQ ID NO. 18891
acctcatcgatcgagccagccgtccagccagtcgcctatatcctcgcctgctgcgcgcgtctctctgctctcctagggagatctcgcgcagcgcggtaacccaccttcccacctcgtcgccgtcgcagatggccggcctcaggatgaagctcgtcgccgccgccgccgtggccgccgcgctcgtggcgtccgccgccgccgccaccgasgcccccgccccggcgcccgcctccgacgccgccgccgcggtgcccctcgccgcggcgtccctcgccgccgccgccttcggctacctcttctgctagatccgccgcccgttccccgtgggtcctgctgatatgatgattcgttctggcgtggcgtgagtcgagtccgtgtggggaggatgtcggtgggcgtgtgtatgtacgagttcggctgcggtgggggtggtgtgcgagcggtggttgcgtgcgtcgacgcgccgttctctatggcgccgatcatgtactcactccgtttctggttattgatgagatcatttatttgattctttccatcttattcatacctgtc

SEQ ID NO: 18891 - protein, 58 aa, Panicum virgatum
  misc_feature: Ceres CLONE 1802676
  misc_feature: Functional homolog of the protein sequence given in SEQ ID NO 50452
  misc_feature: Useful for making plants with altered carbohydrate content
  misc_feature: Functional homolog of the protein sequence given in SEQ ID NO 50827
  misc_feature: Useful for making plants with altered cell wall content and/or composition
  misc_feature (27)..(27): Xaa is any aa, unknown, or other
MAGLRMKLVAAAAVAAALVASAAAATXAPAPAPASDAAAAVPLAAASLAAAAFGYLFC

SEQ ID NO: 18892 - DNA, 1060 bp, Panicum virgatum
  misc_feature: Ceres CLONE 1802696
  misc_feature: Encodes the peptide sequence at SEQ ID NO. 18893
tcgatcatcagttggtttgaattcggttccatgcgtgtgtttaccgatgcatgcagctgagcggtccgacgtgggcggtgccgctgggccggcgcgacacgcgcacggcgagccaggcggcggcgagcagcaacctgccctccccgtcgtcgagcgcggcggcgctggtgtcggcgttcgcgtccaagggcctggacgcgcgcgacctggtggcgctctcgggcgcgcacaccgtggggtcggcgcgctgcgcgagcttccgctcccgcgtctacaacgacaccaacatcaacgccgggttcgcggcgaagcggcggcagatctgccagccgcagggcggcgccaccgacggcaacctggcgccgctcgacgcgctcagccccgtccgcttcgacaacggctacttccgcaacgtcgtcgcccagttcggcctgctccactccgaccaggagctcttcggcggcggccaggtggacggcgtcacggcgcagtacgcgcgcaacggtgccgccttcgcgcgggacttcgccgcggccatggtcaagatggggaacatcagcccgctcacggggtccagcggcgagatccgggccaactgccggaagcccaactaacaataatcagccgcgccccgccgccgccggccggccggccggccttgagatgcgtgcgggacggagaagggacggcgcggatgggcggggccgatcgacatggccagctaagaggagtgcggcttttgcgcgtggggaagtgtggagtgcgttcgaagggagcggcggcggctggccggagacggcgatgattgaggtggggcggatttggtgggtggagcggcgctgtcaaggggggaggaggagggagacgagaggtggggcccagcgtgccgtgacacatcgatcacgcgctgcagtgcatgcatggctggccactgcggctgcttttggtttggttgcattctttccttgtaccatactaccataccgattcgattcatgattatttttcagggaggggacacgaataagaacgtatatattaaaaaatgtgctttatttct

SEQ ID NO: 18893 - protein, 187 aa, Panicum virgatum
  misc_feature: Ceres CLONE 1802696
  misc_feature (1)..(151): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 50828
  misc_feature: Useful for making plants with altered carbohydrate content
MQLSGPTWAVPLGRRDTRTASQAAASSNLPSPSSSAAALVSAFASKGLDARDLVALSGAHTVGSARCASFRSRVYNDTNINAGFAAKRRQICQPQGGATDGNLAPLDALSPVRFDNGYFRNVVAQFGLLHSDQELFGGGQVDGVTAQYARNGAAFARDFAAAMVKMGNISPLTGSSGEIRANCRKPN

SEQ ID NO: 18894 - DNA, 800 bp, Panicum virgatum
  misc_feature: Ceres CLONE 1802701
  misc_feature: Encodes the peptide sequence at SEQ ID NO. 18895
acaccagagcagatacagaataagcacttaagcaacgatcatctctctagctccctgcactgcatctaggcatccagccatggccaccttccaaatcacccctgcgcttgtggagcgcaacgagctcaagttcagtggcctctacctgtaccacacgacctccggcccaaactgtaaccaagagtcacttgtaagcaagaacgggttgggttcgctggttgggaacaactgggaagtacgcgacggccctgatccgaacgccaaagtcatcgcccgcgcacagggcatgcatatgaacaccggtgtcaaccaaatctggcagaatttcttctgtcgggcctttgaggatggcaggttcaagggttccacttttcaggtgatgggattagatgtcatcaggggtgaatgggctattgtggggggggaamcgggagaattctctatggcaacaggtgtcatttacaagaagtttcacaagaaaacgactgaaggggacatagtggaacttacaatccatggattttgtcccgttctcaaagggtcaaagcagaacaaccactgctcgtgatctggtggtgcctgacgtctcgttgcattgtgcccctgcatctgtatgtaccgagcagatctttgctcctgccgacctgtgtgtttgtgtttgctcgtgtcatcctgtgtcaagtaaagatctcgatcagagattgtgttcctggatccataattgtgttttccaatagtcacatgtgcttctgtatccgttgtgaaataaagaacccaatcagagattgtgttcttggatc

SEQ ID NO: 18895 - protein, 162 aa, Panicum virgatum
  misc_feature: Ceres CLONE 1802701
  misc_feature (1)..(151): Pfam Name: Dirigent Pfam Description: Dirigent-like protein
  misc_feature (117)..(117): Xaa is any aa, unknown, or other
MATFQITPALVERNELKFSGLYLYHTTSGPNCNQESLVSKNGLGSLVGNNWEVRDGPDPNAKVIARAQGMHMNTGVNQIWQNFFCRAFEDGRFKGSTFQVMGLDVIRGEWAIVGGEXGEFSMATGVIYKKFHKKTTEGDIVELTIHGFCPVLKGSKQNNHCS

SEQ ID NO: 18896 - DNA, 608 bp, Panicum virgatum
  misc_feature: Ceres CLONE 1802714
  misc_feature: Encodes the peptide sequence at SEQ ID NO. 18897
ggattcatccaagccgaacccggccaataattaagccaccgggcacactacttgcttcttactgatccattgtttgttgccgaccttgatgaagagcagcggcagcaccgccagcaaggaggacgcttccggaggcgggaggccgccgcactggaggcgccgggaccccgcggccacggcggtgtacgtcgtccaccccgcccagttccgcgccgtcgtgcagcaactcaccggagccgcgtcgtcgccgctgccggcgtccgccgcccacgcccatcatcaggggggcggcggcaatggcggcacaggggcggctgctgctgctggcggcggtaccaatgcggcggcgcagcagcaacaggttcagcagcggcatggccgaggcgacgggcggacgctggggcagatgcaccaggagtgcatggcctgggccgacgccgatgattactagcagacgtgcacacactccgtcgccggcgggggcttctcggccgccgttggtggcgatgagcgcgggaattcgccggtctcctcgtaccttagcttcttgtaaaactaggagtactgtcaaaccgcatgccaagtcgccaactagctttgtttatctc

SEQ ID NO: 18897 - protein, 120 aa, Panicum virgatum
  misc_feature: Ceres CLONE 1802714
  misc_feature (26)..(56): Pfam Name: VQ Pfam Description: VQ motif
MKSSGSTASKEDASGGGRPPHWRRRDPAATAVYVVHPAQFRAVVQQLTGAASSPLPASAAHAHHQGGGGNGGTGAAAAAGGGTNAAAQQQQVQQRHGRGDGRTLGQMHQECMAWADADDY

SEQ ID NO: 18898 - DNA, 829 bp, Panicum virgatum
  misc_feature: Ceres CLONE 1802727
  misc_feature: Encodes the peptide sequence at SEQ ID NO. 18899
aggctttcaggagggttcgagaaggcgaaggcgaaggcgaggagcaagctgtactgcgtacagacttcggatatggaggaccagttccaggatggcaaggaggaggtcatccaagcatggtacatggatgacagcgaagaggaccagaggcttcctcatcatcgcgagcccaaagagttcattcctctagacaaactctcagagctaggaatattaagctggcgcctaaatgctgatgactgggagaatgacgagaacctcaagaaaattcgtgaagccaggggttactcttacatggacatctgtgatgtgtgtccagagaagttgccaaactacgaggctaagataaagaatttctttgaagaacacttgcatactgatgaagagatacgctattgtcttgagggtagtggtaggtgcctgttggactgaggataaaagcccccacccctcccactataacacctgggttttatggtcgggttggctaggtggggcgttctaacttggtaccagagccgaggtcctgggttcgatccctcccggccacgcatttccgctgcgcgatttccctggctacgttcgctgagaccgaagtaccggacaggtggcacagccccgcggctcgcccggctcgcacgcagtagggggaatgttggactgaggataaaagcccccacccctcccactataccacctgggttttatggtcgggttggctaggtggggcgttctaattgtttgcatttagagcatttctctaaaactagcaacaatcaacagatttcctttctataattctatctgatttacacgttcaactttttcc

SEQ ID NO: 18899 - protein, 119 aa, Panicum virgatum
  misc_feature: Ceres CLONE 1802727
  misc_feature (14)..(119): Pfam Name: ARD Pfam Description: ARD/ARD' family
MEDQFQDGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGRCLLD

SEQ ID NO: 18900 - DNA, 673 bp, Panicum virgatum
  misc_feature: Ceres CLONE 1802729
  misc_feature: Encodes the peptide sequence at SEQ ID NO. 18901
aaaaacaagtcctcccaccgcacgcaaccacggcagagagagtccacgagtccgccatggcgagcaagcagagcctcctcgtcctcgccgccgtcgccgcctgcctcctcctcctccccgccgcctcggtcgccaccgacgtcgactactgcagtaggggcaagaagtacccggtgaaggtgagcggggtggagatcgtgcccgatccggtccagcccggcaagccggccaccttcaagatctccgcttccactgataaaaccatccagaaggggaagctggtaattgatgttaagtatttcttcttctacgtgcactcggaaactcgcgacatctgcggagagactacctgtccagcaactggtagcttcatgctctctcatgagcagacactaccaagcttcactccaccgggttcttacaccatcaccatgaagatagttggggacgacaatgaggaactgagctgcatctcgttcgggttcagcatcgggttccttgcctccagctgaacggatgcatcttctatgagcaccggaagtttgccatggatgtaattatgaaccacactgtatcctacgactcccggtagtgttgaggtgcacgcgttgtgggtgtctgaggtgcacggattgcgggtgtcgcgaaacttactgctcaactaagacgtttt

SEQ ID NO: 18901 - protein, 151 aa, Panicum virgatum
  misc_feature: Ceres CLONE 1802729
  misc_feature (25)..(145): Pfam Name: E1_DerP2_DerF2 Pfam Description: ML domain
MASKQSLLVLAAVAACLLLLPAASVATDVDYCSRGKKYPVKVSGVEIVPDPVQPGKPATFKISASTDKTIQKGKLVIDVKYFFFYVHSETRDICGETTCPATGSFMLSHEQTLPSFTPPGSYTITMKIVGDDNEELSCISFGFSIGFLASS

SEQ ID NO: 18902 - DNA, 811 bp, Panicum virgatum
  misc_feature: Ceres CLONE 1802730
  misc_feature: Encodes the peptide sequence at SEQ ID NO. 18903
actgcattcatcactcacgtagaacacagaaccagatctgttaatccaggagctgccatgggcatcgtcgacgtcgtctccgtgttctgcgcgctgccgaggactcgccggcacctcaagaagaggaaggagttccagacggtggagatgaagatgcggatcgactgcgaagggtgcgagcgcaaggtgcgcaaggcgctggagggcatggagggcgtgagctccgtggaggtggcgccgcgccagcacaaggtgacggttgccgggtacgtcgacgccggcaaggtgatgcggcgggtggcgcgccggacgggcaagcgggtggagccctggccctacgtgccgtacgacgtggtggcgcacccctacgcgcccggcgcctacgacaagaaggcgccgcccggctacgtgcgcaacgtcgtcgccgaccccgccgccgcgccgctcgcccgggcctcgtccaccgaggtcaggtacaccgccgccttcagcgacgagaaccccaacgccgcctgcgccgtcatgtagagctgcacgctgcctcgctcctggagtagtagtaggagtagatggactaggaagttgctgctgtttcttggagcatttttttttctactttagtatttctctacgcttgtgctctggttcgattcgctgtaaaaaaaagaagatggttttgatttggaaatcctcagtggtagtaagtaggcttgaaggctagctagtagtgtttgttgccttgttgattgatgtatcatttctcaaaaagaagatattttgacaaacgacaataaatattattattaaagcc

SEQ ID NO: 18903 - protein, 156 aa, Panicum virgatum
  misc_feature: Ceres CLONE 1802730
  misc_feature (29)..(91): Pfam Name: HMA Pfam Description: Heavy-metal-associated domain
  misc_feature: Functional homolog of the protein sequence given in SEQ ID NO 50155
  misc_feature: Useful for biocontainment applications
MGIVDVVSVFCALPRTRRHLKKRKEFQTVEMKMRIDCEGCERKVRKALEGMEGVSSVEVAPRQHKVTVAGYVDAGKVMRRVARRTGKRVEPWPYVPYDVVAHPYAPGAYDKKAPPGYVRNVVADPAAAPLARASSTEVRYTAAFSDENPNAACAVM

SEQ ID NO: 18904 - DNA, 537 bp, Panicum virgatum
  misc_feature: Ceres CLONE 1802740-R
  misc_feature: Encodes the peptide sequence at SEQ ID NO. 18905
cgtacgagacggggaaggagagcgcgctgccgtcgtcgtgctgcggtggcgtgcgcagcctgaacagcgtggcgcgcacgagcgcggaccggcaggcggcgtgccggtgcctcaagagcatggccagcaccgtcaagtcggtgaacatgggcaccgtagccaccatccccggcaagtgtggcgtctccgtgccattccccatcagcatgtccacagactgcaacaaggtcaactaaattaatggaatatatgtacataccagctgatggacgatgacaatcttggtgacgtcgtccttcacaagatagctgctacgaggcagctatatatttaattaggagaataaaataaagttgttatcaaggcatcagcatcatctatactattatgtatgtatgtatgtagtaattaaatgcatgttgtgctcgatctgtgtgtacgtgcgcatatatatacatgtgtacatgcctttgtacgatcgatgttatgtgcacatgtatgcttgtgtgtcctgctgtaataatcgagacagagaac

SEQ ID NO: 18905 - protein, 77 aa, Panicum virgatum
  misc_feature: Ceres CLONE 1802740-R
  misc_feature (1)..(73): Pfam Name: Tryp_alpha_amyl Pfam Description: Protease inhibitor/seed storage/LTP family
YETGKESALPSSCCGGVRSLNSVARTSADRQAACRCLKSMASTVKSVNMGTVATIPGKCGVSVPFPISMSTDCNKVN

SEQ ID NO: 18906 - DNA, 222 bp, Panicum virgatum
  misc_feature: Ceres CLONE 1802740
attcccccacagcacaacgcagctagacatccactcatctcacacactgcagctagcatttgcttagcttagcaagaccatcatatccgatcataattataccctgacaatggctttgatgatgaaaaacaacaggatgcaagcagtgtggcggcgttagatcgatgtcatggacgcctgcggcgctggcggcgtcagcttcaacaagacatcaccgtatcg

SEQ ID NO: 18907 - DNA, 1028 bp, Panicum virgatum
  misc_feature: Ceres CLONE 1802741
  misc_feature: Encodes the peptide sequence at SEQ ID NO. 18908
atttcacgtcttcacgaggccggatcacagccgggttgcgagtaaccatcgcccacgaaaggtccaccacccgacctgctctccgcctctcccttcggccttggcgttgtggcaccgacaccccaagcagactgcgcaccaaacacccgccgcgcacggtccgcccgccacccaacaaaaagctacggcctctctgctctcgggagcacggatggatcccacgttaagggcagtgctgagccgtgggggagcaggcggcggcggcggtggcggtgcgagggtaggaggaggcggcgacgcgcactacaggggcgtgaggaagcggccgtggggcaggtacgcggccgagatccgcgacccgtggaagaagacgcgggtgtggctgggcacgttcgacacccccgtggaggccgccctcgcgtacgaccgcgccgcgcgcaccttccgcggcgccaaggccaggaccaacttccccgacagcgccggcgcccaccaccaccgcagcccgcaccacatggcgccactcccgcgccaacccccgccgcaggccgccgtcacgttcggcgccgtcggcctcgactgcccttcgccgtggcatttcgtctacttgctgcccccagcagccgtggccacgacgccgccggtggccgcgccgccgccgtcgaccgcgctggagctcggcacgggccaaagccgcggcggcctgccgttcgacctcaacgaggcgccgtcgtgctgacgacccggatcgtgacgcggcagctgcagatgtggtgagcaggtgaggtgacaggtgagggccgggcggggagcactggtccggctagctgtacatagctatttaaggaaggatgagccctgtctttgtacggctcgctcacctgttctcgtttaagcgttgccattctgtgtcggcaacaatggtgggtggagaggcattggcccctgtttggaggcgcgacgtacaatcgtgcgtcgcgtttacgcgaacgcggctccgcggccgctttttgaaatcgcgggcggtc

SEQ ID NO: 18908 - protein, 175 aa, Panicum virgatum
  misc_feature: Ceres CLONE 1802741
  misc_feature (30)..(81): Pfam Name: AP2 Pfam Description: AP2 domain
  misc_feature: Functional homolog of the protein sequence given in SEQ ID NO 50249
  misc_feature: Useful for making plants with altered lignin content
  misc_feature: Functional homolog of the protein sequence given in SEQ ID NO 50250
  misc_feature: Useful for making plants with altered alkaloid content
  misc_feature: Functional homolog of the protein sequence given in SEQ ID NO 50413
  misc_feature: Useful for making plants with modulated biomass
  misc_feature: Useful for making plants with modulated flowering time
  misc_feature: The sequence is a functional homolog of SEQ ID NO 2217 in the 10/666,642 US patent application
  misc_feature: The sequence is a functional homolog of SEQ ID NO 24 in the 10/903,236 US patent application
  misc_feature: The sequence is a functional homolog of SEQ ID NO 84 in the 10/714,887 US patent application
  misc_feature: The sequence is a functional homolog of SEQ ID NO 84 in the 11/435,388 US patent application
  misc_feature: The sequence is a functional homolog of SEQ ID NO 1011 in the 10/412,699 US patent application
  misc_feature: The sequence is a functional homolog of SEQ ID NO 700 in the 10/666,642 US patent application
  misc_feature: The sequence is a functional homolog of SEQ ID NO 22 in the 10/903,236 US patent application
  misc_feature: The sequence is a functional homolog of SEQ ID NO 2215 in the 10/666,642 US patent application
  misc_feature: The sequence is a functional homolog of SEQ ID NO 82 in the 10/714,887 US patent application
  misc_feature: The sequence is a functional homolog of SEQ ID NO 82 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 1884 in the 10/374,780 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MDPTLRAVLSRGGAGGGGGGGARVGGGGDAHYRGVRKRPWGRYAAEIRDPWKKTRVWLGTFDTPVEAALAYDRAARTFRGAKARTNFPDSAGAHHHRSPHHMAPLPRQPPPQAAVTFGAVGLDCPSPWHFVYLLPPAAVATTPPVAAPPPSTALELGTGQSRGGLPFDLNEAPSC

SEQ ID NO: 18909 - DNA, 793 bp, Panicum virgatum
  misc_feature: Ceres CLONE 1802742
  misc_feature: Encodes the peptide sequence at SEQ ID NO. 18910
tcgtccacactcccactccgccactcgaccccgtcgccatctcctctcctcctgctcgtctcgtgccggcggcaagggcgatggcctccctccgtgcgtccctcctcctcgccgcggcgctttgcgcgctcgcggcttcgggcgccgccgcatcccgcgacctccgcccgctccgggccggctttgtcgtgcgcggacgcgtctggtgtgacacctgccgcgccgggttcgagacacccgcctccacctacattgccggagcaaaggtaagagttgactgcaggtcgaaaaccactggattgaagacatgcagcttcgaggggcacactgatcgcactggcacttacaacatccttgttgccgatgagcacgagcatgagctctgtgagtccgtccttgtcagcagcccggacatgaggtgtgctacgaccgtgcctggtcgggagagggcccctgtcttcctcaccagcaagaatggtgtggcttctaatgttcgtctggcaaatgctctgggcttccagaaggacgttgctctacccagatgtgcgcagatcctcaagatgtacgaggatgtggatgaccgtgtgtaatggtgcagagtttgacactgctcggcgagctatatatttatgccttgtgtctgaagtgttcttgaacctctatatctattacgaggaccaacagcattattgcctgttagttaagcactttgattatgtatgtctatctgcagttgaactgcgaatgttatcagcaactaaatctacctggctaatatagtgttgttgtctgg

SEQ ID NO: 18910 - protein, 169 aa, Panicum virgatum
  misc_feature: Ceres CLONE 1802742
  misc_feature (37)..(157): Pfam Name: Pollen_Ole_e_I Pfam Description: Pollen proteins Ole e I family
MASLRASLLLAAALCALAASGAAASRDLRPLRAGFVVRGRVWCDTCRAGFETPASTYIAGAKVRVDCRSKTTGLKTCSFEGHTDRTGTYNILVADEHEHELCESVLVSSPDMRCATTVPGRERAPVFLTSKNGVASNVRLANALGFQKDVALPRCAQILKMYEDVDDRV

SEQ ID NO: 18911 - DNA, 755 bp, Panicum virgatum
  misc_feature: Ceres CLONE 1802746
  misc_feature: Encodes the peptide sequence at SEQ ID NO. 18912
gaatccctaactccccgtccagtccctcggcacccgaattccggcggcggcggcgatggcggcggctgcggcgaggtccggtttccggcgcatgttctccatctcggccttcgcgccgccgaagccgcccgccccgcgaccccaggccgacccctcccccaacctcttcgtctccggattaagcaagcgtacctcaacagaaggacttagagatgcttttgcgaagttcggggaagttgttcatgctcgagttgtgacagaccgtgtctccggatgttcgaaagggtttggctttgtaaggtatgctacaactgaagaagcagcgaaaggaatagaaggaatggatggaaagttccttgatgggtgggttatttttgcggaatatgctaaacccagaccaccgccccaggaagcagagatgaattcgcagccacaacaatcatggggccctccatcaagttcctggggttcacagtagatgaagagcagccctctatgcagccttggggctcacagtggatcaaaaggccatcaattctgcatctgatttatagatattgtgtgttgtgctgtaccaggtgtgaatgccctagacggtctgatattcttgccgtgttggagtggtcgtttactcgcgtccatggtttccacatgaagaggtagttgtcaatcccaacggaccaaaacacgtatactgtccatgtgcaacagttgaaaacctttgcgaataatgtctgctatcgtgcttgttgcgg

SEQ ID NO: 18912 - protein, 140 aa, Panicum virgatum
  misc_feature: Ceres CLONE 1802746
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAAARSGFRRMFSISAFAPPKPPAPRPQADPSPNLFVSGLSKRTSTEGLRDAFAKFGEVVHARVVTDRVSGCSKGFGFVRYATTEEAAKGIEGMDGKFLDGWVIFAEYAKPRPPPQEAEMNSQPQQSWGPPSSSWGSQ

SEQ ID NO: 18913 - DNA, 608 bp, Panicum virgatum
  misc_feature: Ceres CLONE 1802758
  misc_feature: Encodes the peptide sequence at SEQ ID NO. 18914
gcaagaaacacagctgagccatggacgccgctgccgccgccgccacggccgccggcgacgaggagcaggaccaggcgcggatggacgccatcgccgacggcctacagacccgagacgcgatgcggctgtacaactggctcacgcagcgttgcttctccgactgcgtcgtctccttctaccgccgggcgctcggcaagcgcgaggaggagtgcgtccgctcctgcgtccgcaagtaccagctcttatccaccgcgtccgccgcgcgcttcgcccacttcgccgaccccaacaactcctctccggcagcatttgacgattgattcaccgctgctcttgcccgtctacgcctctgtacgatcccagttcgttgtcctcttcttgcctgccggcccgctactttgtttgcttcagttcttcagtctagcttagcttttgctttgtgatctcaaggaaactgaaacacgacggcataatacgagagtagcatttactattgttgacgccgaaattttcattaggaattggaaggccaagaccaagagtgactgatttgtaccacacaaaaaaagtttggaattttgatgaatgaatcgatggatggattcttc

SEQ ID NO: 18914 - protein, 99 aa, Panicum virgatum
  misc_feature: Ceres CLONE 1802758
  misc_feature (21)..(82): Pfam Name: zf-Tim10_DDP Pfam Description: Tim10/DDP family zinc finger
MDAAAAAATAAGDEEQDQARMDAIADGLQTRDAMRLYNWLTQRCFSDCVVSFYRRALGKREEECVRSCVRKYQLLSTASAARFAHFADPNNSSPAAFDD

SEQ ID NO: 18915 - DNA, 948 bp, Panicum virgatum
  misc_feature: Ceres CLONE 1802781
  misc_feature: Encodes the peptide sequence at SEQ ID NO. 18916
attattagccatttagccttaaccgccgcgacgtcgggccccgagtggcaccggtcagctagctcgagcgcagctctcgccgcgctctccttgcgacgacgccatggccccgaccgcccgagccgccacgggcgcggcgagccccgcggcgccggccatcggcaagggcgagggcggcaatggcaaggccgccgccgcgcgctccgtcggactcgacctgcccgcgctgccgggcctcggtctcgcggcgcagggacagacccgcgccgcatcctgcaagcggctggagaggaacgtggtggccgtggccgcggggaccgccggggagccggcggcggcgccgacggtcgccaacgaggagctcaccgagttcctcaacgccttgaaacaggaggtgcgtatgcacgtgagcggcatgacgcgtctttgtttcaatctgtcgtcctagttgttcgtacttcgtcggctgcttgcagcaacctgatgatgccatgtctttgccggctcgatgctcgtgcagtgggacgggatcgagaacaagttcgccatgaccacactcgccgtcactgtcacgctcgtcatgtggagcgccggtggagtagtatcggcaattgacaggctcccgttagttccaggcctgatggaggttgctggaattggatacagtgggtggtttgcgtaccgctacctgctattcaagcctgacagggatgctttctttgcaaaggtcatggagttctacgaggatataatcagcggctaacagaatataatgcaagctcatccaaattaaggaagctcaacttgagaggggcatgtatactagtctgctgctgttcagttgttctctgtaatatatttctggatagcatctaatttgatccttactcaatgtacggataaataatttggatgttaatcgtaaataacatgtaatccttttaagtc

SEQ ID NO: 18916 - protein, 84 aa, Panicum virgatum
  misc_feature: Ceres CLONE 1802781
  misc_feature: SWISSPROT Homolog: EC 6.1.1.9 Valine--tRNA ligase
MLVQWDGIENKFAMTTLAVTVTLVMWSAGGVVSAIDRLPLVPGLMEVAGIGYSGWFAYRYLLFKPDRDAFFAKVMEFYEDIISG

SEQ ID NO: 18917 - DNA, 723 bp, Panicum virgatum
  misc_feature: Ceres CLONE 1802801
  misc_feature: Encodes the peptide sequence at SEQ ID NO. 18918
gctttcgtttcgcgtggcgtgagggggagggaagcgaaaactcgcgaaagggtatcagtttccctcagagcggaggagatggccgggaagggaggcaagggtctgctcgcggcgaagacgacggcggccaagtcggcggagaaggacaaggggaagaaggcccccgtctcccgctcctcccgcgccggcctgcagttccctgttggccgtatccaccgccaacttaagcagaggactcaggcaaatggtcgtgttggtgccactgcagccgtctactctgctgccatcctggagtacttgactgctgaggttctggagttggctgggaatgctagcaaggatctgaaggttaagcgtatcacccctcgccaccttcagctggccatccgtggagatgaggagctcgacaccctcatcaagggcaccattgcaggtggaggtgttatcccgcacatccacaagtctttgatcaacaagtcctccaaggagtgaggggcagagatgatgggcatcttagtttaaactggacttttgtgtgcccctgtgttgtaattcctggttgttgagtagttttagtggagctgtctggttgaaatgatccttgtgtgtaacactttcctggtactgctgttatttgaacattgtgtccgttgagttgttaacttcaggggtgcaaacctggatgcttatttagttatttgtgactgcctgttatttcagttc

SEQ ID NO: 18918 - protein, 137 aa, Panicum virgatum
  misc_feature: Ceres CLONE 1802801
  misc_feature (32)..(106): Pfam Name: Histone Pfam Description: Core histone H2A/H2B/H3/H4
  misc_feature: SWISSPROT Homolog: EC 2.7.7.7 DNA-directed DNA polymerase
MAGKGGKGLLAAKTTAAKSAEKDKGKKAPVSRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 18919 - DNA, 959 bp, Panicum virgatum
  misc_feature: Ceres CLONE 1802827
  misc_feature: Encodes the peptide sequence at SEQ ID NO. 18920
accatctacccctgcacaccccacatcgctgctcggcttctctcctccccgagcacttcgcctccgcctcgagccggcgccaccacagccgcaggccccgccggaagcgaggagctgcggaagcaggggaggggcgacgcggcgactgcgctcgtcttccccgccaccgtcggcgtcctctcgcgatggcacctctcacggcccccaagtccggcgacgccctcttcgccagcgtcgatcgcgtcaacgcggagctgttcacgctcacgtatggcgccgtcgtgcggcagctgctcacggatctggaggaggtcgaggaggtcaacaagcagctagatcagatgggttacaacattggaacacggttgattgatgagttcttagcaaagtcaaacgtatcaaggtgtgttgacttcaaggagactgctgatgttatcgcaaagcttggatttaagatgttcttgggtgtgactgcaactgtaaccaattgggatgccgagggtacaagctgcagctttatattggaggacaatcctcttgttgattttgttgagctccctgacacttgccaaggccttcagtattgcaatgtgttaagtggagtaatcaggggagcattggaaatggtgtctatgaagacagaggtgacatgggtccgtgacatgctccgtggggatgatgcctatgagatgcgtgtgaagcttatcaagcaagtccccgaggaatacccctacaaggacgatgactagtttgagtttaagcgaagttcctgcagcagggcgctagtttgcttgtctggatgttaattttgttgtggatatagtcctggtattacatgatgtcacaagagtaaactgttgattgcatttacaattgtcgtgtgtattactggtgtattgtagaaatattgcatatcttccatgccttgtggctttgaattaatccggtgaattacgggc

SEQ ID NO: 18920 - protein, 187 aa, Panicum virgatum
  misc_feature: Ceres CLONE 1802827
  misc_feature (24)..(174): Pfam Name: TRAPP_Bet3 Pfam Description: Transport protein particle (TRAPP) component, Bet3
MAPLTAPKSGDALFASVDRVNAELFTLTYGAVVRQLLTDLEEVEEVNKQLDQMGYNIGTRLIDEFLAKSNVSRCVDFKETADVIAKLGFKMFLGVTATVTNWDAEGTSCSFILEDNPLVDFVELPDTCQGLQYCNVLSGVIRGALEMVSMKTEVTWVRDMLRGDDAYEMRVKLIKQVPEEYPYKDDD

SEQ ID NO: 18921 - DNA, 985 bp, Panicum virgatum
  misc_feature: Ceres CLONE 1802838
  misc_feature: Encodes the peptide sequence at SEQ ID NO. 18922
ggagtagcggacgggagaccaggagtccaggaccagggagataatcgaggcctcgaatcggtcgacgcgacgagatgtcttcgccagccgagtactacaattcacttccaccaataagcaaggcatatgggacattgtgtttctttaccaccgtcctgtttcatctccatatactgaacccagaatttattggcttatattacccctttgtattcaagaaatttgagatatggaggttatttacaaatttcttttttctgggcctgttttccatcaactttggtattcgtcttctgatgatagcaaggtatggtgtgcagttggaaaagggtgcgttcgaaaagcggactgcagatttcttgtggatgatgatatttggtgccatctcactactggtactgtcagctattcccctatttaagctttcattcttgggaatacctatggtcagcatgcttctgtatgtctggagccgagagtatccaaattctcagataaatatgtacggcctcgtccaattgaggtctttttatcttccatgggctatgcttggattggatgtgatatttggctcaccattactgcctggctttatgggtatcatagttggacatctatactacttccttgcagttttgcacccgctagccactggaaagaattatctgaagactccgaaatgggtgcacagcatcgttgctcgatacaaaataggtgtgcaggcaaactctccggtccgaccagcagccaacgttggtaccggtgccttcagaggaagaagctatagactcaatcaatagattgaccaggatagcgcatcttataatgtgatgctgttgggactgcaatgtagagcagagctcacagctcaggacatagtaaggtcaacaagtttaagggttgctctcttaggggctctagaaaaatctgggcttgttacacttacacggaatggcgaatctttcgagtgctgatttagttcctg

SEQ ID NO: 18922 - protein, 241 aa, Panicum virgatum
  misc_feature: Ceres CLONE 1802838
  misc_feature (11)..(202): Pfam Name: DER1 Pfam Description: Der1-like family
MSSPAEYYNSLPPISKAYGTLCFFTTVLFHLHILNPEFIGLYYPFVFKKFEIWRLFTNFFFLGLFSINFGIRLLMIARYGVQLEKGAFEKRTADFLWMMIFGAISLLVLSAIPLFKLSFLGIPMVSMLLYVWSREYPNSQINMYGLVQLRSFYLPWAMLGLDVIFGSPLLPGFMGIIVGHLYYFLAVLHPLATGKNYLKTPKWVHSIVARYKIGVQANSPVRPAANVGTGAFRGRSYRLNQ

SEQ ID NO: 18923 - DNA, 779 bp, Panicum virgatum
  misc_feature: Ceres CLONE 1802857
  misc_feature: Encodes the peptide sequence at SEQ ID NO. 18924
acgagatccgcagggtgcgcggcggcgggccgtcaaggtcgccggcggcggcggcggcggaggcgttcatcaccttcgaggagctccgggagatgcactacatccacgccgccatcaccgagtcgatgcggctgtacccgccggtgccgatgggcatgcaccactgcaagcgggacgacgtgctgccggacggcacgttcgtggggaaagggtggacggtgaaccactcggtgtacgccatgtcgcggctggagggcctgtggggcaaggactgcgaggagttcaggccggagcggtggctccgggaagacggcacgttccagccggagagcccgttcaggttcccggtgttccacgcggggccgaggatgtgcctcggcaaggagctggcctacatccagatgaagtccatcgtctcctgcgccttcgagaggttcagcttccagtaccggggcggccaggagcaccctgggctggactggacgatcacgctcaggatgaaaggcggcttgccgatgcaagtgaccaagcagcggctggggctagaggcagaggcacctctaggatagatactactcctgtaatcctgtgctgctacttttttgccatttcatatcttatcgcgtctaataatctctgcatgtaatgttcacagctagcctgcctcagatgtaggcacgcacatccatctcgaggccagtccttcggttgtttttgctttgttattctgagacagagagaaataagtgtaaaatactcctacgtgggtggtactcctc

SEQ ID NO: 18924 - protein, 188 aa, Panicum virgatum
  misc_feature: Ceres CLONE 1802857
  misc_feature: SWISSPROT Homolog: EC 1.14.14.1 Unspecific monooxygenase
EIRRVRGGGPSRSPAAAAAEAFITFEELREMHYIHAAITESMRLYPPVPMGMHHCKRDDVLPDGTFVGKGWTVNHSVYAMSRLEGLWGKDCEEFRPERWLREDGTFQPESPFRFPVFHAGPRMCLGKELAYIQMKSIVSCAFERFSFQYRGGQEHPGLDWTITLRMKGGLPMQVTKQRLGLEAEAPLG

SEQ ID NO: 18925 - DNA, 1040 bp, Panicum virgatum
  misc_feature: Ceres CLONE 1802859
  misc_feature: Encodes the peptide sequence at SEQ ID NO. 18926
aaaaccctagccactctcctcccatctagccctcgcagcggcggccgctcccttctcagatctgctgtaccgcgtgccgacgcctcccttccacttcacctccctctcccttcctcagatctgccgccgccctcgatacccctcgccaccaccgaatcgagaggactacacgcgcatggaggaaagggatgtgggagggagagggagatagagacggagcaggcaagccctacccctccaatggctgactccgacgaggcgccgctgtcggtgcaccgccgcctgccgtggcccgctcgcaggagtgggggcgcgagcccttcgcggcagcgctgcgccgccgggtgaggtcaggcgcctcggaggccgcacgcactagcttcgccgccgactctggggacgagtccattgccagcgagccctcctcatctggggacgcaccagagacgcttcgtcagccggcggtggtgccgagggttggagcaggctattcaaggaccatgacctctccatgctctgctcaccgattcaactacacggtggaactgctgagtaggctctgatatccatatatgttgggcctattggccattgttctgaaggtggacaaaggctacttgtgtatgagttcatggcaaatggggggctccaggagcacctctatccaaacagaggttcctgtggtgggatctcaaaattggactgggatacaagaatgagaattgcacttgaagcagcaaaaggtttggaatatcttcatgagcgtgttaatccacctgtcatacacagagacttcaagagcagcaatattcttctggacaaggacttccatgcaagagtttcagactttggtctagccaaacttagatctgatagagctcgtgatcatgtcaactcaagttttagacacaagattatgttgcgtacctttctctataagtgtttcatgattacacatgatctattggatttgattgtgtttttctgtttacaaaacttgtacaaaattatgaagatgacattatgagtttttttttgcc

SEQ ID NO: 18926 - protein, 131 aa, Panicum virgatum
  misc_feature: Ceres CLONE 1802859
  misc_feature: SWISSPROT Homolog: EC 2.7.11.1 Non-specific serine/threonine protein kinase
  misc_feature: Functional homolog of the protein sequence given in SEQ ID NO 50524
  misc_feature: Useful for making plants with modulated nitrogen use efficiency
  misc_feature: Functional homolog of the protein sequence given in SEQ ID NO 50266
  misc_feature: Useful for making plants with altered cell wall content and/or composition
  misc_feature: Functional homolog of the protein sequence given in SEQ ID NO 50776
  misc_feature: Useful for making plants with altered carbohydrate content
MANGGLQEHLYPNRGSCGGISKLDWDTRMRIALEAAKGLEYLHERVNPPVIHRDFKSSNILLDKDFHARVSDFGLAKLRSDRARDHVNSSFRHKIMLRTFLYKCFMITHDLLDLIVFFCLQNLYKIMKMTL

SEQ ID NO: 18927 - DNA, 988 bp, Panicum virgatum
  misc_feature: Ceres CLONE 1802880
  misc_feature: Encodes the peptide sequence at SEQ ID NO. 18928
aatcagcttctatccatctcgccattgaacaatctccgatagctagcagcttgcctgattgatcctcccggaagatcaaacactccaaggacactgaagaaaagatggcggagcgttcagagaacgcggcgggggaaatgatgagcaacatcatggacgccatcgccgagaacctcccgagcaagaagtccgtcaggttcgacgacggcgagggctccatctccgaccaggcccggaagctgttgggcggcaagaagtccgtccaccacgtcctgggcggcgggaagtccgccgacgtgctgctgtggcggaacaagaagatctcgtcgagcgtgctgggcgtggcgacgctggcctgggtcttcttcgagtggctcgactaccacctgctcaccatcgccagcttcgcgctcgtgctcggcatggccgtgcagctcgcctggtctgccctcgcctcgaacgtgccccgcctcgaggtgccggaggagctgttcgcggacgcctgcagggccgccgtcgcgcaggtgaaccgggccctcggcgcgctccaggacatctcctgcgggcgagacctgaggcggttcctcattgtgatcgccgtgttcttcgtggycgccgtcgtcgggagcttctgcaacctgctgacggtcatctacatcgggttcgtgtgcgcgcacacactgccggtgctgtacgagaagtaccaggaccaggtggacgagttcctgtgcaacatgctgggcctgctccagaaccagtaccagaagctcggcagcaagggcgtcctcagcaaagggaaggccaggaagagggactagttcgatctctgctggtgtacatagttagcctcattgcgtgtatgcaatcagctgcgattgcctgaacagcgggtgtctccgtttatttctgccaactcgatgtcctgtacagtgcggaaagaactaccattcttgtgtaatgcaaataatgcttagtagcttcgaacagc

SEQ ID NO: 18928 - protein, 237 aa, Panicum virgatum
  misc_feature: Ceres CLONE 1802880
  misc_feature (62)..(236): Pfam Name: Reticulon Pfam Description: Reticulon
  misc_feature (170)..(170): Xaa is any aa, unknown, or other
MAERSENAAGEMMSNIMDAIAENLPSKKSVRFDDGEGSISDQARKLLGGKKSVHHVLGGGKSADVLLWRNKKISSSVLGVATLAWVFFEWLDYHLLTIASFALVLGMAVQLAWSALASNVPRLEVPEELFADACRAAVAQVNRALGALQDISCGRDLRRFLIVIAVFFVXAVVGSFCNLLTVIYIGFVCAHTLPVLYEKYQDQVDEFLCNMLGLLQNQYQKLGSKGVLSKGKARKRD

SEQ ID NO: 18929 - DNA, 709 bp, Panicum virgatum
  misc_feature: Ceres CLONE 1802886
  misc_feature: Encodes the peptide sequence at SEQ ID NO. 18930
accgccgcagcccgcagtctagcagggatcgcacacgcaagcgcaagcagctggattcgggggctcggctcggtccgtgaggaagctttccggcgagatggcggaggagaagagcgcgctgcagtcggcgagggagtgggtcgtcgaccacaagctccgggccgtcgggacgctgtggctgagcggcatcgtgggctccatcgcctacaactggtccaggccgggcatgaagaccagcgtcaagatcatccatgccaggttgcatgcccaggctctgacactggctgccttggctgggtctgcactggtggagtactatgatcatcagcaaggatcgggatcaaaggttcaccaatatgcaaagcagatcctatcatctgacggcagctcacaaaaagagtaggcagtgtgggtgagttaggcgttggtgacaaattagcagcagtgagacatggaatggatcggatgttattttccgatcaaataatttgtctgtgaaattctgtgggaacttctgaaagctttacctgctgatggctgcccacttctatgagtaaattctgtgggaacttctgaaagctttgcctgctgatggctgcctacttttatgtgtaagctactgaaccagcatttgggatgttgcaatatgccgatagcagatgttccaaatatcttgaatggaatgcccttcatctgccgcttggtatgc

SEQ ID NO: 18930 - protein, 101 aa, Panicum virgatum
  misc_feature: Ceres CLONE 1802886
  misc_feature (4)..(71): Pfam Name: HIG_1_N Pfam Description: Hypoxia induced protein conserved region
MAEEKSALQSAREWVVDHKLRAVGTLWLSGIVGSIAYNWSRPGMKTSVKIIHARLHAQALTLAALAGSALVEYYDHQQGSGSKVHQYAKQILSSDGSSQKE

SEQ ID NO: 18931 - DNA, 990 bp, Panicum virgatum
  misc_feature: Ceres CLONE 1802892
  misc_feature: Encodes the peptide sequence at SEQ ID NO. 18932
atcgaccccgcatttacattacaccacgggcacagtgagccagacagccaacgacgagccaccagcaccaggtctcccagcgacacggcggcgcgcgccacgaccagcagccgccacacacctcgagcgaagaagcagccatggcgacgcgtcgcctcccgtcgtcgtccctcccactgctgctgctccttgcggcgggatcccttgcggtggcggcagcggcggcaggcgcgcttggcggcaactcccccgaggccgacacggacccgaacatggtgccgcgctccggccggagcctgcagcagctgccgcagccggacccgaacccacagccgcagcccggggggaacccgccggtgccacagcccctgccgcaaccaaatccgaacccgccgcagccgcttccacagccacagccgcagcccatgccgcagccgcagcctcagccgcagccgcagccgcagccgcagccgctgcctcagccacagccgcagccagacccaacagccccacagccgcagcccttgccgcagccggacccaggccagcagcagccacagcccgggacgcagccggctcagaatccgcaggcgcagccggaccagctgcttccgagcggcgtcgggtcgaggatgatgctggtgaacctgcaagactccatgtgcatacttctcccaagtcttgcctatctgttagtgtaaccctgtgcaaatactttttttctttttcttccttccttcatttgttagttgttacccgccgcgtctgtatgtaattattaattaaatatatttagtcgcgagatatgtacagttgtatttttttttgcgtacgttgtgggagtgtgtgtagtaattagattgcatagatttttgctagtgtgtggtaacagggcttgcgctgtggcctgtgggtatttggatgtagcttgcgtgtaccatgattgtgtgcctctctgtacatactatacaatacacttgatttacacgg

SEQ ID NO: 18932 - protein, 186 aa, Panicum virgatum
  misc_feature: Ceres CLONE 1802892
  misc_feature: Functional homolog of the protein sequence given in SEQ ID NO 50619
  misc_feature: Useful for making plants with altered lignin content
MATRRLPSSSLPLLLLLAAGSLAVAAAAAGALGGNSPEADTDPNMVPRSGRSLQQLPQPDPNPQPQPGGNPPVPQPLPQPNPNPPQPLPQPQPQPMPQPQPQPQPQPQPQPLPQPQPQPDPTAPQPQPLPQPDPGQQQPQPGTQPAQNPQAQPDQLLPSGVGSRMMLVNLQDSMCILLPSLAYLLV

SEQ ID NO: 18933 - DNA, 1116 bp, Panicum virgatum
  misc_feature: Ceres CLONE 1802920
  misc_feature: Encodes the peptide sequence at SEQ ID NO. 18934
aaagaggcagcgaaccgcaaccgtctttctcgcgaggcagcctcctccttcctcgtcgccggcgacctcgcccgccgccgccaccgcgatgccggtgagggtggtggacaccgcaactccatcgtcgcagccctccccaggccaagagacaaattctgtacacccgtctcctcctagttgttcactcctaagtgccggaagatgttttgctggaactcagaatgtttcaagtctgcagaaggatgaagcatggaaagttaatgtgcgcatccatggttgtgatcttgaacagggttatttatgtggaacaatggaagcgcttaatgttccattagcagatacacctgtagtgacattctgggagggggagatagtagatgctaaaaattacacatttttcactggcaaatgggaagcatcaccagaggatgatataagacactggtccaagttcccatcatttacgcctcttctgagtcaggttgagacagatggtggcaagtcgttagaccttagcaactatcctcatatatttatgagatggaaggagcaatattttgtcaatgttggagttgactgtgggttaaccattgctggtttctactacgtctgcttttcttgtagcgatggatccattagtggcttttattatgatccaagtagcagtccatttcagaagcttgaactgaagtgtaccaatgagaaaaattctggattcaccttttcgtcctatgagctacagtgacaggcttgatgcatctgatggccgacttcctgttagggatcagattcattcaggaatacaatgggctggttgtaaactcttctgtcttatcatgtgcattccatttcagaagcttgaactgaagtgtaccaataagaaaaaaattctggattcaccttttcatcctatgagcttcaggggcagggacagagacagggttaatgcatccaatggtcgactttcagacagggttaatgcatcctctgtgtgtgttcctaatgttgttgtattaaaagaaatgagacggtttgtgtatgtaacagttatttccagcaagactaagcaaccttttgctttgtgatcttaatgaaagcaggcattttttcttgtct

SEQ ID NO: 18934 - protein, 218 aa, Panicum virgatum
  misc_feature: Ceres CLONE 1802920
  misc_feature: Functional homolog of the protein sequence given in SEQ ID NO 50829
  misc_feature: Useful for making plants with modulated low light sensitivity
MPVRVVDTATPSSQPSPGQETNSVHPSPPSCSLLSAGRCFAGTQNVSSLQKDEAWKVNVRIHGCDLEQGYLCGTMEALNVPLADTPVVTFWEGEIVDAKNYTFFTGKWEASPEDDIRHWSKFPSFTPLLSQVETDGGKSLDLSNYPHIFMRWKEQYFVNVGVDCGLTIAGFYYVCFSCSDGSISGFYYDPSSSPFQKLELKCTNEKNSGFTFSSYELQ

SEQ ID NO: 18935 - DNA, 839 bp, Panicum virgatum
  misc_feature: Ceres CLONE 1802922
  misc_feature: Encodes the peptide sequence at SEQ ID NO. 18936
agctaagctagcgatctcgagccggagatctctcccagatcgacaccgtcgatcccaccaggagacgaagctcgtagtcgtagagacccaagcgaggaaacacatccacggagacgatggagacgatggcggcgaacggcgggcgggaggcggcggcgaggacggcgtacgggaagagggacggccagcagcccgccggcgtggggtgcgggcagtgcttccagatgccgctgcactacccgaggtacagccgggaggactacgaggccatgcccaagtggcagctcgaccgcctcctctccgagtacggcctgcccgccaccggcaccatccaccagaagcgcagcttcgccatgggcgccttcctctggggcgccggcggcaacctctgatgactgatgatcgatctagcttgatccacctgctggctgtgccagcagttcgcctacaccaatatagtttccgatcctgatcttgatcgatcagtggcgtcacgtatgtatccagatcgagagatcgtccatctaacttactagcttccttccttccactatgcatattgttaccgtgcgagcgtgtatgcacgttaattgtctagtacagtagtatctaagctagctagttttgtgctcagttcttgtatctttatttggtgaggattcatcaggtcttgtatctaggcgacttagcactaccggcgcatcatcatcccgttgttaccgtactaatatttagcctagatatagtatatattagagagagtcattcacagatctcgtgtactacgtgtttccttgtaaaataatgtgccggtttaatttaaaatatatgtgttgacg

SEQ ID NO: 18936 - protein, 91 aa, Panicum virgatum
  misc_feature: Ceres CLONE 1802922
  misc_feature: Functional homolog of the protein sequence given in SEQ ID NO 50167
  misc_feature: Useful for making plants with modulated nitrogen use efficiency
METMAANGGREAAARTAYGKRDGQQPAGVGCGQCFQMPLHYPRYSREDYEAMPKWQLDRLLSEYGLPATGTIHQKRSFAMGAFLWGAGGNL

SEQ ID NO: 18937 - DNA, 817 bp, Panicum virgatum
  misc_feature: Ceres CLONE 1802925
  misc_feature: Encodes the peptide sequence at SEQ ID NO. 18938
agaacccaacccacgaccccctggcctgggcggccgcgccaaccacaaccaaaaccagaagcaagaagggggcggcgccgcggcgggtagggttttagccgccggcgatggcccactccgcctcctcttccgccctgctccgccgcctcgtctgcagctccaccccagcctcctccgtgtttcgcgctaccgtttgctcctcctcttccggctccggcccgtcgcacaccccgcctcctccgtcctccatattcagcgacgatgcggaggttgccaacgtgccaccgctcaccacccccaagctattcgtcagcggcctttcaaggctaacaacagatgagaagctccaaggcgcgtttgctccttttggtaggctccttgaagcaaaagttgtgacggatagagtttccgggaggtcaaagggtttcggtttcgtgagatatgccactatagacgaggctgagaaagcacggcaggagatgaacgctaagtttctggatggatgggtcatcttcgtcgatcctgccaaaccaaggcaaccaaagcctgctcctcagcaggacacccgttcttcacacgctggcttcacaacgaacaagacagtaggatggtgtggctaattgcaacaaactgttgttatattgcacaacttggttgagggagtagcagaaacaccatagagtagtttgatttgatacaggcaatggtgggctggagatacaattttcttattggcgcaacatttttgttctatgaattatgggtcgccttctgagttttccattgcggatttaggggttgtttggttcgagtggct

SEQ ID NO: 18938 - protein, 170 aa, Panicum virgatum
  misc_feature: Ceres CLONE 1802925
  misc_feature (66)..(137): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50830
  misc_feature: Useful for making plants with modulated cold sensitivity
MAHSASSSALLRRLVCSSTPASSVFRATVCSSSSGSGPSHTPPPPSSIFSDDAEVANVPPLTTPKLFVSGLSRLTTDEKLQGAFAPFGRLLEAKVVTDRVSGRSKGFGFVRYATIDEAEKARQEMNAKFLDGWVIFVDPAKPRQPKPAPQQDTRSSHAGFTTNKTVGWCG

SEQ ID NO: 18939 - DNA, 819 bp, Panicum virgatum
  misc_feature: Ceres CLONE 1802945
  misc_feature: Encodes the peptide sequence at SEQ ID NO. 18940
ctagtcagccggatcgctgcgtcgctccgccgctccgcctcctcctcggcctcccaccctcgcgcggcgccttcctcggttcttcggtccagcttgggagatgtcggactccgaggagcaccatttcgagtcgaaggccgacgccggagcgtccaagacttacccgcagcaggccggcaccatccgcaagaacggctacatcgtcatcaagggccgcccgtgcaaggtggttgaggtctccacttccaagacagggaagcacggtcacgcgaaatgccacttcgtggccattgatattttcaacggaaagaagcttgaggatattgtaccctcttcccataactgtgacgtgccccatgtcaaccgtactgactaccagctgattgacatatctgaagatggatttgtcagccttttgactgaaaatggaggcaccaaggatgatctgaggctccctactgatgaaactctgctttcccagattaaagctggattcgatgatgggaaggacctgattgttagtgtgatgtctgccatgggtgaggagcagatctgcggtctgaaggatatcggcaagaactagagcttcattgccactggtggttatttatctggccgtctatctgggaggtggtgtgttgatgatataagcgtgtttggttatgagtaacatgcttgtggactgccgttttgtcttgccgtttatgcagagtgatttggatgtacctttgctatctgtaatgttcttttgaaccaagtagcttggctacacctcatcgaaatcatttgcatcaagtttgtgttggcattttcccagtg

SEQ ID NO: 18940 - protein, 160 aa, Panicum virgatum; identical to SEQ ID NO: 10137
  misc_feature: Ceres CLONE 1802945
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif

SEQ ID NO: 18941 - DNA, 908 bp, Panicum virgatum
  misc_feature: Ceres CLONE 1802953
  misc_feature: Encodes the peptide sequence at SEQ ID NO. 18942
aaattcccccgactcctcgcttcctcccgtttgtggccgagccccccgcgacacgccgtcgccgccgcgcgcgcctagaagagagggaggcggccgcagcatcgaccccgcgccacccctcctgatcccccggcatcgatcgggtttgatccatggcgtcgaagaggatcctgaaggagttgaaggacctgcaaaaggacccgccaacgtcctgcagcgcaggtcctgttggtgaggacatgttccattggcaagccactatcatggggctttcggacagcccgtttgctggtggggtattcttggtgaacattcatttcccacctgattatcctttcaaaccaccaaaggtgtcatttcgcactaaggtgttccacccgaacattaacagcaatggcagcatttgccttgacattctcaaggaacagtggagccctgctttgaccatatcaaaggtgctcctctcaatctgttcgctgctcacagacccgaaccctgatgatccgcttgtgcctgagattgctcacatgtacaagactgatagggccaagtatgagtcaactgctcgctcctggacgcagaagtacgccatgggctagaagaaaggccaattggtgaatgtgcgcaaccctgaaacgttatcacctaaataaccagccaagtcactctccccgcaaccaagtatgaatggacttttgagggctattgtgtcctgttgaactcatatgtattaccttgtgaagtccgttgagtctggtagtctgttctacctgactgatccgttatctgatgttgcatcgttaatcatatttgtattgttcgtggtgtccgttgtttccgttgcatatatactaatctgctaattcatctggcataactggacgaacccggatgggcagttggattcc

SEQ ID NO: 18942 - protein, 148 aa, Panicum virgatum
  misc_feature: Ceres CLONE 1802953
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
MASKRILKELKDLQKDPPTSCSAGPVGEDMFHWQATIMGLSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 18943 - DNA, 903 bp, Panicum virgatum
  misc_feature: Ceres CLONE 1802960
  misc_feature: Encodes the peptide sequence at SEQ ID NO. 18944
atttcgcccccgctccctccctctctcccagtctccacgccgcgagggtgacggaagacgcggcgcgagcgagagaaggagggccaggggaaaagggccgccctagacactccgtccgcgccgccgatctccgcgtcgccgccgcctcagattgtggcagctttcaagatgtcgatcaacacatttgctactccctgcgtgctgttgagcaatgttagaacacagaccccacagacagcagtgaagagcccttcatctctaaacttcttcagccaaggcatgaaggttccaagcctgaagacctccaagaaactcgacgtctctgcgatggctgtgtacaaggtgaaacttgtcacaccagaaggggtagagcatgagtttgaggctccagatgacacctacatcctcgatgcagctgagaccgccggagtggagttgccatactcgtgccgtgccggagcttgctccacctgcgctggcaaaattgagtctggtgaggtcgaccagtcagatgggtccttccttgatgacgggcagcaggccgagggctatttgctgacatgcgtctcctaccccaagtctgactgtgtcatccacacccacaaggaaggtgacctgtactagggcttttcagtctggcaagggaccaatgctatcgagtgtgttgtcaagcaagctgcatccttactacaagttgtgcggcatcagacttgcatggtggttgtcttgtttttccgttagtgtgagttcagggaatcagggttggcacattaagattgggaacccgtgggaatactagctagcaataaaaactggtgcgatgccataatagtataaactttatgtggttgcttttttgtatgttggggtacctcttttttcagttgttgattctggatctcg

SEQ ID NO: 18944 - protein, 151 aa, Panicum virgatum
  misc_feature: Ceres CLONE 1802960
  misc_feature (62)..(138): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSINTFATPCVLLSNVRTQTPQTAVKSPSSLNFFSQGMKVPSLKTSKKLDVSAMAVYKVKLVTPEGVEHEFEAPDDTYILDAAETAGVELPYSCRAGACSTCAGKIESGEVDQSDGSFLDDGQQAEGYLLTCVSYPKSDCVIHTHKEGDLY

SEQ ID NO: 18945 - DNA, 678 bp, Panicum virgatum
  misc_feature: Ceres CLONE 1802969
  misc_feature: Encodes the peptide sequence at SEQ ID NO. 18946
tttagagtcggaacacatgaagaagttctttgactatatacagcttccaaattttgacatagcttctgatgcttctgcaacctttaaggaactattgacaaggcataaagcaaccgtggctgaatttctcaccaataattatgattggttctttgaagaattcaacactaggttgctatcgtccaccaactacataacgaaaaggcaagctatcaagttgttgggagatatgctgctggataggtcaaatgctgcagtcatgatgcgctatgttagttccaaagacaatcttatgattctgatgaatctcttaagggattcaagtaaaaatattcaagttgaggcatttcacgtgttcaagctatttgctgcaaataaaaacaaaccggctgaggttgtaaacatactggtcactaataggagcaagcttcttcgcttttttgctgggttcaagattgacaaagaggacgagcaatttgaagcagacaaggagcaggtcattaaagaaatatcggcactttgagtgtctcaggatgtaattagtcattgtaatgaattttcttttgttaagaaagtgcatgtgtaataataaacctctgtgtattattatattggatttagcggaacaatgtgaccaagttggagttggttcttccgtgaaaatgtgataatctcttt

SEQ ID NO: 18946 - protein, 173 aa, Panicum virgatum
  misc_feature: Ceres CLONE 1802969
  misc_feature (1)..(173): Pfam Name: Mo25 Pfam Description: Mo25-like
LESEHMKKFFDYIQLPNFDIASDASATFKELLTRHKATVAEFLTNNYDWFFEEFNTRLLSSTNYITKRQAIKLLGDMLLDRSNAAVMMRYVSSKDNLMILMNLLRDSSKNIQVEAFHVFKLFAANKNKPAEVVNILVTNRSKLLRFFAGFKIDKEDEQFEADKEQVIKEISAL

SEQ ID NO: 18947 - DNA, 724 bp, Panicum virgatum
  misc_feature: Ceres CLONE 1802973
  misc_feature: Encodes the peptide sequence at SEQ ID NO. 18948
acactgccaagtctgccattcagacaggagcaggaaccaggaatttctccccaccccagcaggcagcagtagggcgggcgacaagcggctgaagcgagcgagatggcctggggaagaggcagtgcgagcgcgagccgcgccatggccgccatggcgttcgccgtcgcctgcttctgctgctccgtcctcgccgccgacgcgggcgccacctactacgtcggggacggcaacggctggtccttcggcagccccagctggcccaacggcaagcacttccacgccggcgacaccctcgtgttcaggtacgtcccctggatccacaacgtggtggcggtggacgaggacgggtacaacggctgcacgacgccgccggggtcgcggacctacacgtcgggaaacgaccgcgtcacgctcgccagaggggacaacttcttcatctgcacccgcttcggccactgcaacctcggcatgaagctcgtcgtctacgccgcctgagcgcgcggcggcggccacggtcggggctcaagctgggtggtttctcggttctactaggagtacttggtgcggctctggccgcgtgtggactgactggatgtgcttttgctcagttgcacttgagtgaactgctttgatttctactgctactgctacttcatgtaatccattgttaatggcatattttgcctggacatttgctgtccatgaaaaatcgtttgacattttc

SEQ ID NO: 18948 - protein, 130 aa, Panicum virgatum
  misc_feature: Ceres CLONE 1802973
  misc_feature (45)..(123): Pfam Name: Cu_bind_like Pfam Description: Plastocyanin-like domain
MAWGRGSASASRAMAAMAFAVACFCCSVLAADAGATYYVGDGNGWSFGSPSWPNGKHFHAGDTLVFRYVPWIHNVVAVDEDGYNGCTTPPGSRTYTSGNDRVTLARGDNFFICTRFGHCNLGMKLVVYAA

SEQ ID NO: 18949 - DNA, 764 bp, Panicum virgatum
  misc_feature: Ceres CLONE 1802977
  misc_feature: Encodes the peptide sequence at SEQ ID NO. 18950
aattcgtcctcttctcctttcccctcgacccgacgccagcccagtcgacgcctctccccttctgctcagtccgccggcctcaagccatcaccgaaccatcgcccttccctcgaggatggattggcaggggcagaagctcgcggagatgctgatgcaggtgctgcttgtggcgtcggccgtggcggcgttcctggcgggctacgtgcgcggggacttccagttcatgctgctcgtctacgccgccagcgtcgtgctcacggcgctcgtcaccgtccccaactggcccttcttcaaccgcaacccgctcaagtggctcgacgccgccgaggccgagcgccacccgcgcccgcaggtcagcgccgccggcgcgggggcagggggcaagaagaagtccggcaagaacaagtagtcggtctttcagaggcaatatgtgttgtcgatccatatgactcaacttgttttggtactgtttccagagctatatgacattgcaacattagacaattgcagtactaagttaacagatctgctgaaagttagcttgcaattttgcatgcttggttatatctgctgctatgatccaaaaaagttgcaacatgcttagtgatggtcttgcgctatcaggctaacattggctaagagagctcccctttatttcacctgccagcacacaatttttcttacgcagcgttttggtggctatctatagttggctaataactaatatttgcagagattgtgtagttccaatttgagttgagccc

SEQ ID NO: 18950 - protein, 97 aa, Panicum virgatum
  misc_feature: Ceres CLONE 1802977
  misc_feature (1)..(80): Pfam Name: SPC12 Pfam Description: Microsomal signal peptidase 12 kDa subunit (SPC12)
MDWQGQKLAEMLMQVLLVASAVAAFLAGYVRGDFQFMLLVYAASVVLTALVTVPNWPFFNRNPLKWLDAAEAERHPRPQVSAAGAGAGGKKKSGKNK

SEQ ID NO: 18951 - DNA, 981 bp, Panicum virgatum
  misc_feature: Ceres CLONE 1802979
  misc_feature: Encodes the peptide sequence at SEQ ID NO. 18952
agggtggagctagagagagagagagggggagccggggattgggggcggatggctctgctgcagtgccagagcctgcccggcattggctgcagcggcatcgccctggcacgagcgagggtgcagcaatgtctggcagcggcgtcacacgcgccccttccgcctcccctcctgcgcgccaatggcggcacgagcacgacgggccgctcccctgcctccgttaaggccggcgatgcgataggcttcggccggcggggacggaggggcctgcgcgtcgtcgcggaggcggcggcggcggccaaggtcacgccggtgtcgcctggcggcgtcagcatcagcgacgtgctctggccttccgccggagcattcttggccatggcagtactggggaaacttgaccaggtggtggcgtacaagggagtctccttgacgattgcgccccttggagcggtctgctgcgtgctattcagcgctccaggctcacctgcagccaagaaatacaatatgttcgttgcacagattggttgtgccgcattaggtgtattggccctttcgttgtttgggccaggctggttagcaagagctgcagctctttctgcctgcatagcgttcatgaccatcacaggtgcctcacatcctccagctgcaagcttgcccctcttatttattgatggcccgaagtttcacaatttgcaattttggtatgcactttttcctggagctgcaggttgcgttgtcctttgcttgattcaagaggtggtggtttacctaaagaagaacttcaagttttgattcaagcagcatgacttcatgacttcttgtggcagtgattccattatttattcaatcatgtaccataaataacatgacctgcatttgcaagaagatgagaaaatgtaggtttactgtcacttggttaaagatgaaaaaagactttccttgatactttctactgatcaaagtgcagagctacaaacgtgaagt

SEQ ID NO: 18952 - protein, 246 aa, Panicum virgatum
  misc_feature: Ceres CLONE 1802979
  misc_feature (112)..(243): Pfam Name: HPP Pfam Description: HPP family
MALLQCQSLPGIGCSGIALARARVQQCLAAASHAPLPPPLLRANGGTSTTGRSPASVKAGDAIGFGRRGRRGLRVVAEAAAAAKVTPVSPGGVSISDVLWPSAGAFLAMAVLGKLDQVVAYKGVSLTIAPLGAVCCVLFSAPGSPAAKKYNMFVAQIGCAALGVLALSLFGPGWLARAAALSACIAFMTITGASHPPAASLPLLFIDGPKFHNLQFWYALFPGAAGCVVLCLIQEVVVYLKKNFKF

SEQ ID NO: 18953 - DNA, 797 bp, Panicum virgatum
  misc_feature: Ceres CLONE 1802980
  misc_feature: Encodes the peptide sequence at SEQ ID NO. 18954
ctcgctaaccctagcccccgcctcccacctgctccccgccgccgccgcaagtagtaccagccaggatgccggccggccacgggctgcgctcgcggacgcgcgacctcttcgcgcgtcccttccgcaagaaggggtacatcccgctcaccacctacctccgcaccttcaagatcggcgactacgtcgacgtcaaggtgaacggcgccgtccacaaggggatgccgcacaagttctaccacggccgcaccgaccgcgtgtggaacgtcactaagcgcgccatcggcgttgagatcaacaagcaggttaatggccgcatcatcaggaagcgtatccatgtccgtgtggagcatgtgcagcagtcccgctgcactgaggagttccgccagaggaaggcaaagaatgaccagctgaaagcagatgccaaggcacgcggtgaggtcatcagcaccaagaggcagccgttgggtcccaagcctggcttcatggttgaaggtgctaccatcgagaccgtcacccccatcccatatgatgttgtcaacgatctcaagggcggttactaggttgctcggtctatctagcggcactaccagttctatatctgtattactctagtgggtacaattttgctctgtccgagcagtagtctggacctattctgtgtgtttctgttgaaagattttccattctaggtgcaaacctgagttcggcagaacgctcgatactgttatgtttgcttctgtgaacgaagatgtgcttttttttaacctgctatgatacccaaagatttgtaaggtgcc

SEQ ID NO: 18954 - protein, 164 aa, Panicum virgatum
  misc_feature: Ceres CLONE 1802980
  misc_feature (2)..(100): Pfam Name: Ribosomal_L21e Pfam Description: Ribosomal protein L21e
  misc_feature: Functional homolog of the protein sequence given in SEQ ID NO 50444
  misc_feature: Useful for making plants with modulated flowering time
MPAGHGLRSRTRDLFARPFRKKGYIPLTTYLRTFKIGDYVDVKVNGAVHKGMPHKFYHGRTDRVWNVTKRAIGVEINKQVNGRIIRKRIHVRVEHVQQSRCTEEFRQRKAKNDQLKADAKARGEVISTKRQPLGPKPGFMVEGATIETVTPIPYDVVNDLKGGY

SEQ ID NO: 18955 - DNA, 438 bp, Panicum virgatum
  misc_feature: Ceres CLONE 1802985
  misc_feature: Encodes the peptide sequence at SEQ ID NO. 18956
gtgctctctcagaggtgggttggcttctcctccccctccggttcgcggttcggttcggtccgggttcgtgaggttcttgggggggagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcacgcgatgcgcgatgccatcgaggggatgaacgggaaggagctggacggccgcgccatcaccgtcaaccaggaccagtcccgtggcggcccgcgctccggcggctgcgcgcgagcggcgccggcgggttacgggctcggaaaggactgctgccctgacgacgtct

SEQ ID NO: 18956 - protein, 114 aa, Panicum virgatum
  misc_feature: Ceres CLONE 1802985
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDNSLHNAFSPFGEVLESKIILDRETQRSRGFGFVTFSSEHAMRDAIEGMNGKELDGRAITVNQDQSRGGPRSGGCARAAPAGYGLGKDCCPDDV

SEQ ID NO: 18957 - DNA, 300 bp, Panicum virgatum
  misc_feature: Ceres CLONE 1802985-R
tacggcaactccgatgggaactggaggagctgagcggtggggcccgcgtggccaagttatcctgtccttgctactgttacctgagttatcctgtgccatgatctacctgtgtttggtgtctttcgtgttcgttgttgcccatctgtgtttttgatcgcaagctcgttcgtctagtggtcatgttgttgtctgtcagagctatcttgacctccatcccatgaaccggggtgttggaattggatgctgttatcttgtgtaacttgttaccgtttcagttaatggaatggaaaaaaagttgcc

SEQ ID NO: 18958 - DNA, 934 bp, Panicum virgatum
  misc_feature: Ceres CLONE 1802986
  misc_feature: Encodes the peptide sequence at SEQ ID NO. 18959
acgttggcctgcctaaactgaaccttccaatggctgccgccgcctcctccaccgctgccgcctccggtgtcgtgcttccccacgccttcctctcccaccgctcgccgccgccgcaggtcgtcgccgtggcctcctcgttccgccggctctccctgtgcgcctcccctcgccggaccacccacctagtcgcccgcgccgacgccggcgccgaagctgccggggaaccggagcctgaggctgaggccgagcctgccactgcctcagctgacgccgaggagggggaggccgagggggctgtcgcggtggccgaggaagaggaggcagaggaaccgccgccgagcaagccgaaggttaagttcggcgaaatcatcgggattctgaacaagcaattcattgaggaggccgagaaggtgaagactgtaccagatctgaggcctggggacatcatcgagctgaggatgcaacggcccaacaagaggagattgtcactctttaagggaataatcatcgcaaagcacaaagctggtgttcacaccacaatccgtgtcagaaggatcattgctggtgtaggagttgagattaccttcccagtgtattcacccaggatcaaggagatcaaagtaatcaggcacaagaaagtgaggcgagcaaagttgtactacttgaaacacaagcttccccgcttttcaaccttcaagtaaaatcagatgtgacgacagaacagcttctccctccaccattttgatttctcctatcaaacaattttcacttccctgcccaaatcagggcatttcactgtattacctggatatcaaaggtgtaatatgtacggcttcatagcatattttggtttgcagggcaatgtttcttttgtccttagtgtacaaaatcatactaagaccatcttattttgaattaatctcgtctttttatg

SEQ ID NO: 18959 - protein, 223 aa, Panicum virgatum
  misc_feature: Ceres CLONE 1802986
  misc_feature (119)..(216): Pfam Name: Ribosomal_L19 Pfam Description: Ribosomal protein L19
MAAAASSTAAASGVVLPHAFLSHRSPPPQVVAVASSFRRLSLCASPRRTTHLVARADAGAEAAGEPEPEAEAEPATASADAEEGEAEGAVAVAEEEEAEEPPPSKPKVKFGEIIGILNKQFIEEAEKVKTVPDLRPGDIIELRMQRPNKRRLSLFKGIIIAKHKAGVHTTIRVRRIIAGVGVEITFPVYSPRIKEIKVIRHKKVRRAKLYYLKHKLPRFSTFK

SEQ ID NO: 18960 - DNA, 969 bp, Panicum virgatum
  misc_feature: Ceres CLONE 1802989
  misc_feature: Encodes the peptide sequence at SEQ ID NO. 18961
gagaaaacaggaagaaaaaaaaaaaaaccaaacccgcatccgcacccgcacccgcgtccgcgtgctccgctccgcccttcccatccggcacccgctccctctcctctcctgcaccgcccgttcccgccgccgccgccggcccaagtgagggaccaggcaggcagcccgcccccgtgccgccgaagccgcggagcagcgcgcgattccgggggccgaccgtccgtcccaggcggcgatggcgtaccgggcggaggacgactacgactacctcttcaaggtggtgctcatcggggactccggcgtcggcaagtcaaacctgctctcccgcttcacgcgcaacgagttcagcctcgagtccaagtccaccatcggggtcgagttcgccacccgcagcatccacgtcgaggacaaggtcgtcaaggcccagatctgggacaccgccggccaggaaaggtaccgagctatcacaagtgcatactaccgtggagcagtaggggcactagttgtctatgacgtgacacgccatgtcacctttgagaacgtggagaggtggatgagggagctcaaggaccacacggacgccaacatcgtgatcatgctcgtcgggaacaaggcggacctgcgccaccttagggctgtctcgacggaggatgcaaaggccttcgccgagagagagaatgccttcttcatggagacgtcagccctggaggcgatgaatgtggaggatgccttcaccgaggtgctcacacagatctaccgcgtgataagcaagaaggctcttgacatcggcgatgaccctgcggcgcctcccaagggccagaccatcaatgttggcggcaaggatgatgtgtcggcggtgaagaagtctgcttgttgttcgtcttagcttgaaaggatagaacatgtacttgggttggtcaatacattttgcagtagcgggcacaggaagttatggcagtgatggtcctc

SEQ ID NO: 18961 - protein, 216 aa, Panicum virgatum
  misc_feature: Ceres CLONE 1802989
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MAYRAEDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELKDHTDANIVIMLVGNKADLRHLRAVSTEDAKAFAERENAFFMETSALEAMNVEDAFTEVLTQIYRVISKKALDIGDDPAAPPKGQTINVGGKDDVSAVKKSACCSS

SEQ ID NO: 18962 - DNA, 846 bp, Panicum virgatum
  misc_feature: Ceres CLONE 1802999
  misc_feature: Encodes the peptide sequence at SEQ ID NO. 18963
aaagccaggccaggccagccagcgagagccaagccgcactgcctccccgagtcctccactgccaccgcccgctccgcgacgcgatggccgcgctccgcctcgcctccttcaccctccgcccggcctccgcggcggtatccccctcctccgccgcggccgacgccgcggcggagggctacgcgaccgcgctgtccgaggtggccgccgagaacggcaccctcgagaagaccgtgtccgacatggagaagctggagaagatcttcgccgacgaggccgtcgccgagttcttcgacaaccccaccgtgccgcgcgaggtgaaggcccagctcatcgacgagatcgccaagtcgtccgagctgcagccgcacgtcgtcaacttcctcaacgtcgtcgttgacaacttccgcgcgggcatcgtgccgcagatcgtcgccgagttcgagaacgtctacaacgcgctcagcggcactgagctcgccaccgtcacctccgtcgtgcagctcgaatcgcaggacctcgcgcagatcgcgcagcacgtccagaagatgaccggcgccaagaacgtccgcctcaagacacagctcgacccggagctcatcgccggcttcaccgtgcagtacggccgcgacggatccaacctcatcgacatgagcgtccggaagcagattgaggagatcgcctcagagttcgagttgccctccgttgccctcgaagtctgatccggctttaggcgtcaatcctcgcccttgaagcctaggtccatcctgctccccctgctcttcttctgtatcattctctggttgaatgagtgatgaatactatataactggattccaggattggtat

SEQ ID NO: 18963 - protein, 211 aa, Panicum virgatum
  misc_feature: Ceres CLONE 1802999
  misc_feature (28)..(202): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPASAAVSPSSAAADAAAEGYATALSEVAAENGTLEKTVSDMEKLEKIFADEAVAEFFDNPTVPREVKAQLIDEIAKSSELQPHVVNFLNVVVDNFRAGIVPQIVAEFENVYNALSGTELATVTSVVQLESQDLAQIAQHVQKMTGAKNVRLKTQLDPELIAGFTVQYGRDGSNLIDMSVRKQIEEIASEFELPSVALEV

SEQ ID NO: 18964 - DNA, 638 bp, Panicum virgatum
  misc_feature: Ceres CLONE 1803010-R
  misc_feature: Encodes the peptide sequence at SEQ ID NO. 18965
ggacaatgcgtccctctagcaggctttcgcctcatacggcgacgtcctcgactccaaggtcgtcaccgaccgtgagacggggaggtcccgggggttgggcttggtcaccttgtcaaccgagcagtcgatgctcgaggccatggaagccatgaacggcaaggagctggagggccgcaacatcgccgtcaaccaggcccaatcccgcggcggtgggggcgggggcggcggcggcggttacggcggcggtcgccagggaggctagggggggggcggcggcggctacggcggcggtcgccgtgagggcggctacggtggcggcggctacgacggtggcggtggcggatacggcggcggtcgccgcgagggcggctacggcggtggtggctacggcagccgcggtgactccggtggcaactggaggaactaatgggggggccctcccgtgctggcagccaagttatcctatatatctattagtgttcgtgttaccatttgatccgagttaccccagagtttggtgtccgtgttacctgttggttcccatgttaccgttcccgagttgtttcggcaatgaaatgagaagaaaagagtgagcaaggtttttgttcgcatctcttgcggtgctctgattgggtttc

SEQ ID NO: 18965 - protein, 44 aa, Panicum virgatum
  misc_feature: Ceres CLONE 1803010-R
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MLEAMEAMNGKELEGRNIAVNQAQSRGGGGGGGGGGYGGGRQGG

SEQ ID NO: 18966 - DNA, 667 bp, Panicum virgatum
  misc_feature: Ceres CLONE 1803010
gcgctctctccgaggtgggttgccttctccccctcttagcagctcctccgatctagggttttacttggaaggggagatggcggcggatgatgtccattaccgccgtttcgccggcgaggctcccctcccccaccacaccacgcctacccctccccggccttcttctcctacggatacatcctccactccacagccaacggcacttcgagatgcttttacgtccctcggggacgttttcctcgccctatttgccgacacaccctgtccctggttcctccaaggggtttggctttgtagaatatgctacccctgacatacgccggcaaaggaatagaacgaatggatggaaagttccttgatggatgggttatttttgcggaataccctaaacccaaaccagcaccccaggaagcagagatgaactcgcagccacaacaatcatggggtcctccatcaagttcctggggttcacagtacatgaagagctgccagccctctatccagccttggggctcacagtggatcaagaggccatcaattcagcatctaatttatagatattgtgtgtgctgtgcgaggtgtgaatgccctagacgatccgatattcttgccgtgttggagtggtcgtttactcgggtccatgatttccacatgaagaggtagttgt

SEQ ID NO: 18967 - DNA, 622 bp, Panicum virgatum
  misc_feature: Ceres CLONE 1803014-R
  misc_feature: Encodes the peptide sequence at SEQ ID NO. 18968
tgcggtgccgtcggccgccgtggtccgcgcggccgtccaggggcaagtgccccctgaacacgctgaagctgctggcgtgcgtggacgggctcaacgggctggtgcacgctgtggtgggggccaaggccagcgagaagtggtgcccgctgctgcaaggcgtggcggaccttgacgccgcgttctgcctctgcaccgccatcaaggtcagggggctcaggatcaacttggtgctctccatggccattgaggtgtttgtcaacgagtgccacaagaacgtccccgccagcttccagtgcctcgtaatcacacactcactcatcattattgcgtatgtatgtaccattaattaattatacatctgcatgcatgcatccatgcatgatgggttaaggttatgataaaccagtcatatattcatatatctatatatatcttaagcatgtacgtatagcttaatgcatgagctttttttggtttgtgatataaagggagctgtggattgtccatttgtttttgtaattgtgtatcaatattgtaacatgaaccagtgtgagagttgtgggcttggaacttgtagtgaccaaaaagatttatatgaataaagcgtgtgtgtcatacaggt

SEQ ID NO: 18968 - protein, 115 aa, Panicum virgatum
  misc_feature: Ceres CLONE 1803014-R
  misc_feature (16)..(98): Pfam Name: Tryp_alpha_amyl Pfam Description: Protease inhibitor/seed storage/LTP family
RCRRPPWSARPSRGKCPLNTLKLLACVDGLNGLVHAVVGAKASEKWCPLLQGVADLDAAFCLCTAIKVRGLRINLVLSMAIEVFVNECHKNVPASFQCLVITHSLIIIAYVCTIN

SEQ ID NO: 18969 - DNA, 592 bp, Panicum virgatum
  misc_feature: Ceres CLONE 1803014
accactccagctgagctcagctgtagcctagctagctaggtagctaataaatccatcacttccccgcgccatggcgaagaaccaccacctcattgtggcgctcctgctcgtctcggacacatctggacgcgcaggtcgtcgcgccggccgcggcctgcccgtcctgcccgacgcctaagcctccgccgccgcccccgacgcccgtgccgtgcccgccgccgccgtctcccgccccgccctccagcgggcaagtgccccctgaacacggtgaacctgctggcgtgcgtggactccctcaacgggctggtgcacgccgtggtcggccccaagaccaccgacaagtgctgcccgctgctgcgccgcgtgacccacctcaacaccgcgctctgcctctgcaccaccatcgacgtcaccgtcctcagcatctgcctcgtgctccccatcttcctcgacgtgctcgccaccgactgccacaagaacgtctccgtcagcttcctatgtccgcattcccactcaccctcaacgatattgcggatgtactgtcccattaattaaatatacatctgcatgcatgctatccatgcaagatagg

SEQ ID NO: 18970 - DNA, 886 bp, Panicum virgatum
  misc_feature: Ceres CLONE 1803022
  misc_feature: Encodes the peptide sequence at SEQ ID NO. 18971
aatccctcttccccaatctctcgccctcctgcctcccccgtgcgccgcagctagaaagctagggtttcgcctgcgatccgatccgtcgagtccaccctccccacccagatcgatggcggccgagggcgataagaagatgatcaccctcaagagctcggacggcgaggagtttgaggtggaggaggcggtcgccatggagtcgcagaccatccgtcacatgatcgaggacgactgcgccgacaacggcatcccgctccccaacgtcaactccaagatcctctccaaggtaatcgagtactgcaacaagcacgtccacgccgcggccgcagcggccgcggcgtccaaggccgactccgacgatgcgggggcagccgtcgccaacagcaacgctgcctccggtgaagaccttaagaactgggacgccgacttcgtcaaggtcgatcaggccacgctgttcgacctcatcttggctgcaaactatctcaacatcaaggggctgctggacctgacgtgccagactgttgctgacatgatcaagggcaagactcctgaggagatccgcaagaccttcaacatcaagaacgacttcacccctgaggaggaagaggagatccgcagagagaaccagtgggccttcgagtagagaggcgcttgagcccctgatctcttgatgcctaggttttgtcgtacctattaccttgcaatgtctgcttttatgtgtcgtcgtaatggttgtaagtattttgggagttgctgtggttggtttgagaacaagtgttgatcatcttgggtaaaaactgatgctgtcactggtcagttattctgaaccaattatctctagttaaatatcatgaaaagactaagtggctgctgccctaagaggttc

SEQ ID NO: 18971 - protein, 176 aa, Panicum virgatum
  misc_feature: Ceres CLONE 1803022
  misc_feature (99)..(176): Pfam Name: Skp1 Pfam Description: Skp1 family, dimerisation domain
  misc_feature (8)..(68): Pfam Name: Skp1_POZ Pfam Description: Skp1 family, tetramerisation domain
MAAEGDKKMITLKSSDGEEFEVEEAVAMESQTIRHMIEDDCADNGIPLPNVNSKILSKVIEYCNKHVHAAAAAAAASKADSDDAGAAVANSNAASGEDLKNWDADFVKVDQATLFDLILAANYLNIKGLLDLTCQTVADMIKGKTPEEIRKTFNIKNDFTPEEEEEIRRENQWAFE

SEQ ID NO: 18972 - DNA, 1069 bp, Panicum virgatum
  misc_feature: Ceres CLONE 1803049
  misc_feature: Encodes the peptide sequence at SEQ ID NO. 18973
gcttatccctccgcgaactcgcctcccatcatggcggcggcatcggcggcggcggcgaccctcctccgcctccctctcgcccgtctcaaccaccacctccgctccgtacctacccctggtgtcccgcccccacgcctccgcatctccacctcctaccgcttcctctcctccctgggccacggctccgcctccgcggccgtggccgaggcggtagccgcgccggacgcggagggggacctggtcgatgcagaggaagagagtcacaaggaggagtctacggccgaggcggaggcggaggcgccccggtcgttcgtgctcccgcggctgccgcggctgaagctgagcgttaaggagcgcaaggagctggcctcgtacgcgcacggcctcgggaagaagctcaagtcgcagcaggtgggcaagggcggcgtcacacccaacctcgtctccgccttcagtgacaacctcgagtcgaacgagctcctcaagctaaagattcacgggaactgccctgcggaactaacctctgtgatactgcaacttgaggagtcaacaggatctattgctgttgaccaaatcggccgctcaattattctgtataggcctagcactagcaagatgaaaaagaggcaagaggttgctgaaaatgctaggagatttgcgagagctaaagaagaaaatgctaggcgatttgtaaaatctgaggaatcatttgaagaacgtcctagaaacagcccaggcagaagatttgttaaatctggatccacatttagctctcagcagaagaggagaccaatggcatccaagggatcgtcatacagccgagggtagcagcagcataaaaaggtatatggcttgttttcttgttgtctggactctggagagaccatgtaaattttagacaaactagctggtatatggatgctagtgctaattctagtctttgccagtaagctacggttccaacttccatgtctcattcatcaaccacaacaaaatagggacaagctactttatgcccagactaaaaacatgagataacctaattgatctacatatctgacctactcgg

SEQ ID NO: 18973 - protein, 265 aa, Panicum virgatum
  misc_feature: Ceres CLONE 1803049
  misc_feature (104)..(190): Pfam Name: CRS1_YhbY Pfam Description: CRS1 / YhbY domain
MAAASAAAATLLRLPLARLNHHLRSVPTPGVPPPRLRISTSYRFLSSLGHGSASAAVAEAVAAPDAEGDLVDAEEESHKEESTAEAEAEAPRSFVLPRLPRLKLSVKERKELASYAHGLGKKLKSQQVGKGGVTPNLVSAFSDNLESNELLKLKIHGNCPAELTSVILQLEESTGSIAVDQIGRSIILYRPSTSKMKKRQEVAENARRFARAKEENARRFVKSEESFEERPRNSPGRRFVKSGSTFSSQQKRRPMASKGSSYSRG

SEQ ID NO: 18974 - DNA, 862 bp, Panicum virgatum
  misc_feature: Ceres CLONE 1803063
  misc_feature: Encodes the peptide sequence at SEQ ID NO. 18975
attaattcccactcaccttataattccaagcaagctagtaggcatggacgccatcttggccgacgccgccatcgcgcgcgcgctccacctgtcggccatgtcctcccactccgccgcctccctcgtctcagcgcccgcgccgcaccaccaacaatcgccgctgctcgccgccgcccacctgccggcgcatctcacccccgaatcgccgccttgccctgctggcgggcgccgcaaccaccaccagcagcagcagctggcgccggccgggggccgcgcggggaagaggcggcggtcgcgggcgtccaagcgcacccccaccacgtacatcaccaccgaccccgccaacttccggatcatggtgcagcacatcaccagcgtggaggccgagctgccggccgacatgctgctgcagcggacggcggctgacattgacacgctgctgctgcccgcggacgcccaagccggagtggaggcgtcgtcgtcggcgcttgcgcttcatcagcagccgtgcttcccgacgctggactcgtggaacgtcatgtacgacgacgggatgagaagcgacctgccctgactctgactcagcctcttaattaatttaattatattgctcaatcaaggcattattgcagcactgttgatgattagtgagtactagtagtagtgattaatttaggacgtaagtactactccgcaggagtactctctacttagatggagctgcctgctatctgtctgagtagctgttgcagcagctgcctactagcagtagagtatgcattgcagtgcagactcaaagactgctctgtatgtctgtatggttcccaactctgaatgatttgatttgatcagcattgcctac

SEQ ID NO: 18975 - protein, 176 aa, Panicum virgatum
  misc_feature: Ceres CLONE 1803063
  misc_feature (88)..(118): Pfam Name: VQ Pfam Description: VQ motif
MDAILADAAIARALHLSAMSSHSAASLVSAPAPHHQQSPLLAAAHLPAHLTPESPPCPAGGRRNHHQQQQLAPAGGRAGKRRRSRASKRTPTTYITTDPANFRIMVQHITSVEAELPADMLLQRTAADIDTLLLPADAQAGVEASSSALALHQQPCFPTLDSWNVMYDDGMRSDLP

SEQ ID NO: 18976 - DNA, 595 bp, Panicum virgatum
  misc_feature: Ceres CLONE 1803106
  misc_feature: Encodes the peptide sequence at SEQ ID NO. 18977
atgccagtgtctcgacgcgggattattagggttctgggttctcgacgcggcggcggcggcggctacatatacccctttctttgtctcagcaagcaaggcttagggtttggtggttggacgcagaagcttgtagtagatccttcgttagggagtcgccatgagccggtcggggcaacctccggatctgaagaagtacatggagaagaagctccaaatcaagctgaatgcaaaccgtgtagtcgttggcacgctgcgtggatttgatcagttcatgaatctggtcgtggacaacacagtggaggtcaatggaaacgacaagaatgacatcggaatggtggttatcagggggaacagtgttgtcatgatcgaagccctcgaaccggttgccaaagctcagtgaactgtcagcctgctttggtagttaataagttggtagtgttaatttaaaactgatgtatgccgttgggcaccattgtatcttgagttcctaacccttattcatgtgcaagtgttaagcacttttgtatagttgagcctgtgtttcgactttccagttgcacagcctgctggttgttattctgctgggatttgtgct

SEQ ID NO: 18977 - protein, 80 aa, Panicum virgatum
  misc_feature: Ceres CLONE 1803106
  misc_feature (8)..(72): Pfam Name: LSM Pfam Description: LSM domain
MSRSGQPPDLKKYMEKKLQIKLNANRVVVGTLRGFDQFMNLVVDNTVEVNGNDKNDIGMVVIRGNSVVMIEALEPVAKAQ

SEQ ID NO: 18978 - DNA, 407 bp, Panicum virgatum
  misc_feature: Ceres CLONE 1803128
  misc_feature: Encodes the peptide sequence at SEQ ID NO. 18979
gcaagctaaaacagagctagggttttaggagacagcgagacaggaagagagaggagcgacgacatggacaaccccgagatgcagcgattcctccagcaagagcagcagaaggcgatgatgggtgagatggttggcaagctgacaagcgtgtgctgggacaaatgcatcacgggcaccccaggaagcaagttcagctccggggaatcaacctgcctgaccaactgtgcccagaggtttctcgacatgagcgtcctgatcgccaaacggtttgagatgcagtgaggcgtcggcgcccaataccattgcttagtcaaatgccataagtttcttctgagttttgtacgaaccctttgaatgatgatggatttttttaaattattttaacagagaaagcctgatgtgattcc

SEQ ID NO: 18979 - protein, 72 aa, Panicum virgatum
  misc_feature: Ceres CLONE 1803128
  misc_feature (7)..(72): Pfam Name: zf-Tim10_DDP Pfam Description: Tim10/DDP family zinc finger
MDNPEMQRFLQQEQQKAMMGEMVGKLTSVCWDKCITGTPGSKFSSGESTCLTNCAQRFLDMSVLIAKRFEMQ

SEQ ID NO: 18980 - DNA, 700 bp, Panicum virgatum
  misc_feature: Ceres CLONE 1803140
  misc_feature: Encodes the peptide sequence at SEQ ID NO. 18981
acaaacaagtcctcccaccgcacgcaaccacgacagagagagtccacgggtcgccatggcgagcaagcagagcctcctcgtcctcgccgccgtcgccgcctgcctcctcctcctcccggccgcctcggtcgccaccgacgtcgactactgcagtaggggcaagaagtacccggtgaaggtgagcggggtgcagatcgtgcccgatccggtccagcccggcaagccggccaccttcaagatctccgcttccactgataaaaccatccagaaggggaagctggtaattgatgttaagtatttcttcctctacgtgcactcggaaactcgcgacatctgtggagagactacctgtccagcaactggtgacttcgtgctctctcatcagcagacactaccaggcttcactccaccgggttcctacaccatcaccatgaagattgttggggacgacaatgaggaactgagctgcatctcgtttgggttcagcattggcttcgtcgcctccagctgaatggatgcatcttctatgagcaccagaagtttgccatggatgtaattatgagccacacactgtatcctacgactcccagtagagtggaggtccaggtagggttgggggggtgggcaaagttgctgttcaagtaagacgttttttttccagagttgaacacggcaataaagcaaaagtttggttgtcatg

SEQ ID NO: 18981 - protein, 151 aa, Panicum virgatum
  misc_feature: Ceres CLONE 1803140
  misc_feature (25)..(145): Pfam Name: E1_DerP2_DerF2 Pfam Description: ML domain
MASKQSLLVLAAVAACLLLLPAASVATDVDYCSRGKKYPVKVSGVQIVPDPVQPGKPATFKISASTDKTIQKGKLVIDVKYFFLYVHSETRDICGETTCPATGDFVLSHQQTLPGFTPPGSYTITMKIVGDDNEELSCISFGFSIGFVASS

SEQ ID NO: 18982 - DNA, 379 bp, Panicum virgatum
  misc_feature: Ceres CLONE 1803157
  misc_feature: Encodes the peptide sequence at SEQ ID NO. 18983
tcggcggagctgctggagaaccagaggctggaggagctctccatcgttctcaagccatttgggaagaacaaggtgtctccacgagaaactgctatctggcttgccaggagtttcaaagggatgatgagcgacgatgcaggtcggccgtcgccgtgagctcctttttcttttctttttttcatttcttttttttgctcggttgatttcacttggagccgcttgatttggtaatagcggtgctctgagttactcaaactttacagcttgtggtctctgttgccagttttgccttttctgattgccccattctttctggcgtatgttgtacatagccaagaactgtaaacagcaataaagctttgcctccagtgtgatgcag

SEQ ID NO: 18983 - protein, 51 aa, Panicum virgatum
  misc_feature: Ceres CLONE 1803157
  misc_feature: SWISSPROT Homolog: EC 2.7.11.1 Non-specific serine/threonine protein kinase
SAELLENQRLEELSIVLKPFGKNKVSPRETAIWLARSFKGMMSDDAGRPSP

SEQ ID NO: 18984 - DNA, 1640 bp, Panicum virgatum
  misc_feature: Ceres CLONE 1803168
  misc_feature: Encodes the peptide sequence at SEQ ID NO. 18985
atttttctccacaaaaacccgcacaaaatctcatctgaggaaaaggggaatcggaccatcggaggatcggaagtgagctgaagccatggccgtggatccaagcatcgcggcggaggccgaggccgcagcgcgccggagcgaggaggcggcggaggccttcttccgcgccgcgccgccgctccgcgaccgcgaccgcgtcgccgccagcgtggccgacttcgtcgcccgccactccgcagggagcggcggtgcgggcgggcccgccgaaggcgccagggtgatctgcatcacctccggcggcaccacggtgcccctggagcagcgctgcgtgcgctacatcgacaacttcgcctccggccagcggggggcggccgccaccgagtacacacacacacacacacacaccgcgccatcttcattttgctgtcaccgccctgcttggtgttcagaactgtctgtggtaaaatgcaggtattttctcaaggcgggctatgccgtcatcttcatctatcgccgtgggagcaagcagccttactgtagatttcttccagaggattcgtttctcgatctttttgagcttggtgaagactcagagatccaagttccccaatctcattccactgtggtcaaggcagctattagcaattatcgcaaggcaattggtgaaggcctgcttctgaaacttcccttcactacaattttcgagtaccttcagttactacagatggtagctacttcgatgaattgcttgggacaccatggaatgttctttcttgctgctgcagtttctgacttctatgttccatgggaaagtatggctaaacataaaatcgagtcagcagttggccctttgaacatgcaactcaaccaagtccctaagatgcttttcatcctcagaaaaatttgggccccttcagcattttgtgtatcattcaagctcgagaccgatccaaacattcttctacagaaggcggagatggctttgaagaagtacggtatgaacgtggtggttgcaaacgagcttgctaactacaaagatgtagtggtcatggtcacaagcagcgggaggacgaccgtgagcaggagcagcaaggaggaagacttggaggagcagctaaccgagctcctggtaaagatgcacttggagcacatcagacaacccggttcagaagaccgttaaacacatggtgggggcagagtatcgtctatttgagttacttctaccaagttgctgcagagaccacctggttcatcagatgctcagtgcgttttgcaccagatgaatgccaaagttagtaatggatcccaccaacgcagcaatgcctatagacgtttgaattcgaatgcaaagctagctgtaagckggcgttgtgatgccrctgttctctatgkgggtgyaastggggccctataygatgcmcmcasgakggggggggagggagagggagtggggctgactggagttggccaaaaataacatagggaccgggggcgcggtagtttttttttcatccggaggattcatgatcaggagtcatgagacatcgacgtaaggtccggtacttgtatgaaatatgaacttttacgctcacctggcaccgtcggttggtctcattttcgaaatcgtgtatagtgggcac

SEQ ID NO: 18985 - protein, 364 aa, Panicum virgatum
  misc_feature: Ceres CLONE 1803168
  misc_feature (60)..(337): Pfam Name: DFP Pfam Description: DNA / pantothenate metabolism flavoprotein
  misc_feature: SWISSPROT Homolog: EC 6.3.2.5 Phosphopantothenate--cysteine ligase
MAVDPSIAAEAEAAARRSEEAAEAFFRAAPPLRDRDRVAASVADFVARHSAGSGGAGGPAEGARVICITSGGTTVPLEQRCVRYIDNFASGQRGAAATEYTHTHTHTAPSSFCCHRPAWCSELSVVKCRYFLKAGYAVIFIYRRGSKQPYCRFLPEDSFLDLFELGEDSEIQVPQSHSTVVKAAISNYRKAIGEGLLLKLPFTTIFEYLQLLQMVATSMNCLGHHGMFFLAAAVSDFYVPWESMAKHKIESAVGPLNMQLNQVPKMLFILRKIWAPSAFCVSFKLETDPNILLQKAEMALKKYGMNVVVANELANYKDVVVMVTSSGRTTVSRSSKEEDLEEQLTELLVKMHLEHIRQPGSEDR

SEQ ID NO: 18986 - DNA, 887 bp, Panicum virgatum
  misc_feature: Ceres CLONE 1803173
  misc_feature: Encodes the peptide sequence at SEQ ID NO. 18987
gcagatcgatcgagcaccccaaacttgcacacaatcaccatcagttctagtagacaagacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacgagaagcgccttgggcttcaaccagcatgcactgctgcctgaagggcaaacaatctagttgtacagctaacagttgctaggtttgcgctcacgttttttctctactaaaaaccttataaaagggcccttttggcctttgccggaaataaatactgtatgtttgcgccgaagagtgtacattaatcctgtagctgaagaccccacgcagaatcaagggaggagtgatgcatgcaagtttgatgtgcaagctgctgtaaagaggaggaagatggaggggagtaagaagcacgtttattaatctgctgctgtacaaattaaatttagcactagagtgagagaaagtaagctgttagctgtctaaaagaaaagccgaagccattggccctctggttgtatctgttgatatagtagtggcttcctgttgtttggcctttgttgtaacataagcagaggcgcactagccttcgtttacagttaagctgaattattagtacc

SEQ ID NO: 18987 - protein, 87 aa, Panicum virgatum
  misc_feature: Ceres CLONE 1803173
  misc_feature (12)..(71): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVAQTPTRSALGFNQHALLPEGQTI

SEQ ID NO: 18988 - DNA, 830 bp, Panicum virgatum
  misc_feature: Ceres CLONE 1803196
  misc_feature: Encodes the peptide sequence at SEQ ID NO. 18989
gcaatcgcggaaaagtccaaccccaaaactccccagccggaggcgaggcgatctgagggagaggagaagccgcagcagacatgtcggggggaatcgctcgcggtcgcctcgccgaggagcgcaaggcctggcgcaagaaccacccgcatggtttcgtggcgaagccggagacgctgcccgacgggacggtgaacctgatgacctggcactgcaccatccccggcaagcaagggactgattgggaaggtggatacttccctcttacccttcatttcagtgaggattaccctagcaagcctccaaagtgcaagttcccacagggcttcttccacccaaatgtctatccttcgggaacagtctgcctttctattcttaacgaggatagcggttggagaccagctattactgtcaagcagattcttgttgggattcaggacttgcttgatcagccaaatcctgctgatcctgcacagactgatggttatcatctttttatccaggatccaacagaatataagaggcgcattaagctgcaggctaagcagtatcccgcattggtgtgaggacaattgtccatctagggatccatggtgcacatcagcattgttgtttctagtttattgaatgaaagaccaaatgtaacatggtgctttaagacatgaaactgtggtcattgtgaaccaatgtggtggtgttaacggtactattaactgtttgagtgtgtgttttgtgggataatttctaggcctttgcattgtgtggtttttctcaagaaatgttatgtgtggtttgtcttatctaagtgagaaggtacacttcagtttgcccag

SEQ ID NO: 18989 - protein, 160 aa, Panicum virgatum
  misc_feature: Ceres CLONE 1803196
  misc_feature (9)..(153): Pfam Name: UQ_con Pfam Description: Ubiquitin-conjugating enzyme
  misc_feature: SWISSPROT Homolog: EC 6.3.2.19 Ubiquitin--protein ligase
MSGGIARGRLAEERKAWRKNHPHGFVAKPETLPDGTVNLMTWHCTIPGKQGTDWEGGYFPLTLHFSEDYPSKPPKCKFPQGFFHPNVYPSGTVCLSILNEDSGWRPAITVKQILVGIQDLLDQPNPADPAQTDGYHLFIQDPTEYKRRIKLQAKQYPALV

SEQ ID NO: 18990 - DNA, 342 bp, Panicum virgatum
  misc_feature: Ceres CLONE 1803205
  misc_feature: Encodes the peptide sequence at SEQ ID NO. 18991
tggtggacagtgggcttccttgctttagcaggggagatcctatcaataatcttcgtaagcggtttcatccagagatgaatgagcgggaggctgctaacttcatggcacggacatgtgctgatgcttacaacaagtggactaccgcaggatatgacttaattcagtacttgcagcagggtattgagaaatagtttgtttctcattttgtaaatggtatgttcgtgtacatcaattgtatgtagctgctaattttttcttatgtagaattgatttttttagctgtatcattgtatggtaaggaattcacgtgattaacagaggatgtttgttgcmcagaggcag

SEQ ID NO: 18991 - protein, 62 aa, Panicum virgatum
  misc_feature: Ceres CLONE 1803205
  misc_feature: SWISSPROT Homolog: EC 2.7.1.67 1-phosphatidylinositol 4-kinase
VDSGLPCFSRGDPINNLRKRFHPEMNEREAANFMARTCADAYNKWTTAGYDLIQYLQQGIEK

SEQ ID NO: 18992 - DNA, 720 bp, Panicum virgatum
  misc_feature: Ceres CLONE 1803216
  misc_feature: Encodes the peptide sequence at SEQ ID NO. 18993
gtctgcgtctccgttcgttcgcgccacaggcaagggataggagctcgtgaggaagagcgaggaggaggacgacatggtgcacgggacgctggaggtgctgctcgtcggcgccaagggcctcgagaacaccgattacctctgcaacatggatccgtatgcgattctcaagtgccgatcacaggagcagaggagcagtattgcagctggaaaaggaactaaccctgagtggaatgaaaactttgtcttcactgtgtccgaccgaactacagacttgataatcaagcttatggatagtgatacaggcacagcagatgactttgtaggtgaagcaatgattccgctggaagcagtgtattcggaaaggagcattccaccaacgatctataatgttgtgaaaggtgaaaaatactgtggcggaatcaaagttggtctcacatttactcccgaggatactcgccagaggggtctcccggatgactgcggtggatggaagcaatctcgctaagaagggcagcaagatcttttgatatttcaccagagcaacagtgataatttgtgtgcttgaggcattcagccctcgaacacgttcacgcttgtgcaacatgaaattcagttgatttggcctctttaaatgtttgaaaagatgtgttattagcgagtttaaattaaaagcatcgtcatattgttgcatcaatacagttcgttaagattggaaatttc

SEQ ID NO: 18993 - protein, 143 aa, Panicum virgatum
  misc_feature: Ceres CLONE 1803216
  misc_feature (6)..(87): Pfam Name: C2 Pfam Description: C2 domain
  misc_feature: SWISSPROT Homolog: EC 2.7.11.13 Protein kinase C
  misc_feature: Functional homolog of the protein sequence given in SEQ ID NO 50618
  misc_feature: Useful for making plants with modulated nitrogen use efficiency
MVHGTLEVLLVGAKGLENTDYLCNMDPYAILKCRSQEQRSSIAAGKGTNPEWNENFVFTVSDRTTDLIIKLMDSDTGTADDFVGEAMIPLEAVYSERSIPPTIYNVVKGEKYCGGIKVGLTFTPEDTRQRGLPDDCGGWKQSR

SEQ ID NO: 18994 - DNA, 262 bp, Panicum virgatum
  misc_feature: Ceres CLONE 1803254
  misc_feature: Encodes the peptide sequence at SEQ ID NO. 18995
gccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgtaaaaggtg

SEQ ID NO: 18995 - protein, 46 aa, Panicum virgatum
  misc_feature: Ceres CLONE 1803254
  misc_feature (1)..(46): Pfam Name: potato_inhibit Pfam Description: Potato inhibitor I family
AKKVILKDKPDADIHVLPVGTPVTRDFRPNRVRIFVGTVAQTPHVG

SEQ ID NO: 18996 - DNA, 387 bp, Panicum virgatum
  misc_feature: Ceres CLONE 1803267
  misc_feature: Encodes the peptide sequence at SEQ ID NO. 18997
ccaaggtctgtgttgttccggcaaattcttcctggattagagtctttgctgtcctgtctgagaaggattgcagaaaagaaggggaaaaccatgtctcaggtggccataaactggtgcatctgcaaaggcgcgattcccatcccaggcgtgaaaacggtcaggcacgtcgaggagaatttgggcgcgctcggctggaggctgagccctgctgagatctcagatctcgagtccgcggcgatggcggctccgaagaaaatgatccagaacgtctttcagactgcctgatcatgtacagggatatgaatgaatctcagtaccaaacatcacagaaccatgtacagataaagagctgcatgtatatcttcctgcaagaagttcagattaagc

SEQ ID NO: 18997 - protein, 94 aa, Panicum virgatum
  misc_feature: Ceres CLONE 1803267
  misc_feature: SWISSPROT Homolog: EC 1.1.1.274 2,5-didehydrogluconate reductase
PRSVLFRQILPGLESLLSCLRRIAEKKGKTMSQVAINWCICKGAIPIPGVKTVRHVEENLGALGWRLSPAEISDLESAAMAAPKKMIQNVFQTA

SEQ ID NO: 18998 - DNA, 1129 bp, Panicum virgatum
  misc_feature: Ceres CLONE 1803298
  misc_feature: Encodes the peptide sequence at SEQ ID NO. 18999
gtactgcggcccattcataggcataggctggtgatcatatcacagctccacgtctccagttccagtctactcagccccctgcatagagtgctcctccttaatttgaaggaacaagcaagaaaaggagagaaagatgaccagcgtttggaagaccaaggttctgccccgcctcaacaagatctttgacaaggatggcaagaaggcggcggcggccgagttcctaaagtccttcaacaaggaggagattggcaaggagattgaggacaagaagacagagctggagcccaaggttgtggaggcttatgaagcatctcctcctgaagttaaggctctgttcaaggacaagaaaccagtcaagatcagcaagaagaactcggctgcagctaccaagttgctcgacgagctggctaagattgagttccctggagcaaagctggtgagcgacgcggtggccaagtccggcaccacgcccctctccccggcgatcaccttcgtcttcgacaaggttgcgccattcatccccaaggaggagcccaaggccgagccggaggccacctcccgggaagtcggycktcgaggagaagaaggaggaggccgagcccccggccgctgcggcgacggaggaggctgcgccggcaccggcggaggcgtcggrggsggtagaggagaagaaggctgaggaggagaagcggacggaagcagcagctgagtccgcggcggcgctaccaggtgaggagaagaagtgatctccacgccagtcggcaatgaatgaagaagttaatcaagcaaattaagataggtagctagttccgatcctcatcgttgatggtaaatggaagttacttttccgtgagatttaaattaaattactcctttttcttcttgtcaaccatgtcgtcgtatatatatatatagtagatagctgttgcacaaattaatttgcatatatataagggtggtggatgcatgaacatttgttattgttttgggtcacctgtattgatggatggactttttgtaaatttgtaatgggttttgccttttttgttttttttttgattgattttggggtgatgaaacaggcgacgggtaatgatttgtagtaatatgttagactggtggtcatatt

SEQ ID NO: 18999 - protein, 181 aa, Panicum virgatum
  misc_feature: Ceres CLONE 1803298
  misc_feature (2)..(159): Pfam Name: DREPP Pfam Description: DREPP plasma membrane polypeptide
  misc_feature (147)..(147): Xaa is any aa, unknown, or other
MTSVWKTKVLPRLNKIFDKDGKKAAAAEFLKSFNKEEIGKEIEDKKTELEPKVVEAYEASPPEVKALFKDKKPVKISKKNSAAATKLLDELAKIEFPGAKLVSDAVAKSGTTPLSPAITFVFDKVAPFIPKEEPKAEPEATSREVGXRGEEGGGRAPGRCGDGGGCAGTGGGVGGGRGEEG

SEQ ID NO: 19000 - DNA, 480 bp, Panicum virgatum
  misc_feature: Ceres CLONE 1803377
  misc_feature: Encodes the peptide sequence at SEQ ID NO. 19001
acaagaaagccacttctagccatcaacaacgacttcttcaccatcatcgtcacctaactcagacagtattagcgactgaagaagaagaagaagaagaagatgagctcctccgcggaaccagctatgtgcggcggcggcggcaagacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtatgaataataatggatgtgtgttctttccctataaatcaaataaataagcaagggatgtgcccccggcatgtccctttcctctaaataatgcc

SEQ ID NO: 19001 - protein, 74 aa, Panicum virgatum
  misc_feature: Ceres CLONE 1803377
  misc_feature (15)..(74): Pfam Name: potato_inhibit Pfam Description: Potato inhibitor I family
MSSSAEPAMCGGGGKTSWPEVVGMSIEEAKKVILKDKPDADIQVLPVGTPVTKDFRPNRVRIFVNTVAETPHVG

SEQ ID NO: 19002 - DNA, 333 bp, Panicum virgatum
  misc_feature: Ceres CLONE 1803443
  misc_feature: Encodes the peptide sequence at SEQ ID NO. 19003
aagcatagtagtgtgcaactgcaacaagagctcactcactctcttctgtgtactgaaagtcccgaacgtgacaagctcaaggagaacagcgacccgctggagaactactgcaaggagaaccccgaggccgacgagtgccgcacctacgacaactagagcgcgcatgtatatatgctaaatttgccgtacacgatcgaaggatagcgaagtgaagaagtggctatgtaagctggtgaatttgcacgaagcttcatatttctccgcctgtattatcctgcatattacttgcttgcgtgttgcaaattatatacatataattataattttaagagt

SEQ ID NO: 19003 - protein, 51 aa, Panicum virgatum
  misc_feature: Ceres CLONE 1803443
  misc_feature (7)..(51): Pfam Name: CP12 Pfam Description: CP12 domain
KHSSVQLQQELTHSLLCTESPERDKLKENSDPLENYCKENPEADECRTYDN

SEQ ID NO: 19004 - DNA, 507 bp, Panicum virgatum
  misc_feature: Ceres CLONE 1803457
  misc_feature: Encodes the peptide sequence at SEQ ID NO. 19005
tatatgctgtaccatcacttgcaaatgcggtgctgggggacaaattccagtttgaacgccttggttacttcgctgtggattcagactcgacgcctgagcggctggtgttcaacagaacggttaccttaaaggactcctatggaaaagctgggcccaagtgatctatcgccttctgcggacgaagagatttgctcgctttgcttggcgaaaaaagattttgttgttgtaatgctgttagtggtctataaagagttgtaggacactgccctgcatgagattttgtggggtgccacaattttgcttcgatgacaccagcattcactctgttcgctgcatccaaccaacagtatttttctcgcacactaaatcagcaccagccagcagccacgagtcagccagcagtacttttctttcacaacaaattagcaccagtcatagcacagcgaacagagtgattgaactgaactgttgttttatggtaactcaacatgatagcgagttttattt

SEQ ID NO: 19005 - protein, 52 aa, Panicum virgatum
  misc_feature: Ceres CLONE 1803457
  misc_feature: SWISSPROT Homolog: EC 6.1.1.18 Glutamine--tRNA ligase
YAVPSLANAVLGDKFQFERLGYFAVDSDSTPERLVFNRTVTLKDSYGKAGPK

SEQ ID NO: 19006 - DNA, 526 bp, Panicum virgatum
  misc_feature: Ceres CLONE 1803471
  misc_feature: Encodes the peptide sequence at SEQ ID NO. 19007
agggctgtgtgttactgtcggagttggggctgagccttggacttggagatggcaagcttcaatgaagagaagagagcagctccgcagagggaggaggcaccttcccggagcaagtacggcggcatttcgccraagaagcccctgatcagcaaggaccacgagcgcgcctacttcgactcggcagattgggtcctcggcaagcaaggcgcgaccagcagcaacggcgcgacggtcccggccgccgagcccctcaagcccaagctgcagcggacggcgtaccmccagctccccccgcgaaggccggcgtgcacgtcggagtagctggcgcggctcctgtctcgtcccgtcggcggcgttgcagctagctcgtgatgcctcacacagagtcgcactatagggagccaggatccgtggagttggggcgaattgggttgtaaatacggggacgcatgctgtcactgctcagcagtgtggagctatctgaaatgaagtgatcggtgcactcggcgtctcgtcttcaatcttc

SEQ ID NO: 19007 - protein, 90 aa, Panicum virgatum
  misc_feature: Ceres CLONE 1803471
  misc_feature (20)..(90): Pfam Name: Lg106 Pfam Description: Lg106-like protein
  misc_feature: Functional homolog of the protein sequence given in SEQ ID NO 50181
  misc_feature: Useful for biocontainment applications
  misc_feature (78)..(78): Xaa is any aa, unknown, or other
MASFNEEKRAAPQREEAPSRSKYGGISPKKPLISKDHERAYFDSADWVLGKQGATSSNGATVPAAEPLKPKLQRTAYXQLPPRRPACTSE

SEQ ID NO: 19008 - DNA, 434 bp, Panicum virgatum
  misc_feature: Ceres CLONE 1803487
  misc_feature: Encodes the peptide sequence at SEQ ID NO. 19009
atttattgagagtcaagtaaagaaaattgcagagttgagaagattatgtgcagagaagggagtaaacccctggattgaggttgatggtggtgttggtccacaaaatgcctacaaggtcattgaagctggggcgaatgccattgttgctggttctgcagtttttggggctccagactacgctgaagctatcaaaggaatcaagaccagcgaaagacctgtagcagtaccagcatgaggaactggaactgcactcaattaccgtgtaagtttagcagtgctgcgacttgtgtcttgatgagtcatacgttatattggacattaaagaagactggaggcggtgaagaaatatccctcttctgccctcatttcctcaagggtgcctgccttgtactggttcccagaatgttgtgtgatattaaaacgtatacgggatc

SEQ ID NO: 19009 - protein, 77 aa, Panicum virgatum
  misc_feature: Ceres CLONE 1803487
  misc_feature: SWISSPROT Homolog: EC 5.1.3.1 Ribulose-phosphate 3-epimerase
FIESQVKKIAELRRLCAEKGVNPWIEVDGGVGPQNAYKVIEAGANAIVAGSAVFGAPDYAEAIKGIKTSERPVAVPA

SEQ ID NO: 19010 - DNA, 677 bp, Panicum virgatum
  misc_feature: Ceres CLONE 1803559
  misc_feature: Encodes the peptide sequence at SEQ ID NO. 19011
gcagcaagccacagctcaacttcatcagcgagttgcagcagagatcgagatggagatccgcggcatgggcaccaccgccgtcctcgctctcctcgtcgccggcctcgccgccgccgccgtgggagtgctgcgacttcgtcgtgcgggacccggacttccggccgccgcggtggcagtgcaacgacgtggcggccgagtgccccgccgcctgcagccggtgcgaggaggcgccgggcgacggcggcggctacgtgtgccgcgactgggtcgtgagcctgctcgagccgcccgtgtgcacgccgaggccgtgggactgctgcgacgccgccgtctgcaccagggagtacatccccttctgccgctgcgccgacgaggtggaggcgtgccccagcaactgcagcgtgtgcgagctggcggaggcggacccgccccgctaccgctgcctcgaccagttccacggctaccctgggcccaagtgcacgccgttgccgtggatgggcaactagcccagcacgtacacgcccgatcagctatatctacggacacgtacgtacgcccacaaataaataaaattagctactgtagcaagtgattgttcatccgacgtggacaattagctaccctgctcgctagctgctactgtatttcgtgcaactcaataagagacgtggccaagc

SEQ ID NO: 19011 - protein, 167 aa, Panicum virgatum
  misc_feature: Ceres CLONE 1803559
  misc_feature (131)..(155): Pfam Name: Bowman-Birk_leg Pfam Description: Bowman-Birk serine protease inhibitor family
  misc_feature (105)..(129): Pfam Name: Bowman-Birk_leg Pfam Description: Bowman-Birk serine protease inhibitor family
SKPQLNFISELQQRSRWRSAAWAPPPSSLSSSPASPPPPWECCDFVVRDPDFRPPRWQCNDVAAECPAACSRCEEAPGDGGGYVCRDWVVSLLEPPVCTPRPWDCCDAAVCTREYIPFCRCADEVEACPSNCSVCELAEADPPRYRCLDQFHGYPGPKCTPLPWMGN

SEQ ID NO: 19012 - DNA, 186 bp, Panicum virgatum
  misc_feature: Ceres CLONE 1803559-R
cccatatccacggctgtcgtggggccaattgcagcccgttccgcaggagggggaacaatcccagcacgtacaggcccgatcacatatatgtggggacaagtacgtatgcccccaaataaagaaaattaactaccgtagcaagggatggttcatcggaggtgaacaattagatgccgtgctcggtag

SEQ ID NO: 19013 - DNA, 681 bp, Panicum virgatum
  misc_feature: Ceres CLONE 1803570
  misc_feature: Encodes the peptide sequence at SEQ ID NO. 19014
atgtcgaaggcgagctgcccgccggctcggctcccccccgcttcgcgcgcgcgcgcacgcaagagctccgtgggctcgcggtgagcagagcacgccggcgccgcgccacgcatggcgaagcacctcctctcgacggcggcgcaccgcaccatgccggggaactacgtccggccggaggcgcagcgcccgcgcctcgccgaggtcgtctccggcgcgcccatccccgtcgtcgacctggcgtgccccgaccgcgccgccgccgtcggcgacgcctgccgctcgcacggcttcttccaggtcctgaaccacgggatagacggcgggctgatcgcggaggtgatggccgtcgcgcgcgagttcttccggctgccggcggaggagaaggccaagctctactccgacgatccggccaagaagatccggctgtccaccagcttcaacgtgcgaaaggagacggtgcacaactggcgcgactacctgcggctgcactgccaccccctcgaccagttcgtgcccgattggccctccaacccgcccgacttcaagtaagttaataactgttttgcctcattgattaatacaataatcacactcctattcaatcacttcctagtccttgtttttttttataaaaggtctttgtagtccttgttgaaacaagcagaggtaaattgctaacgc

SEQ ID NO: 19014 - protein, 145 aa, Panicum virgatum
  misc_feature: Ceres CLONE 1803570
  misc_feature: SWISSPROT Homolog: EC 1.14.11.9 Flavanone 3-dioxygenase
MAKHLLSTAAHRTMPGNYVRPEAQRPRLAEVVSGAPIPVVDLACPDRAAAVGDACRSHGFFQVLNHGIDGGLIAEVMAVAREFFRLPAEEKAKLYSDDPAKKIRLSTSFNVRKETVHNWRDYLRLHCHPLDQFVPDWPSNPPDFK

SEQ ID NO: 19015 - DNA, 985 bp, Panicum virgatum
  misc_feature: Ceres CLONE 1803606
  misc_feature: Encodes the peptide sequence at SEQ ID NO. 19016
cggagtgtcggagtggtagacacagatctcgcgtgtggtgccgccgccccgcgcgtgctccgccactgaccggagcgccaccaaattcctccccatttcgaatcagccaaaccgtcgccgaaccctagccccggcgatctcgcatggccacccacccgcgatctctccacacccggctcggcggcggcgcagtcgccgacgtgctgctgtggcggcggaggaacgcctcggcggcggccgtggtgggcgccacggcggtctggttcgtcttcgagcgcgcgggctacagcctcccctcggtcctggccaacgccctgctcctcctcgtcgccatcctcttcttctgggccaagtccgcgtcgctgctcaacaggcctcttccacctcttcctaatctagaggtttcagatgtggttgttgagaaagctgcagatcgtgctcttgtatggatcaatagagtgcttgctgttggccatgatattgccatcaagagagataggaaaacttttataagggtgatattaatactctgggtggtttcgtatgttggaatgctcttcaacttccttacgctcatttacattggggtaatgctttctctgttggttccaccactgtatgagaagtaccaggatcatgttgatgaaaagctcggtgtagcacacagtgtactatcaaggcacatagataccatcattaccagggcggggcaagccaagcagaagaaaactgagtaaaagaaatgttttggctgtattctggaacatctccggttctctagtggagttgacgtgagcctttcatctttgactatccatatctatgatctccactaaaattaattttcgatatgctgatctgaggttttgatgcgcattgttttcaagctgagaaatgaggtggcttgtgtatttttctttctgaacatgaggtttactatgggcgcatatcgtactcgcaatgatattggatattgcaaactcgc

SEQ ID NO: 19016 - protein, 197 aa, Panicum virgatum
  misc_feature: Ceres CLONE 1803606
  misc_feature (17)..(194): Pfam Name: Reticulon Pfam Description: Reticulon
MATHPRSLHTRLGGGAVADVLLWRRRNASAAAVVGATAVWFVFERAGYSLPSVLANALLLLVAILFFWAKSASLLNRPLPPLPNLEVSDVVVEKAADRALVWINRVLAVGHDIAIKRDRKTFIRVILILWVVSYVGMLFNFLTLIYIGVMLSLLVPPLYEKYQDHVDEKLGVAHSVLSRHIDTIITRAGQAKQKKTE

SEQ ID NO: 19017 - DNA, 429 bp, Panicum virgatum
  misc_feature: Ceres CLONE 1803680
  misc_feature: Encodes the peptide sequence at SEQ ID NO. 19018
atctcctcacgccgcaacctcactcgagcacgagtcaagagaaaagaagcgcggcgccggcacccgcaaggacgaggtggtgacccgcgagtacaccattaacctccacaagcgcctccatggatgcaccttcaagaagaaagcaccaaatgccatcaaggagatcaggaagtttgcacagaaggccatgggaactactgatgtccggattgatgtgaagctcaacaagcacatctggagcagtggtatccggagcgttctaaggcgagtccgtgtcagaatcgcccgcaacaggaacgacgaggaagatgccaaggaggaactctactctctggtcacagttgctgtaacatcactggtgttaatcacctataattaaacctagtcacagacattagttaaacttacgcgaccaaaaccattagctag

SEQ ID NO: 19018 - protein, 125 aa, Panicum virgatum
  misc_feature: Ceres CLONE 1803680
  misc_feature (22)..(116): Pfam Name: Ribosomal_L31e Pfam Description: Ribosomal protein L31e
SPHAATSLEHESREKKRGAGTRKDEVVTREYTINLHKRLHGCTFKKKAPNAIKEIRKFAQKAMGTTDVRIDVKLNKHIWSSGIRSVLRRVRVRIARNRNDEEDAKEELYSLVTVAVTSLVLITYN

SEQ ID NO: 19019 - DNA, 828 bp, Panicum virgatum
  misc_feature: Ceres CLONE 1803690
  misc_feature: Encodes the peptide sequence at SEQ ID NO. 19020
gaaacgagctttcccctttctccggccaaggcaatccaacaaacccccaaacccaaccccatctgctcctgctcctcacggccccgtcgatccatcggcgatgacgccaggaagctccgccgccggatcgggcgtcgtcgttcctcggaacttcagactgctagaagagcttgagtgtggggagaagggcattggagatggtacagtgagctatggcatggatgatgcagatgacatctacatgagatcgtggactggcactatcattggcccacataataccgtccatgagggtcgcatctaccagctgaagttgttctgtgacaaggactaccctgagaagccaccatctgttagatttcattcaagaataaacatgacatgtgttaatcatgagactggagtggttgacccaaagaagttcagtgtactggctaactggcagcgggagtacacaatggagtacattctgacccagctcaagaaagagatggcctccccacataaccgcaaactagtgcagcctccagaaggaacattcttctgaaatagctatttgttgccccatttgcggattcaacagcagaatctcatggccatccatggtgactccaaaaacatcttcacttggtagctatgattgatttctagtatgtgtgcctactatctsttgaccgctgcgatagcgtcacgwgtgaactttcctgaaaatctttctggtggtcggtaaagaaagggaatgaaagggttgccagttggatgggtggtacgaaggggtaatcggggcaaacgggggtggcttggggcatatatgatagttctttgccg

SEQ ID NO: 19020 - protein, 148 aa, Panicum virgatum
  misc_feature: Ceres CLONE 1803690
  misc_feature (19)..(140): Pfam Name: UQ_con Pfam Description: Ubiquitin-conjugating enzyme
  misc_feature: SWISSPROT Homolog: EC 6.3.2.19 Ubiquitin--protein ligase
MTPGSSAAGSGVVVPRNFRLLEELECGEKGIGDGTVSYGMDDADDIYMRSWTGTIIGPHNTVHEGRIYQLKLFCDKDYPEKPPSVRFHSRINMTCVNHETGVVDPKKFSVLANWQREYTMEYILTQLKKEMASPHNRKLVQPPEGTFF

SEQ ID NO: 19021 - DNA, 460 bp, Panicum virgatum
  misc_feature: Ceres CLONE 1803768
  misc_feature: Encodes the peptide sequence at SEQ ID NO. 19022
gaaccagcagtacaagaagcacaagaaaaaacacttgtagccatcaacttcttcttcttcttcttcaccgtcatcaactcatcatcagctcagaccctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgt

SEQ ID NO: 19022 - protein, 74 aa, Panicum virgatum; identical to SEQ ID NO: 18697
  misc_feature: Ceres CLONE 1803768
  misc_feature (15)..(74): Pfam Name: potato_inhibit Pfam Description: Potato inhibitor I family

SEQ ID NO: 19023 - DNA, 657 bp, Panicum virgatum
  misc_feature: Ceres CLONE 1803788
  misc_feature: Encodes the peptide sequence at SEQ ID NO. 19024
acagcaaatcgaattccagtttccaatccccaaatcctccagcccgctcgccgccgctccgtcacctcccgtccaatggcccgcacgaagcagacggcgcgcaagtccaccggcggcaaggcgccgcggaagcagctggcgaccaaggcggcgcgcaagtcggcgccggcgacgggcggcgtgaagaagccgcaccgcttccgcccgggcacggtggcgctgcgcgagatccgcaagtaccagaagagcacggagctgctgatccggaagctgcccttccagcggctggtgcgggagatcgcgcaggacttcaagacggacctgcggttccagtcctcggcggtggcggcgctgcaggaggccgcggaggcctacctggtggggctcttcgaggacaccaacctctgcgccatccacgccaagcgcgtcaccatcatgcccaaggacatccagctcgcgcgccgcatcaggggcgagagggcctagagccgcctctgctgctcgtccgtcgtcgtggtgctcgtttacctgcccgcggtgggaggactagatctagatgcacgggccgttcgttccttgctgtgctttcttgtagtaatggtctgaatgcattgtcctcactgcaatggaatatgattgatgggtgggtttcactgc

SEQ ID NO: 19024 - protein, 136 aa, Panicum virgatum; identical to SEQ ID NO: 10238
  misc_feature: Ceres CLONE 1803788
  misc_feature (58)..(132): Pfam Name: Histone Pfam Description: Core histone H2A/H2B/H3/H4

SEQ ID NO: 19025 - DNA, 357 bp, Panicum virgatum
  misc_feature: Ceres CLONE 1803811
  misc_feature: Encodes the peptide sequence at SEQ ID NO. 19026
ggcgaggagccgtgggacgaggccgagagcttcgtgctccgcaagtacccgtcctacgagatcgactgggacgccctgctcgccaactagctagcagcttccgtgattgttcatccagtgattgtaatttagtagcttggtcatccgccatggccgcggccggtgcagatgaggttttaagcaatctgcacggcgcggcccgcccctgtgtagcagcaagtacaagtaggcttctgttgttcttgttctgttggtccccggacctcgccgccggcgtttttgtgaccggcgtcctgctccggatgtttgctgtaaaatgttagtgggtgcacagcattggtgtactggtctgtctgc

SEQ ID NO: 19026 - protein, 29 aa, Panicum virgatum
  misc_feature: Ceres CLONE 1803811
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 116 in the 11/479,226 US patent application
  misc_feature: The sequence is a functional homolog of SEQ ID NO 1712 in the 10/412,699 US patent application
  misc_feature: The sequence is a functional homolog of SEQ ID NO 1948 in the 10/374,780 US patent application
  misc_feature: The sequence is a functional homolog of SEQ ID NO 256 in the 11/375,241 US patent application
  misc_feature: The sequence is a functional homolog of SEQ ID NO 6 in the 10/412,699 US patent application
  misc_feature: The sequence is a functional homolog of SEQ ID NO 722 in the 10/225,066 US patent application
  misc_feature: The sequence is a functional homolog of SEQ ID NO 906 in the 11/435,388 US patent application
  misc_feature: The sequence is a functional homolog of SEQ ID NO 198 in the 10/374,780 US patent application
  misc_feature: The sequence is a functional homolog of SEQ ID NO 52 in the 11/375,241 US patent application
  misc_feature: The sequence is a functional homolog of SEQ ID NO 642 in the 10/412,699 US patent application
  misc_feature: The sequence is a functional homolog of SEQ ID NO 860 in the 11/435,388 US patent application
  misc_feature: The sequence is a functional homolog of SEQ ID NO 996 in the 10/225,066 US patent application
  misc_feature: The sequence is a functional homolog of SEQ ID NO 212 in the 10/666,642 US patent application
  misc_feature: The sequence is a functional homolog of SEQ ID NO 2600 in the 10/374,780 US patent application
  misc_feature: The sequence is a functional homolog of SEQ ID NO 2706 in the 10/374,780 US patent application
  misc_feature: The sequence is a functional homolog of SEQ ID NO 294 in the 10/225,066 US patent application
  misc_feature: The sequence is a functional homolog of SEQ ID NO 352 in the 10/225,066 US patent application
  misc_feature: The sequence is a functional homolog of SEQ ID NO 179 in the 11/479,226 US patent application
  misc_feature: The sequence is a functional homolog of SEQ ID NO 1291 in the 10/374,780 US patent application
GEEPWDEAESFVLRKYPSYEIDWDALLAN

SEQ ID NO: 19027 - DNA, 464 bp, Panicum virgatum
  misc_feature: Ceres CLONE 1803848
  misc_feature: Encodes the peptide sequence at SEQ ID NO. 19028
atccagtccccaatccgtcgagaaattcctcccgagccatcgaaatcgaagcgaagcgaagcggcctcccccgatcctctcaagatgcagatctttgttaagaccctcaccggcaagaccatcactttggaggttgagtcgtctgacaccattgacaatgtgaaggccaagatccaggacaaggagggcatccctccggaccagcagcgtctgatcttcgctggcaagcagcttgaggatggccgcaccctagcagactacaacatccagaaggagtccaccctccacctggtgctccgcctgcgtggtggtatgcagatctttgtgaagaccctcactggcaagaccatcaccttggaggtggagtcttccgacaccatcgacgatgtgaaggggaagatacatcacggagaaggagggcctccccccggagcagcaacgtttgatatcttccccggaaccga

SEQ ID NO: 19028 - protein, 126 aa, Panicum virgatum
  misc_feature: Ceres CLONE 1803848
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDDVKGKIHHGEGGPPPGAATFDIFPGT

SEQ ID NO: 19029 - DNA, 682 bp, Panicum virgatum
  misc_feature: Ceres CLONE 1803854
  misc_feature: Encodes the peptide sequence at SEQ ID NO. 19030
gcgctcagcgtcacaagcgaagtcagagaaggttagggtttcccagtcgcgacctctgccgccgccgccgccgccaccgccaccatgggacactccaacgtgtggaactcgcacccgaagaactacggccccggatcccgggtttgccgtgtgtgcgccaacccccacggcttgatccgaaagtacgggctcatgtgctgcaggcagtgcttccgcagcaacgccaaggacatcggcttcatcaagtaccgctaaaaacttgagaggtctgaagcatcacgaaaatgggagcatggatgaggagcatctttgatccgtcttttgtttagtactgtgataatcataccatgtaatgaattatttgggtttgaaatggaccaagtcgtattctggctggcactctagtgcaccctagttgagcatgttgaaccgctatgatcagactaatacaatattgttactattgtggctctattggagtaaaaaaaaaaggctaagtgtccatccacaacatacatcttgcacacaacatactagcaatctcgtctctgtagcatttgaagaactccaacgaaaatgaactcggtggtgaagatcggcccctttggcagcacctccgaggctgagggcaatcgcgacatcaccgtagcgccgctgcgcctggagagcatcaccatccgcc

SEQ ID NO: 19030 - protein, 56 aa, Panicum virgatum; identical to SEQ ID NO: 9888
  misc_feature: Ceres CLONE 1803854
  misc_feature (3)..(56): Pfam Name: Ribosomal_S14 Pfam Description: Ribosomal protein S14p/S29e

SEQ ID NO: 19031 - DNA, 525 bp, Panicum virgatum
  misc_feature: Ceres CLONE 1803854-R
ggcagccggatcaacccgctggtccgcctcaaggcccagcacatcgagccggatttcgggcttgtacggcgtgaagacgatcaagaatgtgttcaaggcgggcatcaacgcggtgccggtggtccagtgcagcaagggccccttcggcaagttccagatgttccagctctaattctgcgcgtgggcgaacggcaagttcatcgactgcccggcgccggagcagtatacttgctccaaggagatcctcttccaccccttccagaagtggatgctcaagcagcagctcaatgagtccaccgccgccaaccccttcgtgctccccggggtagccggggaaatgtaactgatagatgtgcggcggcggcgctgcgcgcttaccgtttggttcgtgattacgagtttgcgagtttcggtgacgcgcgcatggaaattaaataatgttcccctgttgtgtgtgaggcttgccagctcctcgcggagcaacattgtccttgtgtagtcaagctagaggaataaactagtgcg

SEQ ID NO: 19032 - DNA, 381 bp, Panicum virgatum
  misc_feature: Ceres CLONE 1803861
  misc_feature: Encodes the peptide sequence at SEQ ID NO. 19033
ccccaagaagcgaaatccggaaagccaatctagaagctccccccttccctctcgcagcctcctcccacccgatcccaatctaagctcgccgagatgggccgcaagttcttcgtcggtggcaactggaaatgcaacggaaccactgatcaggttgagaagattgtcaaaactctgaatgaaggacaggttccctctccagatgttgttgaggtcgttgtcagccctccttatgtgttccttcctgtggtcaagagccagctgcgcccagagttccaagttgctgctcagaactgctgggtgaaaaagggaggtgctttcactggtgaagtcagtgctgagatgctcgtcaaccttggcgctccctctggcattctcggggac

SEQ ID NO: 19033 - protein, 95 aa, Panicum virgatum
  misc_feature: Ceres CLONE 1803861
  misc_feature (5)..(94): Pfam Name: TIM Pfam Description: Triosephosphate isomerase
  misc_feature: SWISSPROT Homolog: EC 5.3.1.1 Triose-phosphate isomerase
  misc_feature: Functional homolog of the protein sequence given in SEQ ID NO 50215
  misc_feature: Useful for making plants with modulated biomass
MGRKFFVGGNWKCNGTTDQVEKIVKTLNEGQVPSPDVVEVVVSPPYVFLPVVKSQLRPEFQVAAQNCWVKKGGAFTGEVSAEMLVNLGAPSGILG

SEQ ID NO: 19034 - DNA, 565 bp, Panicum virgatum
  misc_feature: Ceres CLONE 1803868
  misc_feature: Encodes the peptide sequence at SEQ ID NO. 19035
atcgcttctcgtctcgtgtgttgttccgagaacacaaccaaaatccaaatcatcatcctcgcgactctcgtcgatccctcgccccgcttcaagatgcagatcttcgttaagacccttactggcaagaccatcaccctcgaggtggagtcctccgacactatcgacaatgtcaaggccaagatccaggacaaggagggcattcccccagaccagcagaggctcatcttcgctggcaagcagctcgaggatgggcgtacccttgccgactacaacatccagaaggagagcaccctccacctggtgctccgcctgaggggaggcatgcagatctttgtgaagaccttgactggcaagactatcacccttgaggtcgaatcttccgacaccatcgacaacgtcaaggccaagatccaggacaaggagggcatccccccagaccagcagcgtctgatcttcgctggcaagcagcttgaggatggccgcacccttgccgactattacatccagaaagagaacactctccacctggtggttcgcccggaggggggggaggcgaatcttcttg

SEQ ID NO: 19035 - protein, 157 aa, Panicum virgatum
  misc_feature: Ceres CLONE 1803868
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYYIQKENTLHLVVRPEGGEANLL

SEQ ID NO: 19036 - DNA, 515 bp, Panicum virgatum
  misc_feature: Ceres CLONE 1803869
  misc_feature: Encodes the peptide sequence at SEQ ID NO. 19037
cgtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggccctcgagtccaagatcatcctcaatcgtgagacccagaggtcccgcggcttcggcttcgtcaccttctcgagcgagcaggcgatgcgcgatgccatcgaggggatgaacggcaaggagctggacggccgcatcatcaccgtcaacgaggcccattcccgcggcggcccgcgctccggcggcggcggcggctggtacgggcgccgcgagggcggcggcggctacagcggcggtggctacggcggcggcggtggtggctacgggcgccgcgagggcggcggcggctaccgcatctgcggcggctaccgcagcggcggcgg

SEQ ID NO: 19037 - protein, 139 aa, Panicum virgatum
  misc_feature: Ceres CLONE 1803869
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDNSLHNAFSPFGEALESKIILNRETQRSRGFGFVTFSSEQAMRDAIEGMNGKELDGRIITVNEAHSRGGPRSGGGGGWYGRREGGGGYSGGGYGGGGGGYGRREGGGGYRICGGYRSGG

SEQ ID NO: 19038 - DNA, 676 bp, Panicum virgatum
  misc_feature: Ceres CLONE 1803878
  misc_feature: Encodes the peptide sequence at SEQ ID NO. 19039
atccaatccatcctcgtccccgtttccatccctgcgaagcatcaggctttaatttttccgtctccgagaatccatccctagctagctcgacccggccggccatggcggcgcggctgcccctggcgatcctgatgctggccctggccgtcgccgggcgcgcggcggcgcaggactacgacttcttctacctcgtgctgcagtggcccgggtcctactgcgacaccaagcagagctgctgctacccctcgtccggcaagccggcggccgacttcggcatccacggcctctggcccaaccgcgacgacggctcctacccgcagaactgcaaccccgacgccgccttcaacccctccaaggtgagcgacctgctgagcagcctgcgcgccaagtggccgacgctggcgtgcccgaccaacgacgggctccgcttctggggccacgagtgggagaagcacggcacctgcgccgccgacgtcttcgacgagcacggctacttccaggcggcgctccgcctccgcgaccagctcggcgttctcggcgcgctcaccgccggcggcgttaaccccgacggcggctactacacgctggcccagatcaagggcgccatccgcgagggcaccggcttcgagccctacgtcgagtgcaaccgcgacgaggccggcaacagccagctcta

SEQ ID NO: 19039 - protein, 191 aa, Panicum virgatum
  misc_feature: Ceres CLONE 1803878
  misc_feature (25)..(189): Pfam Name: Ribonuclease_T2 Pfam Description: Ribonuclease T2 family
  misc_feature: SWISSPROT Homolog: EC 3.1.27.1 Ribonuclease T(2)
MAARLPLAILMLALAVAGRAAAQDYDFFYLVLQWPGSYCDTKQSCCYPSSGKPAADFGIHGLWPNRDDGSYPQNCNPDAAFNPSKVSDLLSSLRAKWPTLACPTNDGLRFWGHEWEKHGTCAADVFDEHGYFQAALRLRDQLGVLGALTAGGVNPDGGYYTLAQIKGAIREGTGFEPYVECNRDEAGNSQL

SEQ ID NO: 19040 - DNA, 108 bp, Panicum virgatum
  misc_feature: Ceres CLONE 1803878-R
tagttttgattgaataaaagaagtgttcatgtgccaattcatgtatttgatttgagctgatgctagagatcaattgataagttcaggaaaagcatttttttttttggt

SEQ ID NO: 19041 - DNA, 1312 bp, Panicum virgatum
  misc_feature: Ceres CLONE 1803887
  misc_feature: Encodes the peptide sequence at SEQ ID NO. 19042
aaattaaacaaggagcagggcacgcttgctatgctgcctcatatacatacttactactagcttatctatctacctgtctcccacctatctatctggctatatatcggcgtcagccgtgagctcctcccacacacgacacgctcacgcacatcaccgtaccagccatggcaaagcttgctctcggccaccaccgcgaggccgctgatgccggctgcgtccgtgcggtgctcgccgagctcatcctcaccttcctcttcgtcttcgccggcgtaggatcagccatggcgaccgggaagctggccggcggcgctgactccgtcgtgggcctgacggcggtggcgcttgcccacacgctggtcgtggccgtcatggtgtccgcggggctccacgtctccggcggccacatcaacccggccgtcacgctgggcctcgccgtcacgggccgcgtcacgctcttccgctccgcgctctacatcgccgcccagctcatgggctccgccctcgcctgcctcctcctcgccttcctcaccggcggcgcgcccacgcccgtgcacgcgctggcggcgggcgtcggcgcgctccagggcgtgctcatggaggtggtgctcaccttctccctgctcttcgccgtgtacgccaccgtcgtcgacccgcgccgcgccgtcggaggcatgggcccgctgctggtgggactggtcgtcggcgccaacgtgctcgccggcgggcccttctccggcgcctccatgaaccccgcgcgctccttcgggccggcgctcgcggccggggtctgggccgaccactgggtctactgggtcgggccgctgattggcgggccgctcgccgggctagtctatgacggcctgttcatggtccagggaggccacgagccgcttccaagggacgacaacgacttctagctagcatcacatcagccagcgaaagggcacgaactctccggtagcatcttgatcctcgattcgattctgttgtggaagtgacttttttagaatttaataatattgtgctttcaggcagcgtttttgccgacagtgaaacatttacgatgactttgccaaattcgagtatttgttggcccggtcttcaaaaatgctcttaggggtatgtctgcctttgtagggatgaatgtgcgtgtgttgttagtatctgagttgtatcgtgaaatctaaagaaaatactagcatcaaatcaggattcaggcatcatgtaattctgtctgtgttgggtgggtgcccccccccaataaaaataaaatggagtccagtttcaagctggatatgtaacttttttcctc

SEQ ID NO: 19042 - protein, 250 aa, Panicum virgatum
  misc_feature: Ceres CLONE 1803887
  misc_feature (11)..(230): Pfam Name: MIP Pfam Description: Major intrinsic protein
MAKLALGHHREAADAGCVRAVLAELILTFLFVFAGVGSAMATGKLAGGADSVVGLTAVALAHTLVVAVMVSAGLHVSGGHINPAVTLGLAVTGRVTLFRSALYIAAQLMGSALACLLLAFLTGGAPTPVHALAAGVGALQGVLMEVVLTFSLLFAVYATVVDPRRAVGGMGPLLVGLVVGANVLAGGPFSGASMNPARSFGPALAAGVWADHWVYWVGPLIGGPLAGLVYDGLFMVQGGHEPLPRDDNDF

SEQ ID NO: 19043 - DNA, 1011 bp, Panicum virgatum
  misc_feature: Ceres CLONE 1803898
  misc_feature: Encodes the peptide sequence at SEQ ID NO. 19044
gtttgtcacaagggtcatgcaagaaagggaatctcaatctggaataaaacctctcagactgatggaaagaagtgtattcagtgatcggatggtatttgtccgtgctgttcacgaagctaattggatgaatgagatggagatcagcatctatgattcctggtttgatcctgttgtgtcatcgctcccaggtctcattccagacggatttatctatctaagagctagtccagatacttgccacaaaagaatgatgcatcggagaagatcagaggaaggtggtgttacacttgactacttgcaaggtttgcatgagaagcatgagagctggttgcttccttcaaaaggttcaggttcaggtatattatcagtcagtcaactgcccatgcatatggaaggctccttgcctccagaaatacaggatcgagtattttacttggaaggaaatcacatgcactctagtatccaaaaggtccctgcccttgtcttggactgtgaacctgacattgatttcaacaaagacatagaagctaaacgacaatatgcgcggcaagttgcagagttctttgaattcgtaaagaaaaagaaggaagaagctccatctgagcaattgagtgccgacaagggtcgcatgaacccgcaggtcatgcttcctaacagaggccgcctgtgggtccctgaaggcaaccctttcgcgggctcccctatgaacatggatttcagaagagccatgtcttcatacatctccacctaggactccgatgcagagacaaacttgccgtcctcactcattgacctcgcaacgcaaaccacctatgcctttaagtaccttaggctgctcgatgctagccattgatgtatgatagcctggcggcggctcccgtcctgtaaattatgatcttagcgcaagttccacgttttgcagcactagcatcagcgtcagtcttaccttacgtttggttgcttgaagcattctgctgaacagaactgcaacgagattaccagaacatgtgc

SEQ ID NO: 19044 - protein, 249 aa, Panicum virgatum
  misc_feature: Ceres CLONE 1803898
  misc_feature (1)..(142): Pfam Name: dNK Pfam Description: Deoxynucleoside kinase
  misc_feature: SWISSPROT Homolog: EC 2.7.1.74 Deoxycytidine kinase
FVTRVMQERESQSGIKPLRLMERSVFSDRMVFVRAVHEANWMNEMEISIYDSWFDPVVSSLPGLIPDGFIYLRASPDTCHKRMMHRRRSEEGGVTLDYLQGLHEKHESWLLPSKGSGSGILSVSQLPMHMEGSLPPEIQDRVFYLEGNHMHSSIQKVPALVLDCEPDIDFNKDIEAKRQYARQVAEFFEFVKKKKEEAPSEQLSADKGRMNPQVMLPNRGRLWVPEGNPFAGSPMNMDFRRAMSSYIST

SEQ ID NO: 19045 - DNA, 1590 bp, Panicum virgatum
  misc_feature: Ceres CLONE 1803901
  misc_feature: Encodes the peptide sequence at SEQ ID NO. 19046
accttgcacccgtcgacagagttcaacttcatctcctctcctgcttaattttcaaaaaaaaaaaagctcctctcctgctccgatcgatcgagaatgtcgagcctcgaggagccgcttggtcttggagacctgccgaagttgagtattaacagacttggaagcttctcccagccaagtgcttatcgcagggcagcggctgatgaccgcaacactcgcaagtacaacaactcctgcaatggtggcgcgccgatggttttccatgccaattctcatgcgtggcatcagcaatgccgtcaggccgattcgtcatgtcatgtggtggagcttagagatctccctcggaaggttatgtgggatctaccaagctttgtgaagattgttgaagttggaccccgagacggcctgcaaaacgaaaagggcaatgtaccgacatctgtaaagatacaactgatacacaaattagtggctgcaggtttatcagtagttgaagccacaaattttgtatccccaaaatgggtgccgcagctagctgatgcaaaggaagtcctcaaaggaatccagcagatgccaaatgtgcggtatcctgtgttaactcctaacctaagaggatttgaggctgctgttgcagctggtgcaaaggaaattgcggtttttgcatctgcctctgaatccttctctaagtcgaacatcaactgtaccatagaggaaagccttgttcggtaccgtgatgttactgctgctgccaagaaacatggactccttatccgtgggtatgtttcgtgtgtgattggttgccctgttgaaggtgcaatcgatccatcaaaggtggcatatgtagctaaggagctttataacatgggctgctcagagatttcacttggcgatactattggtgttggtacaccagtggacaagattgccgttcatttccatgatacatacggccaggcccttgccaatatcctagtatcccttcaaatggggatcagcatagtagactcctcagtttcaggccttggaggctgcccatatgcaaagggcgccactggcaatgtcgccactgaggatgtcgtgtacatgctccatggcctaggcatagagaccaacgtggacctcaacaagctcatggaggctggcaattacatctccaagcatctaggaaggccactgggctccaagactgctgccgctctgcgcaagctaaccacctgagttcgtgaagatcatttcaggccaaaagcatatatatcagctggtgtcatcacacatattttatacaggttgtatgaatgtccgaaagtcttgctttattttgtatatttgggtaaaagtcgcagaaaacatggatctacataaagttgtattctatccttaggtgatcctgcatagtcaggacatcatggaggaaactgtgctcgcagatacgagtatatgtaacggcaaatccctaacaaatttggggccctctgcacagttctccaaatgtaatttggagctcattgtgtacccatggaaaatgtacgagaatctggtctttggtagcttaccgttcttccatatctgctgaacacaaatgaagaatgtgccagc

SEQ ID NO: 19046 - protein, 372 aa, Panicum virgatum
  misc_feature: Ceres CLONE 1803901
  misc_feature (101)..(357): Pfam Name: HMGL-like Pfam Description: HMGL-like
  misc_feature: SWISSPROT Homolog: EC 4.1.3.4 Hydroxymethylglutaryl-CoA lyase
MSSLEEPLGLGDLPKLSINRLGSFSQPSAYRRAAADDRNTRKYNNSCNGGAPMVFHANSHAWHQQCRQADSSCHVVELRDLPRKVMWDLPSFVKIVEVGPRDGLQNEKGNVPTSVKIQLIHKLVAAGLSVVEATNFVSPKWVPQLADAKEVLKGIQQMPNVRYPVLTPNLRGFEAAVAAGAKEIAVFASASESFSKSNINCTIEESLVRYRDVTAAAKKHGLLIRGYVSCVIGCPVEGAIDPSKVAYVAKELYNMGCSEISLGDTIGVGTPVDKIAVHFHDTYGQALANILVSLQMGISIVDSSVSGLGGCPYAKGATGNVATEDVVYMLHGLGIETNVDLNKLMEAGNYISKHLGRPLGSKTAAALRKLTT

SEQ ID NO: 19047 - DNA, 1596 bp, Panicum virgatum
  misc_feature: Ceres CLONE 1803915
  misc_feature: Encodes the peptide sequence at SEQ ID NO. 19048
agcgagcccccagaagaaaaaaaacgcattccgcttccacacaatcggctgcgggcgcggggaggcggaggcgccgccagccgccgtgactggagggaggcggcggctacggagggtctcgaggtccggaggggggagctagagctacggtgctaaaacaggagcggcgggctcgcgctgttctgtccctcgatggcggccagcggcgagagcggaggggatccggcggcggcgcgccggcggtgggatctcaccaataaggggcccgacagcactccaattgtgaaagggactctggaaatttctacagacgaagaatcagatggtgttgttttatgccatccaaatggtaaaagtaatactgatggatgtgatgaagccactagtggcaatcacgatgatgatatcccggaagaccaagtaactagttctgttaaggactctgacgtggaaggtgacacacaggaagacaagtgtgtaaatcaagattcactgaagttgattgatcaagagaagtctgctccccccaagtccccagtgaagtctgcaagttctggatcggagaggcctaaacgtgttgttccccaaccattctccctttcttctcaaagaaggtcttctggaggaaatggtgttgtgatcagtccacccatcaataaggaaaaatctggtgacaaaaatagcatctctccagcaagcatgacaaagaagagtacgccaatggcacctaggaagactttgcagcctgagcaggcatttcaccctcaggaagaagactcgtgttctgtgacttcttcaactacaacgtcaacaagagctggtagaactaagacaactgtccctgttcccccttcatttgtgtgtgctaaccgagctgacaagaggagggagttctacacaaaactagaggagaaacacaaggctttggaagcagagaaggatgaggctgaggccaggaaaaaggaagagcaagaagctgcgttaaagcaactaaggaagtcattggtcattagagcaaaacccatgccaagcttctatcaagaaggccccccaccaaaggctgaacttaagaaggtgcctcctactcgtgccaaatcaccaaagtttacaagttcaaggagaaagagttgcagtgatacagcacagacaccagagggtaaaaacactatagcatcatctgcgcggtcacatcgtcacagtatcggaagttctaaggacgctaatagagtacaatgctcaccgaagaatggtgtggcaactaaaaccagagctgtcaaacctgagctgaaggccctttgaagagcgtggagcagccaagcgatgcgattgtctctgtagaaacctaattacctaactcttagccatttccattttccatgacattttgctcttattttacacccgaaatcgccaccaaaagaaggctgtatggccaagtgcatgcgctgctggaccttatccattctctttcattcgccttgtacttgtaagaactctgttgctggaccatgtgatgttccatgttgtaaattactcgagggtctttgtaaggagtctcactcgatatattggtccttgaagcccttgaactaatct

SEQ ID NO: 19048 - protein, 368 aa, Panicum virgatum
  misc_feature: Ceres CLONE 1803915
  misc_feature (222)..(278): Pfam Name: TPX2 Pfam Description: Targeting protein for Xklp2 (TPX2)
MAASGESGGDPAAARRRWDLTNKGPDSTPIVKGTLEISTDEESDGVVLCHPNGKSNTDGCDEATSGNHDDDIPEDQVTSSVKDSDVEGDTQEDKCVNQDSLKLIDQEKSAPPKSPVKSASSGSERPKRVVPQPFSLSSQRRSSGGNGVVISPPINKEKSGDKNSISPASMTKKSTPMAPRKTLQPEQAFHPQEEDSCSVTSSTTTSTRAGRTKTTVPVPPSFVCANRADKRREFYTKLEEKHKALEAEKDEAEARKKEEQEAALKQLRKSLVIRAKPMPSFYQEGPPPKAELKKVPPTRAKSPKFTSSRRKSCSDTAQTPEGKNTIASSARSHRHSIGSSKDANRVQCSPKNGVATKTRAVKPELKAL

SEQ ID NO: 19049 - DNA, 1231 bp, Panicum virgatum
  misc_feature: Ceres CLONE 1803922
  misc_feature: Encodes the peptide sequence at SEQ ID NO. 19050
acgtaccagcaggcaggcagggtcccaatcccgccggtcgctccactgctccagcctgcccccatcctcctcctccctccctctcgtccccaagccgctcgctcgctcgatcgatcccctttctgccgagctagctagccgcgcgcggaggggggacatggcgagcgctggaggcggcgcggcgggggaaggggagtggctcaaggtcgccgagctcagggccgccgtccaggcgcaggacccccgcgccaaggaggtggacaacctgacgctgcggaggttcctgcgcgcgcgcgaccacaacgtggacaaggccgccgccatggtcctcaagtacctcaagtggcggagggaggtggcgcccgacggcttcgtgccggaggagcgggtgcggagggagctcgcgcaggacaaggcctgcatgggcggcgtcgacaggagcggccgccccatcctcgtcggcttcatggccaggcacttctccgccgaccgcgacctggcggagttcaagtgttttgttgcctacttcttcgacaagatctgtgccaggatccccagaggtcaggagaaattcctcgccatcgttgatgttaagggctgggggtatgcaaactgcgacgtccgggcttacatcgctgcgatagagattatgcagaactactacccggagcggctcggcaaggcgctgatgatcaatgtgccctacatcttcatgaaggtgtggaagacgatgatctacccgttcatcgacaccaacaccagggacaagttcgttttcgtggacgacaagagcctgcacgagacgctgcgccgggagatcgacgagacccagctccccgagttccttggcggcaagatgcctctgatccctctcaaggactatgcccagcagcatgaatcagtttagccattaccatcacacgtcggtaatctccattagcggttaattaattaggtgcacaaagtaaggatgatcctttggctacaaaagggaggaagatgcaatctagctgctactagtcctgcaacaatggtgtaactgtaaaatgcagctctgtccgatcgcatgcttcagccgctccaatataattagtggtggccgaggtcggtgatcagtcagcagctgacattgtctgcgccacatgctgggctatatgaaataaaactgtgaatgggatggcacctgcatacggcaacataataataaaggattgagaccattagtccttgc

SEQ ID NO: 19050 - protein, 249 aa, Panicum virgatum
  misc_feature: Ceres CLONE 1803922
  misc_feature (86)..(248): Pfam Name: CRAL_TRIO Pfam Description: CRAL/TRIO domain
  misc_feature (7)..(72): Pfam Name: CRAL_TRIO_N Pfam Description: CRAL/TRIO, N-terminus
  misc_feature: SWISSPROT Homolog: EC 3.1.3.48 Protein-tyrosine-phosphatase
MASAGGGAAGEGEWLKVAELRAAVQAQDPRAKEVDNLTLRRFLRARDHNVDKAAAMVLKYLKWRREVAPDGFVPEERVRRELAQDKACMGGVDRSGRPILVGFMARHFSADRDLAEFKCFVAYFFDKICARIPRGQEKFLAIVDVKGWGYANCDVRAYIAAIEIMQNYYPERLGKALMINVPYIFMKVWKTMIYPFIDTNTRDKFVFVDDKSLHETLRREIDETQLPEFLGGKMPLIPLKDYAQQHESV

SEQ ID NO: 19051 - DNA, 1055 bp, Panicum virgatum
  misc_feature: Ceres CLONE 1803923
  misc_feature: Encodes the peptide sequence at SEQ ID NO. 19052
aaagaccaccgattccttggccacaaagctgaagacatttccgagcacaagagatagaggctccatcctcttcgtccatcggaatcggagaagaagaagatagccacagcctacagctacatagaatagaaacaaggaaggaataagcaaggatccatggcgcagccgccggagggagcgctgatctacgcgatggtggcgcggggcacggtggtggtggcggagcacacgtcctacgcgagcaacttccgggacatcgccgcgcagtgcctgcaccggctgccggcggggaacaaccgcttcacctacacctgcgacgcccacaccttcaacttcctcgtcgccgatggatacgcatactgcgtcgtggcgaccgagtcggctgggcggcagattcctatggccttcctggagatgatcaaggaggatttcaacaagagatacgcagggggcaaagcagctacagcgacagcaaacagcctcagccgagatttcgggccgaggcttggagatcagatgcagtactgtagggatcacccagaggaggtgagcaggctgtccagagtgaaagctcaggtggatcaagtgaaaggcatcatgatggaaaacattgacaaggtcatagatcgcggggaacaaatcgatgggctcgtcacgaggacagagcagctgcatgaccaggctgctgatttcaggcagcaaggcgtgcgggtgcgtcgcaagatgtggtaccagaacatgaagatcaagctcatcgttctcggcatcgtcatcgcgctcatcctcatcataatcctctcaatttgccatggcacatgcaagtgatccatttagctcagatgcagtagtagctggttaattagaatgtcagttttggattcggggtgatcatcacttcactgtacaggttggtccttgaggttacactccactgtgttaaccccatcaactcttgtcctgctgtttattttcttgactattcaaacaacaattttgtgttctttggttatccggcagcgcctcgctcttaattttagattttcgctctttctttc

SEQ ID NO: 19052 - protein, 222 aa, Panicum virgatum
  misc_feature: Ceres CLONE 1803923
  misc_feature (130)..(218): Pfam Name: Synaptobrevin Pfam Description: Synaptobrevin
MAQPPEGALIYAMVARGTVVVAEHTSYASNFRDIAAQCLHRLPAGNNRFTYTCDAHTFNFLVADGYAYCVVATESAGRQIPMAFLEMIKEDFNKRYAGGKAATATANSLSRDFGPRLGDQMQYCRDHPEEVSRLSRVKAQVDQVKGIMMENIDKVIDRGEQIDGLVTRTEQLHDQAADFRQQGVRVRRKMWYQNMKIKLIVLGIVIALILIIILSICHGTCK

SEQ ID NO: 19053 - DNA, 1506 bp, Panicum virgatum
  misc_feature: Ceres CLONE 1803932
  misc_feature: Encodes the peptide sequence at SEQ ID NO. 19054
actgatccagccgctgacctcaccgcgcaccattcggcactcaccttcctgctcgatccatctcttggccatatccaccgtgcattatactatgtccatgctctctccctctaaccccaagtggacctgatataaaggggaggccagttgatcgaggggaaggaatcaaacgagctagctgactattaatttcttcctcctcttgatcgatcgagcattcaggctcgatccctttctgtctcctcgacagcgggaagctagctactagcgaccatgtccatgttcggcaggaacaagaagctggatggccaacaccagcagcagatcaccggatgcggcggcgcggcgccggcggcggcgatgaggaagggcccctggacggaggaggaggacgcgcagctggtacggttcgtccgcctgttcggcgaacgccgatgggatttcttagcaaaggtgtcaggtttgcgcggtggcgggtgcatcgatccgtccccacgcatgcgagcgccgctccggcggctatatctgcggcgcatgcgtgagggccgatcgaccgaggtccacgggcagtggcgtgcggtgttaaccgtttgctttcttctccctcctctgtgtctctctgcatgcgatgcggctcccctccgtcaccgtgctgcaggtctgaggcgcaccggcaagagctgccgcctccggtgggtcaactacctccacccggacctccgccgcggccgcatcaccgccgacgaggagcgcctcatcgtccagctccacgcgcagtggggcagcaggtggtcgcgcatcgccaggagcctccccggccgcaccgacaacgagatcaagaacttctggaggacgcgcaccaggaagaaggcgctcgaggagaggcagcacagcagcggcagcaacaagacggcggcgtcgcctctttcctctatgacgacggcctcctgctgcccgggctctccgaacagcggcgccgacacgcagtcctcgtcggctgcgccgtccggcgacgacgccgagctcgaggaggcgtcgacggccaccgccgcggcgagccagcacgaggagccgcaggagtactgctgcagagtggaccagctgtggaccgagatcgcggcagccgatgcggcggcgagctacgtgctccacggctggggagctggccattgctattatggcgctgccgctgagccaccgccgatgccgtcgtcgccggtgtgggagtacagctcggattattcgctctggaggatcgatgacgaagaatactacagggagatgctcgacgcctcctgaatcctgatccatccatcttcttgtatactttcatgtatatgcttgctggtagagacagattgtctgaatgctctgcaccgggagtttccgcatcagtaataatcagttgtgtaagagaaaaattaagagcgatgatgagcaaggtagatcatggtgatgagagaactgtacttgtgattgatggtagctgaagtagtatgattgtct

SEQ ID NO: 19054 - protein, 341 aa, Panicum virgatum
  misc_feature: Ceres CLONE 1803932
  misc_feature (151)..(196): Pfam Name: Myb_DNA-binding Pfam Description: Myb-like DNA-binding domain
  misc_feature: The sequence is a functional homolog of SEQ ID NO 126 in the 10/412,699 US patent application
  misc_feature: Functional homolog of the protein sequence given in SEQ ID NO 50831
  misc_feature: Useful for making plants with modulated nitrogen use efficiency
  misc_feature: Functional homolog of the protein sequence given in SEQ ID NO 50733
  misc_feature: Useful for making plants with altered cell wall content and/or composition
MSMFGRNKKLDGQHQQQITGCGGAAPAAAMRKGPWTEEEDAQLVRFVRLFGERRWDFLAKVSGLRGGGCIDPSPRMRAPLRRLYLRRMREGRSTEVHGQWRAVLTVCFLLPPLCLSACDAAPLRHRAAGLRRTGKSCRLRWVNYLHPDLRRGRITADEERLIVQLHAQWGSRWSRIARSLPGRTDNEIKNFWRTRTRKKALEERQHSSGSNKTAASPLSSMTTASCCPGSPNSGADTQSSSAAPSGDDAELEEASTATAAASQHEEPQEYCCRVDQLWTEIAAADAAASYVLHGWGAGHCYYGAAAEPPPMPSSPVWEYSSDYSLWRIDDEEYYREMLDAS

SEQ ID NO: 19055 - DNA, 1030 bp, Panicum virgatum
  misc_feature: Ceres CLONE 1803933
  misc_feature: Encodes the peptide sequence at SEQ ID NO. 19056
accccgccgcccgcgcaccaacgcctgctcaataaatcccccgcgctccgcgcccgccgccgccctacaaccctagccgccctccctgtcgccgcggccgccgccgccgccgtcatggtgagcgccgaggccggcatcgagcgcgtgctgtggacggaggccgaggtggccgcccgcgtgggcgaggtcgccgccgagctcgcggccgacctgcgcgcgctgccggagcccgcggtcgtcgtcggcgtcgccacgggcgcgctcctcttcctcgccgacctcgtccgccgcgtcgacgcgccgctcgcggtcgacttcgtgcgcgtcgagtcctacggcggcgggaccgagtccagcggcaagccccgaatcacggccgacctcaaggtcgacgtcgccgggaagcacgtcgtcgtggttgaggatattgtggatacagggaatactctctcatgtctcattgctcatttagaaaagaaaggggcatcatccatatcggtttgcactttccttgacaaaccagcaagaaggaaagttgatattcagcttgtgggggatggaaaattctacagtggctttgagtgcccggactactttgttgttggttatggtttggattatgcagagctctaccgcaacctgccttatgtcggagttctcaagcctgagaagtacaaaaaggattcaagcaattagaccggagcctcaacttgcacaacatgcaagagggcagagttacaaatgatacaaacatctcagttttgttcagctttgtacaagaaagaagcagaaagcctgataatttacctttttctccttttaagctcaggaaaactgcagcttcccagatttcagcagcataacagtaagatgtatcactgtcagctttgttcgtcgcggccccgcaaccctggagggaaagatgtggttgtatgacatgttaaattcactttacaggccgaacagcatatctcgtggtaacctgcgtctgaagatacatctcagaagtttcaatgtgcttgtctattct

SEQ ID NO: 19056 - protein, 193 aa, Panicum virgatum
  misc_feature: Ceres CLONE 1803933
  misc_feature (7)..(152): Pfam Name: Pribosyltran Pfam Description: Phosphoribosyl transferase domain
  misc_feature: SWISSPROT Homolog: EC 2.4.2.8 Hypoxanthine phosphoribosyltransferase
MVSAEAGIERVLWTEAEVAARVGEVAAELAADLRALPEPAVVVGVATGALLFLADLVRRVDAPLAVDFVRVESYGGGTESSGKPRITADLKVDVAGKHVVVVEDIVDTGNTLSCLIAHLEKKGASSISVCTFLDKPARRKVDIQLVGDGKFYSGFECPDYFVVGYGLDYAELYRNLPYVGVLKPEKYKKDSSN

SEQ ID NO: 19057 - DNA, 686 bp, Panicum virgatum
  misc_feature: Ceres CLONE 1803938
  misc_feature: Encodes the peptide sequence at SEQ ID NO. 19058
acacacggcatcctccccccagctcctcccccatctcaggcgccatcaccaccagttcaccaccaccaccagcactcctcttccgactcgcgcagctgcggaccgaggcgcccgcgcgacggcgcgagccctacctgacggagtgacggcgggaggcgggggcggcgcggcgatgacgcggcggtgctcgcactgcagccacaacgggcacaactcgcggacgtgccccaaccgcggggtcaagatcttcggggtgcgcctcaccgatggctcggccatccgcaagagcgccagcatggggaacctctccctcctctccgccggatccaccagcggcggcgcctcccccgccgacgggcccgacctcgccgacggcggcgggggctacgcatccgaggacttcgtccaggggtcctcctccgccagccgcgagcgcaagaagggtgttccttggactgaagaagaacaccggaggtttttgctgggattacaaaagcttggaaaaggtgattggcgaggcatttctcgtaattttgtggtctcaaggacacccactcaagtagcaagtcacgctcaaaaatattttatacgccaatcgaatatgagcagaaggaagagaaggtctagcctttttgacatggtgcctgatgagtcaatggaccttccaccccttcctgggagtcaag

SEQ ID NO: 19058 - protein, 171 aa, Panicum virgatum
  misc_feature: Ceres CLONE 1803938
  misc_feature (91)..(138): Pfam Name: Myb_DNA-binding Pfam Description: Myb-like DNA-binding domain
  misc_feature: The sequence is a functional homolog of SEQ ID NO 1045 in the 11/479,226 US patent application
  misc_feature: The sequence is a functional homolog of SEQ ID NO 452 in the 10/412,699 US patent application
  misc_feature: The sequence is a functional homolog of SEQ ID NO 317 in the 11/479,226 US patent application
  misc_feature: The sequence is a functional homolog of SEQ ID NO 1002 in the 10/225,066 US patent application
  misc_feature: The sequence is a functional homolog of SEQ ID NO 308 in the 10/374,780 US patent application
  misc_feature: The sequence is a functional homolog of SEQ ID NO 1023 in the 11/479,226 US patent application
  misc_feature: The sequence is a functional homolog of SEQ ID NO 440 in the 10/412,699 US patent application
  misc_feature: Functional homolog of the protein sequence given in SEQ ID NO 50832
  misc_feature: Useful for making plants with altered cell wall content and/or composition
  misc_feature: Useful for making plants with altered lignin content
  misc_feature: The sequence is a functional homolog of SEQ ID NO 1064 in the 11/479,226 US patent application
  misc_feature: The sequence is a functional homolog of SEQ ID NO 462 in the 10/412,699 US patent application
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: Functional homolog of the protein sequence given in SEQ ID NO 50833
  misc_feature: Useful for making plants with modulated nitrogen use efficiency
MTRRCSHCSHNGHNSRTCPNRGVKIFGVRLTDGSAIRKSASMGNLSLLSAGSTSGGASPADGPDLADGGGGYASEDFVQGSSSASRERKKGVPWTEEEHRRFLLGLQKLGKGDWRGISRNFVVSRTPTQVASHAQKYFIRQSNMSRRKRRSSLFDMVPDESMDLPPLPGSQ

SEQ ID NO: 19059 - DNA, 573 bp, Panicum virgatum
  misc_feature: Ceres CLONE 1803938-R
  misc_feature: Encodes the peptide sequence at SEQ ID NO. 19060
gaatctgcaaccaagctatccggtgattcttccagcttatttctcaccgttcttgcaattctcagttccgttctggccaaaccagaaagatggagatgatctgccccaagaaacgcacgagattgtcaagcccgttgcagttcattcgaagaatccaattaacgttgatgagcttgtgggcatgtccaagctaagcataggggaatctggtcaggagacagtatcaacttctctttcgttaaatctgctagggggtcaaaatagacaatcagctttccatgcaaatcctcaaacgagggctcaggcctgatcttcagcacacaaaactgcattaggtgaaaccctggcaaaataagctttgcctccttgttttttttaatatttaagattaaccgttctctgtagcttgtatcatgtgctgtaagttatgctatgtatgaatatatcttttatttgtctggcacgcatgatatggcactatatgttaacaaagtcattaatgttagtgctgatcttcatggttgtaatgttgtaaactttttgtaagaaaagtgtagtcagttttgtgggcgc

SEQ ID NO: 19060 - protein, 102 aa, Panicum virgatum
  misc_feature: Ceres CLONE 1803938-R
  misc_feature: The sequence is a functional homolog of SEQ ID NO 1045 in the 11/479,226 US patent application
  misc_feature: The sequence is a functional homolog of SEQ ID NO 452 in the 10/412,699 US patent application
NLQPSYPVILPAYFSPFLQFSVPFWPNQKDGDDLPQETHEIVKPVAVHSKNPINVDELVGMSKLSIGESGQETVSTSLSLNLLGGQNRQSAFHANPQTRAQA

SEQ ID NO: 19061 - DNA, 646 bp, Panicum virgatum
  misc_feature: Ceres CLONE 1803940
  misc_feature: Encodes the peptide sequence at SEQ ID NO. 19062
gaggccacaccgaaagcgcagctgcgaagctggtctccgctgttacgtctcggctcggctctctccctcaccatcttcctctagtccaaagactccaaagactccaaagccccccaccccaccggccaccaccatcccgtccccccactccttccgttcgcatacgcgggaacgcgcgccgccggcggggcggggaggggaggccgatgcacccgaagctgtcgcgggccgcccgcaggctcctctgctgcggcgggcccgcctccggggaggacctgtctgacgaagggacaggatcgttaaggtgggtgttctcattgagggagcttcgatcggcaacaaacagcttcaattacgataacaagattggagaagggccatttgggagtgtgttttggggacaagtttgggatggctctcagattgctgtcaagaggttaaagaattcaaagaatggcacagaagtggaattcgcttcagaagtcgagatcttgggaagaataagacaaaaaaacctcctgagtttccgtggatattgtgcggatggacctgaacgcattctggtgtatgactatatggcaaactcaagtctctatgcacatcttcatggaccactttctgcggagtgtctccttgactggcgcag

SEQ ID NO: 19062 - protein, 146 aa, Panicum virgatum
  misc_feature: Ceres CLONE 1803940
  misc_feature: SWISSPROT Homolog: EC 2.7.11.1 Non-specific serine/threonine protein kinase
MHPKLSRAARRLLCCGGPASGEDLSDEGTGSLRWVFSLRELRSATNSFNYDNKIGEGPFGSVFWGQVWDGSQIAVKRLKNSKNGTEVEFASEVEILGRIRQKNLLSFRGYCADGPERILVYDYMANSSLYAHLHGPLSAECLLDWR

SEQ ID NO: 19063 - DNA, 1441 bp, Panicum virgatum
  misc_feature: Ceres CLONE 1803956
  misc_feature: Encodes the peptide sequence at SEQ ID NO. 19064
gttcccccgaagcccatcgagacccgtgcgacccggcgtctcctccgccaccgggcgctgcttccccgccgccgccgccgggcgcacacccgtggccgtagggcgcgtcccggttgctggcgtctccacggtccagaaggctatatgctgcaaaatggctcaaccttctgtcattcttgcaactgcaagctatgatcacacaatcagattttgggaagccaagagtggtcgctgttatcgtacaattcaataccctgactctcaagttaatcgtcttgagataaccccagacaagagattcttagctgctgctggcaatcctcatatccgcctttttgacatcaattcaaatagccctcaaccggtaattagctatgattcgcatactagtaatgtgatggctgtgggattccattgcgatggtaactggatgtactctggctctgaggatggtactgtgagaatctgggatttacgaactggcacttgtcagcgagaatatgagagccgtgcagctgtcaacactgtagtcctgcacccaaatcagaaagaactgatatctggtgatcagaatggaaacatacgtgtgtgggatttagctgctaactcgtgcagctgtgaactggtaccagaggttgataccgctgtaagatctctgacagttatgtgggatgggagtatggtggttgctgcaaataaccgtgggacatgttacgtttggcgcctgcttaagggtactcagacaattacctgctttgaacctctacacaaactgcaagcccatgatggctacattctgaaatgcctgctttcaccagaattttgtgaccctaacaggtatcttgccacagcatcatctgaccacactgtaaagatttggaatgtcgatggcttcaagttggaaagaactctagtcggccatcaacgctgggtttgggactgtgtgttctccgtcgatggtgcttatctgataactgcttcttctgacaccacggcgaggctatggacgatgtcgactggagaggccatccgggtgtaccagggccaccacaaggccaccatgtgctgcgctctccacgacggagctgaatcggccccttcataagcatgctgtgtgactctgcattctgtacatactttcgattgcagaactgtttcagcactcctactgtaatttgagaactagtggctgttaacgttgagttgctgaatcgctgggtcgtagctgctgcgctgtgcagcaaacctgtagggctctgtacaaataatccgcgtgctgttaacgttgagttgctgaatcgctgggtcgtagctgctgcgctgtgcagcaaacctgtagggctctgtacaaataatccgcgtgctgttgtccgatgtttgtgcatcatcttttgtagtaaggccggactcagtggaagtgtcatgagcattaaatttgcgg

SEQ ID NO: 19064 - protein, 316 aa, Panicum virgatum
  misc_feature: Ceres CLONE 1803956
  misc_feature (68)..(106): Pfam Name: WD40 Pfam Description: WD domain, G-beta repeat
  misc_feature (247)..(285): Pfam Name: WD40 Pfam Description: WD domain, G-beta repeat
  misc_feature (201)..(243): Pfam Name: WD40 Pfam Description: WD domain, G-beta repeat
  misc_feature (110)..(147): Pfam Name: WD40 Pfam Description: WD domain, G-beta repeat
  misc_feature: SWISSPROT Homolog: EC 2.7.11.7 [Myosin heavy-chain] kinase
MAQPSVILATASYDHTIRFWEAKSGRCYRTIQYPDSQVNRLEITPDKRFLAAAGNPHIRLFDINSNSPQPVISYDSHTSNVMAVGFHCDGNWMYSGSEDGTVRIWDLRTGTCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDHTVKIWNVDGFKLERTLVGHQRWVWDCVFSVDGAYLITASSDTTARLWTMSTGEAIRVYQGHHKATMCCALHDGAESAPS

SEQ ID NO: 19065 - DNA, 726 bp, Panicum virgatum
  misc_feature: Ceres CLONE 1803976
  misc_feature: Encodes the peptide sequence at SEQ ID NO. 19066
ccccactcatcacacaccatcagagcacagccgagagcgagacgcccaagcaaccaccactccacagctaagccagccaccgcgagaacaagtcgcagcggcggccaagaactcatctccgctctccagcgaagaagccttccaagcttgccgtgcgccatgacttccatggagctgctccacgccgtgatcccggagaagcagcgcgaggacgcggcggcagctctggcgccggcgacgacgacgagcagcagcgccaccgccacgagcggcgacgagggctcccacgtgccgcaagggtggaccaagaggaagcgctcgcgccgccagcggtccgaggaggagaacctcgcgctctgcctcctcatgctctcccgcggcggcaaccaccgcgtccaggccccgccgccggtccccgccgcggcgccggccgccgcggagttcaagtgctccgtctgcggcaagtccttcagctcctaccaggcgctggggggccacaagaccagccaccgcgccaagctgccgacccctcctgcttccgcgggcgctccggccgcacccgtcgtggaggcccccgccctaatcaccgtcgtcgtcccgccgccgatcgaggtccgcgagccggccacttcatccaccgccgcgtcctccgacggggcggccgcctcgagcagagtccacaggtgctccatctgccacaaggagttccccaccgggcaggctctc

SEQ ID NO: 19066 - protein, 188 aa, Panicum virgatum
  misc_feature: Ceres CLONE 1803976
  misc_feature (95)..(117): Pfam Name: zf-C2H2 Pfam Description: Zinc finger, C2H2 type
MTSMELLHAVIPEKQREDAAAALAPATTTSSSATATSGDEGSHVPQGWTKRKRSRRQRSEEENLALCLLMLSRGGNHRVQAPPPVPAAAPAAAEFKCSVCGKSFSSYQALGGHKTSHRAKLPTPPASAGAPAAPVVEAPALITVVVPPPIEVREPATSSTAASSDGAAASSRVHRCSICHKEFPTGQA

SEQ ID NO: 19067 - DNA, 554 bp, Panicum virgatum
  misc_feature: Ceres CLONE 1803976-R
ctccaccgatctcctggccgccgccgcggccgccgagacgtccgaggtggggagctccggcaacggcagctccgcggcccgggcgttcgacctgaacctcccggccgtgccggagttcgtgttccggtgcggcaaggccggcaagatgtgggagcaggacgaggaggtgcagagcccgctggcgttcaagaagccccgcctcctgatgaccgcgtgaggacgcgggtccgatcgatccgtccaaagatttttggtctagctgctgagagctgggtggaacactattcgttcattcattcgtctggtaccagtagtactattgtttgatttgttcttgttattacagctcttgtacagagagagagtgcgagtcagatacaacacacataccatacgtacgtaggccttcctcctcttggaagaaggatacttgtatccccttagccgtcagtcagtagtataccctagttcatactccattctggtgcagaggagattggggaactagaaaagcattcgactcccatttggtagaaaaggaatgaggattaagg

SEQ ID NO: 19068 - DNA, 1071 bp, Panicum virgatum
  misc_feature: Ceres CLONE 1803983
  misc_feature: Encodes the peptide sequence at SEQ ID NO. 19069
cacgccagggcccgagctccgtgctagggtttcctctcccgccgccgccgcctccgccgccgccggtggaggaggagctgagcgagtagcgccgggaggggaccatggggacgccggagacgtcgcgcgagccgtgcccggaccggatcctggacgacgtgggcggcgcgttcgggatgggcgccgtcggcggctccgttttccacttcctcaagggcgcctacaactcccccaacgggatgcgcctgtcgggcggcgcgcaggccgtgcgcatgaacgcgccgcgggtggggggcagcttcgccgtctggggcggcctcttctccaccttcgactgcgccatggtctacgcgaggcagaaggaggacccctggaactccatcgtcgccggcgccgccacgggcgggttcctctccatgcgccagggcgcgggggccgcggggcggtcggcgctcatgggcgggatcctcctggccctcatcgagggcgccggcctcatgctcaaccgcgtcctggtaaacccgccgctgcccgccgaggatcctaacctcatgggccccggagggttcccgggcctcccgcaggcgccgccggtcgtggcgcctcctgaggccgcgagctccagcggtgcggctggctggttcgggggcctgttcggcaagaaggaggagaataaggacaactcgagcgggggcaagtcggagatcctggagagcttcgacacgccgagtaccccgataccatcgttcgagtacaagtgaggaaaaaggtttgctgatggaactgttgcttacctggtcttggaacgtggtgattggaattggggatgcagatcagcaatacaataaccgtgaggacaagtgattcacttgctcgataacttattcctgcctttgccgctctgatttgatggctcatatctatgcgcccttgctcgtgtatgtataagccttctgaacgtggcagattggctactttttgaaatgatgtagtagtagaagaacaagcagaagcagtagtgtactgcctatatgatagcatttgtgttgtgtgcattttaatgcactcgat

SEQ ID NO: 19069 - protein, 218 aa, Panicum virgatum
  misc_feature: Ceres CLONE 1803983
  misc_feature (4)..(133): Pfam Name: Tim17 Pfam Description: Tim17/Tim22/Tim23 family
MGTPETSREPCPDRILDDVGGAFGMGAVGGSVFHFLKGAYNSPNGMRLSGGAQAVRMNAPRVGGSFAVWGGLFSTFDCAMVYARQKEDPWNSIVAGAATGGFLSMRQGAGAAGRSALMGGILLALIEGAGLMLNRVLVNPPLPAEDPNLMGPGGFPGLPQAPPVVAPPEAASSSGAAGWFGGLFGKKEENKDNSSGGKSEILESFDTPSTPIPSFEYK

SEQ ID NO: 19070 - DNA, 1071 bp, Panicum virgatum
  misc_feature: Ceres CLONE 1803990
  misc_feature: Encodes the peptide sequence at SEQ ID NO. 19071
cgagccaagtagcggtggcttgtcacccgagcgggggcattaaggtggtgtggatgccttgtgtggcgcttgggcttggacctgcggctgcactctgcggcccgcccgttccaagttgcgtagtgggccgtgggcgctttggcgaaggccttggcgtctcggcacctagagcggtgggcaatgcgtgaggctggcttcacagagcagcgaataccacccgcttccaacggtgggaggataacgggctgctgcaccgcaggcctgcgtgggcccaatcgtcctctttggcaaaccaccatctttactattcgcctttccgcacccgccgctcggtcgccttcgagttccaccagccaccaaacccgccggggagaagtcgagaggagcaagtcgccgagaagaggagagatggcccgtacgaagcagaccgcccgcaagtccaccggagggaaggcccctcgcaagcagctcgccaccaaggcggcgaggaagtcggcgccgacgaccggcggcgtgaagaagccccaccgctacaggcccgggaccgtggcgctccgcgagatccgcaagtaccagaagagcacggagctcctgatccgcaagctccccttccagcgcctggtccgcgagatcgcgcaggacttcaagacggacctccggttccagagccacgccgtgctggctctccaggaggccgccgaggcctacctcgtcgggctattcgaggacaccaacctctgcgccatccacgccaagcgcgtcaccatcatgcccaaggacatccagctagcccgccgcatccgcggcgagcgcgcgtaagccgcagccgccgctgccgtactggtagtggagatgtaggaggtcaagatggaatcggcttgttgatctccgccgcgcttagtggatctggatttagctgtactagttgtcgttctcggtttggttagtgtaaaaacaggtttacaagtctattttgtgcttcgctgctattttggctctcgcttcgtgatgaagcgaccttgttaaagacttaattcgtgatgttacttgaagtaaaattacattgttctt

SEQ ID NO: 19071 - protein, 136 aa, Panicum virgatum; identical to SEQ ID NO: 9871
  misc_feature: Ceres CLONE 1803990
  misc_feature (58)..(132): Pfam Name: Histone Pfam Description: Core histone H2A/H2B/H3/H4

SEQ ID NO: 19072 - DNA, 1254 bp, Panicum virgatum
  misc_feature: Ceres CLONE 1803998
  misc_feature: Encodes the peptide sequence at SEQ ID NO. 19073
aaaaaaactcaggtagctcatccgcacttaggatcgcagtcgcagcccaagagcgagagagagagagagagcgccatggccaagcctcacatcctcgtgctgccgctgcagttccagggccacgtcacccccctcatggagctctcccaccgcttggtcgaccacggcttcgaggtcacgttcgtcaacaccgaagtacctcacgcgcgggtcgtcggcgcgctgcaggcggcgggcggcacggcgacgctggccggcatccacctggcgtccatcccggacgggctggaagatggggaccgcatggaagtcggcaagatcgccgactcctactcccggcacattccggggcacctggagcggctcatcgccgaaatggaggcgtccgggaggcccaaggtgaagtggatcgtctgcgacgtgtacatgttgtcgtccttcctcgtcgccaaaaagtttggcatccgcgtggccgcagtctgggcgacggcggcggcgtgcttagccattagtacgaagatccccaagctgatagaggatgggctcgtcaacgacaagggttctccagagcgtgatgagatggtccaatttgcccccggaattccgccggtccacacgtcgcagctgccgtggatcaatgtcatcccgcccgagtggcaaaggtccttattcgatctgtacaagcagaccgagaggctcagcgccctcgtcgagatggtggtgtgcaactctttcagtgagctcgaggccggcgcgttcacgctcctgcccaacgtcctgcccatcgggcccctgacctccgacagggagctccagaagcccgtcgggcagttgctgccggaggacacccggtgcctcccgtggctcgatgcccagcccgacgggtccgtcgtgtacgtggcgttcggcagctcgaccttcttcaacccgcgccagttccgagagctcgcggaggggctggagctcaccggccggccgttcctctgggtggtgcgcacggacttcaccaccggcgacgtgagcaaggcgtggttcgacgagttcaaggcccgcatcgcgggcgcgggaatggtggtcagctggtgcccccagcagaaggtcttggcgcaccgcgcggtggcgtgcttcgtgtcgcactgcggctggaactcgatcactgtagcaaattatgaattaattaggctcattagattcgtctcgcgaaaaagcactcagctgtcaaaaaatatttataaacagattttatttaatacc

SEQ ID NO: 19073 - protein, 392 aa, Panicum virgatum
  misc_feature: Ceres CLONE 1803998
  misc_feature: SWISSPROT Homolog: EC 2.4.1.121 Indole-3-acetate beta-glucosyltransferase
  misc_feature: Functional homolog of the protein sequence given in SEQ ID NO 50296
  misc_feature: Useful for making plants with altered carbohydrate content
MAKPHILVLPLQFQGHVTPLMELSHRLVDHGFEVTFVNTEVPHARVVGALQAAGGTATLAGIHLASIPDGLEDGDRMEVGKIADSYSRHIPGHLERLIAEMEASGRPKVKWIVCDVYMLSSFLVAKKFGIRVAAVWATAAACLAISTKIPKLIEDGLVNDKGSPERDEMVQFAPGIPPVHTSQLPWINVIPPEWQRSLFDLYKQTERLSALVEMVVCNSFSELEAGAFTLLPNVLPIGPLTSDRELQKPVGQLLPEDTRCLPWLDAQPDGSVVYVAFGSSTFFNPRQFRELAEGLELTGRPFLWVVRTDFTTGDVSKAWFDEFKARIAGAGMVVSWCPQQKVLAHRAVACFVSHCGWNSITVANYELIRLIRFVSRKSTQLSKNIYKQILFN

SEQ ID NO: 19074 - DNA, 1413 bp, Panicum virgatum
  misc_feature: Ceres CLONE 1804002
  misc_feature: Encodes the peptide sequence at SEQ ID NO. 19075
atgcttgcttgcttgcttctcccggccgatttcactaccattccttgctcgactttgagagcggtggagagcctttgtacgtagctgcagcctgcagatgatcttctctgctttagttctactgttctgcttcacctggtccattcgtttcaagacagccgccgctgcaggccatggatcagcaggaacagaccagaactatggcaccttggatcaggtgaaggagaagctccaacaggtcgggctcgagtcatctaaccttataatcggggtggatttcaccaagagcaacgaatggacagggaagcattgtttcgacgggagaagcctgcatcacctcggcgacgctccgaacccttacgagcaggcgatcggcatcatcgggagaacgctgtcagcgtacgacgaagacaacaggatcccatgcttcggcttcggggacacatcaacgcacgatcgaagcgtcttcaacttctacagagatggccgggcgtgcaacggagtttcagaagcactgcagcgatacagagagatcgcccctcacattcggctctctggtatcatggatctttgattcattttcgttcctctctctctccctctcactgaccggcccgtggattctggtttagggccgacatctctagctccgatcatagaaacggcgacgagaattgttgaagcttctaggcaccagtaccacatcctactgatcatagctgacggccaggttccgacacgtactcgtgctcattcagcaagctacccgactgaggcaagatccatgaactaccttgaagaaaggactcttcaagctctcatacgtgccagtcatttccctctgtctattgtcctcgtcggggttggtgatgtgccatgggatgatcgcattcaccgccacgataaccgacgtttgtttgataatttccagtttgtggatttcaccgagataatgtcgagggaaacgtcgcaaaccgagaaggaggatcagtttgcgctggaagctctgaggaagataccagcccagtacagcgcgataatcgacaagtggatccgggagcaggccgcaagcgcgccttcggggactcctcttctcccaccttgctgagaccgttcttgtgtgtggcggtagccgggtgtagcgtcatgggggatggcagatgatgtaaagtctgaacttttcttcaaaaaacagtctgaactctggagcttgctaccacttggagttgagtcagttgacacttgacagtcggcattagcataaccgtagatttcccatcacattagaattaccttagaccgacagtttcatgagtcggtacttctggcatctgtaaatgtttttctattcttgtatattttcatctcttgatgtgattacgtaataatgcgtattgaaatttagcaaatrcc

SEQ ID NO: 19075 - protein, 158 aa, Panicum virgatum
  misc_feature: Ceres CLONE 1804002
  misc_feature (77)..(158): Pfam Name: Copine Pfam Description: Copine
MIFSALVLLFCFTWSIRFKTAAAAGHGSAGTDQNYGTLDQVKEKLQQVGLESSNLIIGVDFTKSNEWTGKHCFDGRSLHHLGDAPNPYEQAIGIIGRTLSAYDEDNRIPCFGFGDTSTHDRSVFNFYRDGRACNGVSEALQRYREIAPHIRLSGIMDL

SEQ ID NO: 19076 - DNA, 664 bp, Panicum virgatum
  misc_feature: Ceres CLONE 1804011-R
  misc_feature: Encodes the peptide sequence at SEQ ID NO. 19077
ttcatctgttcaaggctggagtggagccaaaatgggaagatccagagtgtgcaaatggtggcaaatggactgtcccatgcaacagaaaggcaacctttgagaccatgtggcttgaaacgttgatggctcttattggagagcagtttgatgaaactgaggacatctgtggaattgttgctagtgctcgtcagagaggagataagctcgcattatggactaagactgccagcaatgaagctgtccaggtaaacattggcaagaaatggaaggatgttatcgactacaatgacaagatcacctacactttccatgatgactccagaagagagaagcccagcagaggtggacggtacaccgtgtaaggtgcacatcatgaaggaccgtggcttggattggatagcgggggtggagtgttcttctcggtttctactttcattcgacagcctcagctattgtgcgaggcagttttcccatctgttatgatgttatgtgtctctcagatagctaatgtagtagtacaagaaagatatgctggaaagacattgacgactttgtatggcactaaatttcaatctttatatgccccgattcaacaacccagacggagccattttgttctcagattgttacaatccatatgcatgttgaaatgttttcaacctgg

SEQ ID NO: 19077 - protein, 119 aa, Panicum virgatum
  misc_feature: Ceres CLONE 1804011-R
  misc_feature (1)..(119): Pfam Name: IF4E Pfam Description: Eukaryotic initiation factor 4E
HLFKAGVEPKWEDPECANGGKWTVPCNRKATFETMWLETLMALIGEQFDETEDICGIVASARQRGDKLALWTKTASNEAVQVNIGKKWKDVIDYNDKITYTFHDDSRREKPSRGGRYTV

SEQ ID NO: 19078 - DNA, 1306 bp, Panicum virgatum
  misc_feature: Ceres CLONE 1804013
  misc_feature: Encodes the peptide sequence at SEQ ID NO. 19079
aaagccgtcatttgcacgccagttcatccaaggagcacgatcccattgctaccgcatttctcttgcaacctttttatgccccggactacagcgtttcaggatggggtgaccgaaaatttccatcttttcctcgttttttggggatttcatttccgcttctcgttcccatcgatcagcggccgcctttgctattagcttcccccatttgattccgcgagaagcaaaagactccttttttagggtgggatttgtggccgagctcttgatttgcttggcctgttcctatttctgggagaggaggagggatccttggatcagggaccgagcaagaaagcagccatgagcggcgggagcgggagtttcctcgagatccagccctcggagctcacattcccttttgaattaatgaagcagagctcatgctccatgcaactcaccaataagactgaccattatgttgcgttcaaggttaaaacaaccaacccaaagcagtattgtgtgcgccctaatattggtgttgtattacctgggttaacttgtgatgttacagtgacaatgcaagcgcagaaagagtcacctccagacatgcagtgcaaggacaagttcctagttcaaagtgttgcggctgagaatggtgcaacagctcaagacattaatgcggcaatgttcaataaggagccagggaaagttgttgatgaattcaagctgcgtgtggtctatgtgccaacaactacacccagtccaatccctgaagattctgaactagggagttctgctcattcgtctgcacaagaaaatgggatcaatcattccgcgatgccacaatctgtatctagatcatatgctgaaacaacaaaggagaagtcctctgaggcaacttctgtgatctccaagttaactgaggagaaaatgtctgctattcagcaaaaccagaagttgcggcaagagctggatcttctacggaaagagagcagcaagaatggcggcggtttctccatcaccttcttggtcgtcgttggccttctgggcatcatcgtttggctacatcctcaagaggacatagtaggatccagtctccagcagagctatactcacatgagaggattacccacatgcggcatgcatatgcataccgcctcttgtgtttttgctcctaaatggagcgcctgttctaacgtgtaacaacagccctcctagaagctttggtttgtgtacattatggtggttcatactcttctccctggagattttttggatttcgtagacttgttttaagcctaactgccgtcgactttgtcacctttaa

SEQ ID NO: 19079 - protein, 280 aa, Panicum virgatum
  misc_feature: Ceres CLONE 1804013
  misc_feature (8)..(115): Pfam Name: Motile_Sperm Pfam Description: MSP (Major sperm protein) domain
MSGGSGSFLEIQPSELTFPFELMKQSSCSMQLTNKTDHYVAFKVKTTNPKQYCVRPNIGVVLPGLTCDVTVTMQAQKESPPDMQCKDKFLVQSVAAENGATAQDINAAMFNKEPGKVVDEFKLRVVYVPTTTPSPIPEDSELGSSAHSSAQENGINHSAMPQSVSRSYAETTKEKSSEATSVISKLTEEKMSAIQQNQKLRQELDLLRKESSKNGGGFSITFLVVVGLLGIIVWLHPQEDIVGSSLQQSYTHMRGLPTCGMHMHTASCVFAPKWSACSNV

SEQ ID NO: 19080 - DNA, 603 bp, Panicum virgatum
  misc_feature: Ceres CLONE 1804013-R
catacattcctcctggaagttctcaaattcctctccatgaaactccaaccaaaatattaccactagaccagatcctcctgcaaactccaccaaaaaccatagagcttcctaaaaacagcaaaggagatgacagtatcattgatcctacaccatcaactgaagcaaagtcagcaaagaaaagactgcacatttcagaaagagatgaagaaaaggatggagaagaaccgtattctgaaacaactcctgaccaagagatacctcagcaaacaaatcttaacaggcaaagcaacgtgcagcgagcagcgacgtcacctgcagaaaagatcagttcctctagaagctcaaagagccctaagaaatgacaagatcagcatttagtcagctttcccggccttaccaccggacactacctaccaaccaaaactcgacgaagcagtggcagcgccagaactttgatcttgccaatcaaaattaaaaatagagtccttatatataaactaatgtctgccaaaccatcaatatgatagtcatatattgtgtatctaactatttgcagaactgaacaccttgcaaacactagctgtaatgagacatactactttt

SEQ ID NO: 19081 - DNA, 1023 bp, Panicum virgatum
  misc_feature: Ceres CLONE 1804016
  misc_feature: Encodes the peptide sequence at SEQ ID NO. 19082
acccgcacccgcgcccgcgtgctcagctccgcccttcccatccggcatccgctccctcctctcctctcctctcgtctcctgcaccgcccgttcccgccgccgccgccggcccaagtgagggagcagggcaggcagcccgtccccgcgccgccgcagccgcggagcagcgcgcgattccggggaccgaccgaccgaccgtcccgtcccaggcggcgatggcgtaccgggcggaggacgactacgactacctcttcaaggtggtgctcatcggggactccggcgtcggcaagtcgaacctgctctcccgcttcacgcgcaacgagttcagcctcgagtccaagtccaccatcggggtcgagttcgccacccgcagcatccacgtcgaggacaaggtcgtcaaggcccagatctgggacaccgccggccaggaaaggtaccgtgctatcacaagtgcatactaccgtggagcagtaggggcactagttgtctatgacgtgacacggcatgtcacctttgagaacgtggagaggtggatgagggagctcaaggaccacaccgacgccaacatcgtgatcatgctcgtcgggaacaaggcggaccttcgccacctcagggccgtcacgacagaggacgcaaaggccttcgccgagagagagaacgccttcttcatggagacgtcagccctggaggcgatgaatgtggaggatgccttcaccgaggtgctcacacagatctaccgcgtggtgagcaagaaggcccttgacattggtgatgaccccgctgcgcctcccaagggccagaccatcaatgttggcggcaaggacgatgtgtcggcggtgaagaagtctgcttgctgttcgtcttagcttggaaggatagaacatgtacttgggttggttgatacattttgcagtagagagggcacaggatgttatggcagtgatggtcctcaatctgtattcttgtgttaacaggtgcctagtgttcatttagccataggtcccattaattcattcaggattt

SEQ ID NO: 19082 - protein, 216 aa, Panicum virgatum
  misc_feature: Ceres CLONE 1804016
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MAYRAEDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELKDHTDANIVIMLVGNKADLRHLRAVTTEDAKAFAERENAFFMETSALEAMNVEDAFTEVLTQIYRVVSKKALDIGDDPAAPPKGQTINVGGKDDVSAVKKSACCSS

SEQ ID NO: 19083 - DNA, 1171 bp, Panicum virgatum
  misc_feature: Ceres CLONE 1804028
  misc_feature: Encodes the peptide sequence at SEQ ID NO. 19084
tcacataattctccgcgcgctcttcttctgcgcccctctcctcccgaacagcagataccacacaagcagcggcatcgagtgatccatggcggcccaggctctcctctccgggcggcagctgctcggccgccccgtgcagtcggccgtgtcccggtcctcgtcggccaggaaggcgcccttcgtcgtcagggccagctccagcccgccggccaagcaaggcgccgacaggcagctgtggttcgcgtccaagcagtccctctcctacctcgatggcacgctgcccggcgactacgggttcgacccgctggggctgtcggacccggagggcacaggggggttcatcgagcccaagtggctggcctacggcgaggtgatcaacggccggttcgccatgctgggcgcggcgggcgccatcgccccggaggtcttcggcaagctgggcatcatcccggcggagaccgcgctgccgtggttcaagacgggcgtgatcccgcccgcgggcacctacaactactgggccgactcgtacacgctcttcgtcttcaacatggcgctcatgggcttcgcggagcaccgccgcctccaggactggtacaacccgggctccatgggcaaacagtacttcctcggcctcgagaagttcctcggcggctccggcgacccctcctaccccgggggcccgctcttcaacccgctcggcttcggcaagacggagaaggagatgaaggagctcaagctcaaggagatcaagaacggcaggctcgccatgctcgccatcctcggctacttcatccaggggctcgtcaccggcgtcggcccctaccagaacctgctcgaccacctcgccgaccccgtcaacaacaacgtgctcaccagcctcaagttccactagagatgccgccggccgccgcctgttgttgtagtgggagcgagagaggtgatcgtcgatgtgtgttcgtcatgtgctggctgatgggaaggattattccgaggcgctgcatgatccgtccattgcccggcctgctcgctgctcgtaacgaattagtaatccatccatcctgttaattcagacccaggaaccgtactactgcacatggtaaatcaatgtacaattccgatcgactccagtgtcattatatatgttgagcgacgacggcgtccatttcatctt

SEQ ID NO: 19084 - protein, 268 aa, Panicum virgatum
  misc_feature: Ceres CLONE 1804028
  misc_feature (56)..(239): Pfam Name: Chloroa_b-bind Pfam Description: Chlorophyll A-B binding protein
MAAQALLSGRQLLGRPVQSAVSRSSSARKAPFVVRASSSPPAKQGADRQLWFASKQSLSYLDGTLPGDYGFDPLGLSDPEGTGGFIEPKWLAYGEVINGRFAMLGAAGAIAPEVFGKLGIIPAETALPWFKTGVIPPAGTYNYWADSYTLFVFNMALMGFAEHRRLQDWYNPGSMGKQYFLGLEKFLGGSGDPSYPGGPLFNPLGFGKTEKEMKELKLKEIKNGRLAMLAILGYFIQGLVTGVGPYQNLLDHLADPVNNNVLTSLKFH

SEQ ID NO: 19085 - DNA, 822 bp, Panicum virgatum
  misc_feature: Ceres CLONE 1804030
  misc_feature: Encodes the peptide sequence at SEQ ID NO. 19086
gcacggaactatcccgaaaccaacgggccgcgacgacgaggaaacgggatctatgagtgagcagcgggggcgcgagtgcgagatcggcgaggagatcgggcgcggccgcttcggcgtggtccgccgctgcgcctcccgcgccacgggagagcccttcgccgtcaagtccgtcgaccgctccgcgctcgccgacgacctcgaccgcgcgctggcggggctggagcccaagctggcgcggctggcggccgccgggggcgccaacccgggcgtcgtgcaggtgcgcgccgtgttcgaggacgaggcctggacgcacaccgtcatggacctctgtgcggggcccgacctgctggactgggtccgcctccggcgcggcgcgcccgtgccggagcccgccgcggcccgcgtcgtggcgcagctcgccgaggcgctcgcggggtgccaccgcgccggggtggtccaccgcgacgtcaagcccgacaacgtcctcctcgacctggacgaggacggcccagccggcgaggagggttcggcgccgcgggtgcggctcgcggacttcggctccgccgcgtggctcggcgccggcgggcggggcgccgccgaggggctcgtgggcacccctcactacgtggcgcccgaggtggtggcgggcggcgagtacggcgagaaggtggacgtgtggagcgctggggtggtggcgtmcgcgctgctgtccggcggcgcgctgccgttcggcggcgggccccccgcggtggtgttcgcggccgtgctggggggcggcctccggtttccgcccgcgctgttcgccggggtgtcgccggcggc

SEQ ID NO: 19086 - protein, 256 aa, Panicum virgatum
  misc_feature: Ceres CLONE 1804030
  misc_feature (9)..(250): Pfam Name: Pkinase Pfam Description: Protein kinase domain
  misc_feature: SWISSPROT Homolog: EC 2.7.11.1 Non-specific serine/threonine protein kinase
  misc_feature (216)..(216): Xaa is any aa, unknown, or other
MSEQRGRECEIGEEIGRGRFGVVRRCASRATGEPFAVKSVDRSALADDLDRALAGLEPKLARLAAAGGANPGVVQVRAVFEDEAWTHTVMDLCAGPDLLDWVRLRRGAPVPEPAAARVVAQLAEALAGCHRAGVVHRDVKPDNVLLDLDEDGPAGEEGSAPRVRLADFGSAAWLGAGGRGAAEGLVGTPHYVAPEVVAGGEYGEKVDVWSAGVVAXALLSGGALPFGGGPPAVVFAAVLGGGLRFPPALFAGVSPA

SEQ ID NO: 19087 - DNA, 723 bp, Panicum virgatum
  misc_feature: Ceres CLONE 1804032
  misc_feature: Encodes the peptide sequence at SEQ ID NO. 19088
gctttataacggagcggcccctcccgcgtgaggcaccgagacgcccgagaccggcaggcaggggggagcagcagcccgtccgagccccttcctcctccgggttggcgtgaggctgtgttgctgccgccgccgccgccgccgggaggagggcgaggcgagatggaggcggagaagaagccgccggcggtgtccgacgtgggcgcctgggcgatgaacgtcgtcagctccgtcggcatcatcatggccaacaagcagctcatgtcctcgtccggctacgccttcgccttcgccaccacgctgaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaactgagcatgattccggtggtctgcctcatggaatgggtgctgaacagcaagctctacaccaccaaggttatttctgcagtggtcgttgtggcggccggcgtcgggatttgcacggtcacggacgtcgaggtcaatgccaagggattcctttgcgcgtgtgtggctgtgttctgcacgtcgctgcagcagattaccattggctcctttcagaagaagtacaacattggatcatttgagctg

SEQ ID NO: 19088 - protein, 187 aa, Panicum virgatum
  misc_feature: Ceres CLONE 1804032
  misc_feature: Functional homolog of the protein sequence given in SEQ ID NO 50263
  misc_feature: Useful for making plants with altered cell wall content and/or composition
MEAEKKPPAVSDVGAWAMNVVSSVGIIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKLYTTKVISAVVVVAAGVGICTVTDVEVNAKGFLCACVAVFCTSLQQITIGSFQKKYNIGSFE

SEQ ID NO: 19089 - DNA, 700 bp, Panicum virgatum
  misc_feature: Ceres CLONE 1804032-R
  misc_feature: Encodes the peptide sequence at SEQ ID NO. 19090
gctttcatgctccctggcggtcttctgcaacatgagccaatacctctgcatcgggcggttctctgcgacctcgttccaggtcctgggccacatgaagaccgtgtgcgtgctgatccttggctggatcctgttcgactcggccctcaccgtgaagaacatcctcgggatgctgctcgcggtgatgggcatggtggtctacagctgggccatggagtccgagaagaaggcggccaccccgatcccccggaacaagagcgacatgctggacggcgaggacgtgcccctgaaggccagggtgagcggcctgcccccggtcgacctcgaggaaggcgagatgaagagctagccggccgtggcggcggtgaagattcattgattcttcttgttctttttgtgattgtacgcgctcgctcgatccaagctgctccttcgaagctatcgacgctacacttgtgttcattttggccctttttgagggggccgtccgtccgtagatgacgacgaattggccccccggtttcgacggtagatgatgatgagaacaacgctatggcagacagtttgttagggatttgtcaggcgaggggtggtggtgtggtggtggagagccattgtcaatcccgtggtggcgtgcgtgttgttatagatggtgacaagactcatataatggaatacatgtgtttctccgtggtaggattcg

SEQ ID NO: 19090 - protein, 114 aa, Panicum virgatum
  misc_feature: Ceres CLONE 1804032-R
  misc_feature: Functional homolog of the protein sequence given in SEQ ID NO 50263
  misc_feature: Useful for making plants with altered cell wall content and/or composition
LSCSLAVFCNMSQYLCIGRFSATSFQVLGHMKTVCVLILGWILFDSALTVKNILGMLLAVMGMVVYSWAMESEKKAATPIPRNKSDMLDGEDVPLKARVSGLPPVDLEEGEMKS

SEQ ID NO: 19091 - DNA, 1158 bp, Panicum virgatum
  misc_feature: Ceres CLONE 1804042
  misc_feature: Encodes the peptide sequence at SEQ ID NO. 19092
aagagtttcagccaatacagaaaactcctcagagctctccctgccttctgcaggggccaagggttagagaggaagagaagtgccaaacagtttgtgttggaactttgaaagctcttgcccaccatctcattttaaggtcaacttatcagaatgggcggtttatctctgcagcatccctgggcattcgccttcggccttctaggcaacatcatctccttcacgaccttcctggccccaatcccgacattctaccgcatctacaagagcaagtcgaccgagggtttccagtcggttccctatgtggtggcgctgttcagcgcgatgctgtggatcttctacgcactgatcaagtccaacgagttcctcctcatcaccatcaacgcagccggcatcgttattgagagtatctacatagtcatgtacttcgtctatgcagacaagaaagctaagtggttcactgcaaagatcatgcttggcctcaacgtcggcttcttcggggccatcctcctctttaccctgctcctcttcaagggtgagaagcgcatcgtcaccctcggttggatctgtgtcgccttctccgtcagtgtcttcgtcgcgccactcagcatcatcaagcgtgtgattcagacgaggagtgtggagtacatgcccttctccctctccctctcgctcaccctcagcgccgtcgtctggttcctctacggcctcctcatcaaggacaaatacgtcgcgcttccaaacgtccttgggttcaccttcggcattgtccagatggggctctacatgttctacatgaacaagacgcctttggtcccggagggtaaggtggccgggaagctgccggcgggaggagaggagcacgtcgtcaacctgcaccctgtcacagagatggcggtgcccaggagctgcaaggccgaggcgatgagccaccacagcccagccgtcaacatggtctagacgcccggatgcatgtcgagtcacctccagtccaagcacacaagctgctaactaggggctattacctcacgagccaatatccacgccatacacgcttttatcctttaatttattactatgatgcaaaaaattgcagctatagctacatactttcatgtaccctcaaattaaggaataatagtccataagaattctatctct

SEQ ID NO: 19092 - protein, 268 aa, Panicum virgatum
  misc_feature: Ceres CLONE 1804042
  misc_feature (133)..(219): Pfam Name: MtN3_slv Pfam Description: MtN3/saliva family
  misc_feature (12)..(99): Pfam Name: MtN3_slv Pfam Description: MtN3/saliva family
MGGLSLQHPWAFAFGLLGNIISFTTFLAPIPTFYRIYKSKSTEGFQSVPYVVALFSAMLWIFYALIKSNEFLLITINAAGIVIESIYIVMYFVYADKKAKWFTAKIMLGLNVGFFGAILLFTLLLFKGEKRIVTLGWICVAFSVSVFVAPLSIIKRVIQTRSVEYMPFSLSLSLTLSAVVWFLYGLLIKDKYVALPNVLGFTFGIVQMGLYMFYMNKTPLVPEGKVAGKLPAGGEEHVVNLHPVTEMAVPRSCKAEAMSHHSPAVNMV

SEQ ID NO: 19093 - DNA, 1376 bp, Panicum virgatum
  misc_feature: Ceres CLONE 1804051
  misc_feature: Encodes the peptide sequence at SEQ ID NO. 19094
actcttccacacactcgagactcgagactcgagagccagccaaagccagcttccagcagcgcacgagctgggctgagcctgagagccgccgccagcccgccaccaccacgagagggataggatggcgcccaccgcctcatccttcctcgccgtcttgctgctcgtcgcggcggccgcgtcgacgccggcgcggtcgtgcgcgccgagcgacctgcgcgcgctgctgagcgtgaagcaggcgctgggcaacccggcgacgctgtcgtcgtggagcccgtcgtcgcccaactgctgcgtgtgggaccacctccggtgcgacgacgccgggcgcgtgaacaacgtcttcatcgacggcgccgacgacgtgcacgggcagatcccgtcggcggtggcggggctgacggcgctcatgtcgctgtccctgttccgcctgccggggctcacgggcgccatcccggcctgcctcgcggggctctccaacctgcagttcctcaccatctcccacaccaacgtctccggccccatcccggaggccctggcgcggctccgcaccctggactcggtcgacctctccagcaaccggctgagcggccgcatcccggcgtcgttcgccgacctgcccaacctccggtcgctggacctccagcacaaccagctgacgggccccatcccggcggggctcgtgcaggggcagttccgctcgctgatcctgtcctacaaccagctgaccgggccgatcccgcgcgacgacgcgcaggacgagatcaacacggtggacctctcccacaacaagctcaccggcgacccctcccacctgttcgtccccgggcggcccatcgggaaggtggacctgtcctggaactacctcgacttcgacctcagcaagctggtgttcccgccggagctgacgtacctggacctgtcccacaaccgcatccggggcaccgtgccggcgtcgctggagcgcctgtccacgctgcagaagctggacctcagctacaacaacctgtgcgggccgctccccagggggcacggcgtcatcaagcacgggtgcaagccgtacgcgcacaaccagtgccgccacgggacgccgctcgccggctgccgggacctgtcgtgagcgcgccccggtcgtggtgtgtggtgagctgatctgagcacggcgacggtgcttggtgttcttagctatagacaagagtgcgctgcgtggcggcaatgccgatctcgagcagttaaaagcgtgtacgtacgaaacgacagcggtggacgtgtgctgtactggagcgtgtgttatgtactgtgtatttggtatggatccgatcggccccatgtatcaaaagaatgttactaaatggtaattatgtttgtttggcttc

SEQ ID NO: 19094 - protein, 332 aa, Panicum virgatum
  misc_feature: Ceres CLONE 1804051
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTASSFLAVLLLVAAAASTPARSCAPSDLRALLSVKQALGNPATLSSWSPSSPNCCVWDHLRCDDAGRVNNVFIDGADDVHGQIPSAVAGLTALMSLSLFRLPGLTGAIPACLAGLSNLQFLTISHTNVSGPIPEALARLRTLDSVDLSSNRLSGRIPASFADLPNLRSLDLQHNQLTGPIPAGLVQGQFRSLILSYNQLTGPIPRDDAQDEINTVDLSHNKLTGDPSHLFVPGRPIGKVDLSWNYLDFDLSKLVFPPELTYLDLSHNRIRGTVPASLERLSTLQKLDLSYNNLCGPLPRGHGVIKHGCKPYAHNQCRHGTPLAGCRDLS

SEQ ID NO: 19095 - DNA, 1633 bp, Panicum virgatum
  misc_feature: Ceres CLONE 1804056
  misc_feature: Encodes the peptide sequence at SEQ ID NO. 19096
gccgtcccttgccacgggatccccccctcccccccacccacgggcacaggcgcacagcgcgcgcggcgagctctgcgcttccactagccccctctctccaccgatctctcacccaagcacccaaccgccccgcactcgaactcgaactcgaacgccctcgaggctcggcttggttccggcaacgtcggaggagcacggggatggcgatcgggctcccctcgcccgccttcctcacctgaacccttgatcccaccagcgcggcgcgaggggcgcgggcatggggtacctgccggccctgggcgggaaggcggcgcacctggtgtccgacctcgccaccgtcatcctcaaccccgtctccgagcgggagcgccagcggcaccacgcatcccacctcccggaagctgctgaaggaaaagacacactatttggtgatgaagattctgacaaaaattccgagactcctgatggtcctgacacatcttccttcagagcatttctgatgtcatttgtatcatccacaacctccagcaaggattcaatggagaccatacctgagcataatctagacgtggaatatccaactttaacacctgttggaaaggcaagcagtgtgagaaagggcttgctcagtagagggaagcattccattggaaggattattagcaaggcaggactcagtaatttcagacagaaacccacctacagcattgatggtgaattcacaggtcaaacagaatcagttgcacctaggtttgagatgaagggatcaaaggaattggctttgcatgagaagttgccagctatgtccgagccatctgttctgttgtcagaaatgatgcgatctgttctttattcatctcttcctgttcttgttcaaggaaggaactggatgttggtttacagtacctggagacatggaatatctttgtccactctgtatagaaggagcaggctttgtgctggctactcacttctgatagttggggatcgaaggggagcagtttttggtggtttggttgaggccccactgcagcctatcataaagaggaaatatcaggggactaatgaatgctttgtgttcaccaatgtagaaggccgtcctgttatatgccgtccaacaggtgctaataactattttacattttgctcaaatgattatttggcaatgggaggtggtggtcacttcgccctttatctcgatggagacctactgaatggttctagttccacctcagagacttttaacaacccatgcttatcccatacccaggaattcaaaatcaaagatgtcgagctatggggcttcgtcaatgcttcaaaatatgaagagatgctcacgatctgccgcactgaaaagcaaggagtttggaatctgtgaccgtgcggactgcggagctcactgagttgttgatggttggtgccaacctatctcctggtgtggcctgtacagttttgtagtacataaaacgtatgtagaacatgaagaggagagtttcatatggaatagaaatgtgtagagctttgccgttcatgtttgtaaatattaacagtagaagatggtagtgtgtagtactactatatggtaaaaacaatttactttcatctgcattcgaaatcgtataagattgtcgtt

SEQ ID NO: 19096 - protein, 366 aa, Panicum virgatum
  misc_feature: Ceres CLONE 1804056
  misc_feature (206)..(344): Pfam Name: TLD Pfam Description: TLD
MGYLPALGGKAAHLVSDLATVILNPVSERERQRHHASHLPEAAEGKDTLFGDEDSDKNSETPDGPDTSSFRAFLMSFVSSTTSSKDSMETIPEHNLDVEYPTLTPVGKASSVRKGLLSRGKHSIGRIISKAGLSNFRQKPTYSIDGEFTGQTESVAPRFEMKGSKELALHEKLPAMSEPSVLLSEMMRSVLYSSLPVLVQGRNWMLVYSTWRHGISLSTLYRRSRLCAGYSLLIVGDRRGAVFGGLVEAPLQPIIKRKYQGTNECFVFTNVEGRPVICRPTGANNYFTFCSNDYLAMGGGGHFALYLDGDLLNGSSSTSETFNNPCLSHTQEFKIKDVELWGFVNASKYEEMLTICRTEKQGVWNL

SEQ ID NO: 19097 - DNA, 1206 bp, Panicum virgatum
  misc_feature: Ceres CLONE 1804057
  misc_feature: Encodes the peptide sequence at SEQ ID NO. 19098
atccgtccaaagccgagagttatctcgtgcctgccccgccgttctccggtctccacccccgcatccgatagctagcgcgagcaaaacccctctccccccggctcacccgcgtccgtccccggcaccgcgcgccccatggctgccctcctccgcacggccgccgccctcgcgctcccgccctcttggcccctttccgcgcgggagcctcgcgggcggtgcctgtcgctcgcctgcggccgccgcgccccggcgcggctgctccgggcgcggctgctgcaggctccgcacgtcctcggtcgcgccggggcccggctccggcgcctgggcgccaccgaggctgaggaggcagcgcagacggcgacgcaggaggattcagaaactgaaattactggagatagtgctgcagatgatggtgctgggagcacagatgaaacttcatctattattgtgacagccttgcagtcatacaaagaagctctgattaatgatgatgaagcaaaagttgctgagatagaggcctttttactttctattgaggatgagaaaaactcccttatgaacaaaatcactgttttagatgcagaactggcaactcaacgagaacgtatcttgaggattagcgctgatttcgataatttcaggaaaaggacagaaaatgagaagcttaacatgatgtcaaatgtgcaaggggaacttatagagagctttttgcctgttcttgacaactttgaaagagcaaaatcacaaataaaagtggaaacagagggagaggagaaaataaataatagctaccagagcatttataagcaatttattgagattctaaattcattgggtgttgaagacgttgaaactgttggcaaaccatttgatcctatgcttcacgaggctatcatgagagaagaatcaatggagtatgaagaggggatcatcctccaggaattccggaagggtttcaagcttggggaaagactacttcgcccggcaatggtaaaggtgtctgcaggaccaggccctggaaagtctggggatgatgaccctacagaggttgaagatagtgtggcacctcaaaaggttgaagatgttgaggaggatggtgatgtggagtagtggaggttaatctgtgtaacaacaagaacaggttcagaaattttgatgcttttctggattgtgccaagcaggcaatatgatagtacccatttgttg

SEQ ID NO: 19098 - protein, 324 aa, Panicum virgatum
  misc_feature: Ceres CLONE 1804057
  misc_feature (121)..(290): Pfam Name: GrpE Pfam Description: GrpE
MAALLRTAAALALPPSWPLSAREPRGRCLSLACGRRAPARLLRARLLQAPHVLGRAGARLRRLGATEAEEAAQTATQEDSETEITGDSAADDGAGSTDETSSIIVTALQSYKEALINDDEAKVAEIEAFLLSIEDEKNSLMNKITVLDAELATQRERILRISADFDNFRKRTENEKLNMMSNVQGELIESFLPVLDNFERAKSQIKVETEGEEKINNSYQSIYKQFIEILNSLGVEDVETVGKPFDPMLHEAIMREESMEYEEGIILQEFRKGFKLGERLLRPAMVKVSAGPGPGKSGDDDPTEVEDSVAPQKVEDVEEDGDVE

SEQ ID NO: 19099 - DNA, 718 bp, Panicum virgatum
  misc_feature: Ceres CLONE 1804070
  misc_feature: Encodes the peptide sequence at SEQ ID NO. 19100
acagacacaacacccaagaaactaagtagaaaatccacttcttccctgagagaccacaaatcatgacccctcctatcaaggttggaccatggggtgggagcaatgggagtccgtttgacatcacaaggccattcgagcgtctcgaaagcgtggcaattcagtttggcagagtcatcaattcatttggtttcacctatgttgatgcaataagccagaagcacactgttgggccagttgacggtgacggccgtggagaacttaccacgatcgagtttgcaccaacagagtatgtaacggaattcgccggatcaattggtgacaccaaaggaacatttgttgtgacgtatctcaggattcggacaaacttagaaacatacgagatacatggcacagggctgaacgcccaagcgaacactagcgcagtagagactgcatttcctttcagcgtccctctgccggagaacaccagcattgtgggattctttggacgtcaaggggacaatcttaatgccattggcgtttatgtgaaaccatccagttccctcgacacagacacaacacaggttgctgcggccaagattggagcatggggtgggggtggagggactgaagtttgatgtcacacagccactcatgcgccttgaaagcatgaccatccgcgctggcgactccattgattcacttggattttcctacgtcgatgaaacaggccacaagc

SEQ ID NO: 19100 - protein, 184 aa, Panicum virgatum
  misc_feature: Ceres CLONE 1804070
  misc_feature (15)..(157): Pfam Name: Jacalin Pfam Description: Jacalin-like lectin domain
MTPPIKVGPWGGSNGSPFDITRPFERLESVAIQFGRVINSFGFTYVDAISQKHTVGPVDGDGRGELTTIEFAPTEYVTEFAGSIGDTKGTFVVTYLRIRTNLETYEIHGTGLNAQANTSAVETAFPFSVPLPENTSIVGFFGRQGDNLNAIGVYVKPSSSLDTDTTQVAAAKIGAWGGGGGTEV

SEQ ID NO: 19101 - DNA, 659 bp, Panicum virgatum
  misc_feature: Ceres CLONE 1804070-R
  misc_feature: Encodes the peptide sequence at SEQ ID NO. 19102
gatgccacagagccacctaagcgcctcgacagtgtgatgattcagtctggtgacatcatcgacgcatttggcttttcctacactgatgaagctggtcagaagcacactgtaggtccttatggcgggagtggtgggagtcttaccacgatccagcttgaaccatcagagtatgtgaagcatttctctggaacaactggtaactatgtcggatcaccggctgtggcgtccctaacgatggaaaccaacttacgggtgtatgggccgtatgggaaagatcaggaaaagcatttcagcgttcccctccctgaggacgccagcattgtgggcttctttggaactgctgagaaccatcttgatgcgatcggcgtttacgtgagccgtttcatctcaaactagtccgagcggccacctgcttgaaaaggcacctcaaattaaataagtcaggacttgcgtcctcagcgagttcagctttccagtactttgtttcagcagaaataaagatgatcatgcatgatatgagcgtggtctgtacttgtttgccacagcaggggcggtcctgcggatcccttgttgacgacggtgtaatgcgagtgtttttgtttcatgtcgagagtgctttaattttgttgtaacttctgatgtggaataaaattttgtgc

SEQ ID NO: 19102 - protein, 131 aa, Panicum virgatum
  misc_feature: Ceres CLONE 1804070-R
  misc_feature (1)..(127): Pfam Name: Jacalin Pfam Description: Jacalin-like lectin domain
DATEPPKRLDSVMIQSGDIIDAFGFSYTDEAGQKHTVGPYGGSGGSLTTIQLEPSEYVKHFSGTTGNYVGSPAVASLTMETNLRVYGPYGKDQEKHFSVPLPEDASIVGFFGTAENHLDAIGVYVSRFISN

SEQ ID NO: 19103 - DNA, 1444 bp, Panicum virgatum
  misc_feature: Ceres CLONE 1804071
  misc_feature: Encodes the peptide sequence at SEQ ID NO. 19104
cactcctctccctgacttctattccgtcatggcgccccctcagatctcccgcaaaaccctcggcctcctgcttctcctcgccgccgctgccgtctcgccggccgccgccgacgatgtggtggccctgacggaggccgacttcgagaaggaggtcggccaggaccgcggcgccctcgtcgagttctacgcgccatggtgcggccactgcaagaagcttgccccagagtatgaaaaacttggtgcaagtttcaagaaggctaaatctgtattgatcgcaaaggttgactgtgatgagcacaagagtatatgtagcaagtatggagtttctggatacccaacaattcaatggttccccaaaggttctttggagccaaagaagtatgagggtgaacgttccgtggaagccctcgcagaatttgttaacagtgaagcaggcaccaatgtaaagatagctgcagttccttcaagtgtcgtggttctgactccagaaacctttgactcaattgtgcttgatgaaaccaaagacgtccttgttgagttctacgccccatggtgtggtcactgcaagcatcttgctccggtttatgagaagctggcttcagttttcaagcaggatgaaggtgttgtgattgccaatcttgatgctgacaagcacactgacttggctgaaaagtatggtgtttctggtttccccacattgaagttcttccctaagggaaacaaagctggtgaagattatgatggtggccgggacttggatgattttgtcaagttcattaacgagaagtgtggtaccagccgggattcaaagggacaacttacttcagaggctgggcttgtggcaagcttgaatcctcttgtgaaggagtttatcaatgctgcagatgacaagcggaaagaagtcctttccaaaattgaagaggatgttgctaagctcagcggttctgctgccaaacatggaaagatctacgtgacagctgcaaagaagattatggacaagggctctggctatacaaagaaggagaccgagaggcttcagcgcatgctggagaagtcgatcagtccttccaaagctgatgagttcatcatcaagaagaacattctttcgacattctcttcttgactttgatgacccacggcccttttctgctagtgagctagggccaatagcacaaccgccacatgtcaggaaaggaaaacagaagaaatggaatgatatctaagaaaggtggtagtaaaaaatccagtagtggcagaggtggatttttgtttcttacgaacttgtacccagctgctcgtcaatgcatgtccttttctggttacaggaattgacttagtttacttcagacggaagaggtttatgtagccatccccagatgactccccatactgtgtgcttaatccaataagttggttattcagcttccggtagttattttgcttt

SEQ ID NO: 19104 - protein, 364 aa, Panicum virgatum
  misc_feature: Ceres CLONE 1804071
  misc_feature (147)..(253): Pfam Name: Thioredoxin Pfam Description: Thioredoxin
  misc_feature (29)..(134): Pfam Name: Thioredoxin Pfam Description: Thioredoxin
  misc_feature (269)..(363): Pfam Name: ERp29 Pfam Description: Endoplasmic reticulum protein ERp29, C-terminal domain
  misc_feature: SWISSPROT Homolog: EC 5.3.4.1 Protein disulfide-isomerase
MAPPQISRKTLGLLLLLAAAAVSPAAADDVVALTEADFEKEVGQDRGALVEFYAPWCGHCKKLAPEYEKLGASFKKAKSVLIAKVDCDEHKSICSKYGVSGYPTIQWFPKGSLEPKKYEGERSVEALAEFVNSEAGTNVKIAAVPSSVVVLTPETFDSIVLDETKDVLVEFYAPWCGHCKHLAPVYEKLASVFKQDEGVVIANLDADKHTDLAEKYGVSGFPTLKFFPKGNKAGEDYDGGRDLDDFVKFINEKCGTSRDSKGQLTSEAGLVASLNPLVKEFINAADDKRKEVLSKIEEDVAKLSGSAAKHGKIYVTAAKKIMDKGSGYTKKETERLQRMLEKSISPSKADEFIIKKNILSTFSS

SEQ ID NO: 19105 - DNA, 820 bp, Panicum virgatum
  misc_feature: Ceres CLONE 1804081
  misc_feature: Encodes the peptide sequence at SEQ ID NO. 19106
tggattatttcttactgtaatatctttccctcctttttgcatgtatctagtgggcgcaaagttgaggaccctgacatgttagagaggatacggctaaccatcattaacaatcttctgcaatatcatcctgaatcaagcgagaagttagcaatgggtgaattttttgggataaaatctcctgagaagaaggttgatattgatattgcaactcacgtggttgttgaagatgatgggccaaaaagaagcatgctttacatagagacagctgatcggcctggcctgcttctggaaattatcaagatcattgctgacacaaatattgatgtggaatctgctgagatcgacactgagggtttggttgccaaggacaagttccatgtgagctacagaggcgcaaaactaaacagctccttatctcaggtgctgatcaattgtctgagctattacctccgaaggcctgagacggatgaagacagctattgatcgttatgttgtcccgccttccaaggacttcaaatcagaaagctatgaattctgccttgtgttccttttctgcaaagtgccttgcacatgaaatcccccttgtagcaaacaaaatgtggttcctctgttcccaaaatgcatctatataaatacttagagagttagaagatggcaatggatttgggtatcgaatcagttggatactgtgtcgtcaaacagctgggagcttcaggtttaggtttcagtggctgttatcccatttgattctgattgtgattggtaacattggaatgtacagtactcgatgtcttgtgtgatgaaataaaggagcattgcc

SEQ ID NO: 19106 - protein, 160 aa, Panicum virgatum
  misc_feature: Ceres CLONE 1804081
  misc_feature: SWISSPROT Homolog: EC 2.7.7.59 [Protein-PII] uridylyltransferase
  misc_feature: Functional homolog of the protein sequence given in SEQ ID NO 50834
  misc_feature: Useful for making plants with altered alkaloid content
  misc_feature: Useful for making plants with altered lignin content
WIISYCNIFPSFLHVSSGRKVEDPDMLERIRLTIINNLLQYHPESSEKLAMGEFFGIKSPEKKVDIDIATHVVVEDDGPKRSMLYIETADRPGLLLEIIKIIADTNIDVESAEIDTEGLVAKDKFHVSYRGAKLNSSLSQVLINCLSYYLRRPETDEDSY

SEQ ID NO: 19107 - DNA, 1488 bp, Panicum virgatum
  misc_feature: Ceres CLONE 1804095
  misc_feature: Encodes the peptide sequence at SEQ ID NO. 19108
ggacccggatccatcccaccaccaatccaatcgttctctcccccgtctccgccgggactccacgccggacccgatgggccgccgccgtcgcgccgcggccgcggccgcggccggggagggtcccgactgcttttcccacctcaacgaggacctcctccgcagcatcctctcccgcatccctacccgttccgccgccgcgctcgccgccgtgtcccgccacttccgcaaggagatccccccgctcctcgaacgcgtcgactcgctcaccctccacgagccctacgcccagccccctctgcgggtcaccccgccgctcatcctccgccgcctcgccctcgccccgcaccgcgccatcccgccctcgtccttccgcccggtcctcgacgatgccgcccagcacggcctctccgagctcgctttccgcctcacccgccgcgcgcggctgcccaggaacgtgctctccgtgaaatccctcgccgtgctcgacctcgatacatgcgccgtgcctccgtggtccggcgtcgcgtgcccctgcctccgcaccctcaggctccaccgcgtagccattgaccaggggatcatcaacaaaatcctcgcctccgcgtcatgcctggacacgctcgagatggtgtactgcacgggtatcggtacgggcagggtgggcggctgcacggtggagtcgtcatccgtaaggaacctcgtgttcaggccgactctgaatctagcgcagaccacaattagagcgtcggcgctgaggacggtgaccctgtacacgcggggtaaggtgaacagactggagctggcgcctgcaccggaggtcaggaaggcatacctgcacatcgccaagtcgctgacaacaaaggagtcattcagtgttcggccgttcctggatgctggtgtgagactggagtgcctcacgcttagaggccacgctatgaaggtgttatcaactgaatatgaagatattccagagttgactgttatgtttcaagatttgaggatactgtcagtgagcttagatatctcaagcgcacaagaaactgttttcctgctaaagctgcttgagagttgccctaacctacagaaattcagtatttcggctgctggaacgggcaaatacaaggatttgctccctttcaccgatcacaaggagaagctggcgagtatatcttgcctgactaccagcctggtggaattcacgtttcttgggttcaggcctcaacaatatcaaaaggaactgatggtttttctgctaacccaaggaaagaagctcaagaaggtttgggtggagttcgagaagggccaagcagatgctgtgaagaagattctttctgttaagagagcgccgattgaaaagacaactagcaagtatgcaggccactacacggtggagttcgattattcttgatctagttagtatatagctggtaggatttgcgtctttgtgaacggcatctcgtatacacaataaatggcatgtgttgggtc

SEQ ID NO: 19108 - protein, 444 aa, Panicum virgatum
  misc_feature: Ceres CLONE 1804095
  misc_feature (18)..(65): Pfam Name: F-box Pfam Description: F-box domain
MGRRRRAAAAAAAGEGPDCFSHLNEDLLRSILSRIPTRSAAALAAVSRHFRKEIPPLLERVDSLTLHEPYAQPPLRVTPPLILRRLALAPHRAIPPSSFRPVLDDAAQHGLSELAFRLTRRARLPRNVLSVKSLAVLDLDTCAVPPWSGVACPCLRTLRLHRVAIDQGIINKILASASCLDTLEMVYCTGIGTGRVGGCTVESSSVRNLVFRPTLNLAQTTIRASALRTVTLYTRGKVNRLELAPAPEVRKAYLHIAKSLTTKESFSVRPFLDAGVRLECLTLRGHAMKVLSTEYEDIPELTVMFQDLRILSVSLDISSAQETVFLLKLLESCPNLQKFSISAAGTGKYKDLLPFTDHKEKLASISCLTTSLVEFTFLGFRPQQYQKELMVFLLTQGKKLKKVWVEFEKGQADAVKKILSVKRAPIEKTTSKYAGHYTVEFDYS

SEQ ID NO: 19109 - DNA, 1179 bp, Panicum virgatum
  misc_feature: Ceres CLONE 1804107
  misc_feature: Encodes the peptide sequence at SEQ ID NO. 19110
atcgctcaagctccaagcaagaagagccagcagaaatcactcggttaagaacacacccacaccaatctccattagaaattttagtattggattggagccaccaccaccaccaccaatggcttgttccaccgcatctctagcggcgacgctgctggcgttcgcgctgctgttccaggcctgcctcgccgggaggcggctcaccgcgctcgtgcaggagccggccatcaccatgaagtaccacaagggcgcgctcctgtcgggccgcatcgccgtcaacttcatctggtacggcaacttctccgcgccgcagcgcgcggtcatcaccgacttcgtctcgtcgctgtccgcggccccggcggcggggcagccggagccgtccgtcgccacctggttcgggacggcgcgcaagtactacgccagctccaaggcgcggttcccggcgctgcgcgtcggctcccacgtcctcgacgcgtcctactccctcggcaagcggctcacggacggcgacctcctcaagctcgccgccaggggtgccccgagccgcgccatcaacgtggtgctcaccgccgacgacgtcgccgtggacgggttctgcatgtcccggtgcggcacgcacggcgcgtccccgcggtcgcgctccggccggttcgcgtacgtgtgggtgggcaacccggcgacgcagtgccccggccagtgcgcgtggccgttccaccagcccgtgtacggcccgcaggcggcgccgctcacgccccccaacggcgacgtcggggccgacgggatggtgatctcgctggcgtccatgatcgtcggcacggtgaccaacccgttcgggaacggcttctaccaggagggctccgccgacgctccgctggaggccgccacggcgtgcgccggcgtgtacggcaagggcgcgtaccccgggtacacggggtcgctgctggtggaccaggccagcggggccagcttcaatgccaacggggcccacgggaggaggtacctggtccccgcgctcgtggacccggacacgtcgtcgtgtgccaccttggggtaggttttggtggcgtgactagtgtttttgagaaggcttgaagggtggtgttgtcggccgagagcgttccactcggcccctgtgtgtggttcgtagtagtgaggagcaaaaattttttcacttgttgttcc

SEQ ID NO: 19110 - protein, 311 aa, Panicum virgatum
  misc_feature: Ceres CLONE 1804107
  misc_feature (39)..(311): Pfam Name: Phi_1 Pfam Description: Phosphate-induced protein 1 conserved region
MACSTASLAATLLAFALLFQACLAGRRLTALVQEPAITMKYHKGALLSGRIAVNFIWYGNFSAPQRAVITDFVSSLSAAPAAGQPEPSVATWFGTARKYYASSKARFPALRVGSHVLDASYSLGKRLTDGDLLKLAARGAPSRAINVVLTADDVAVDGFCMSRCGTHGASPRSRSGRFAYVWVGNPATQCPGQCAWPFHQPVYGPQAAPLTPPNGDVGADGMVISLASMIVGTVTNPFGNGFYQEGSADAPLEAATACAGVYGKGAYPGYTGSLLVDQASGASFNANGAHGRRYLVPALVDPDTSSCATLG

SEQ ID NO: 19111 - DNA, 1186 bp, Panicum virgatum
  misc_feature: Ceres CLONE 1804113
  misc_feature: Encodes the peptide sequence at SEQ ID NO. 19112
accaccgcatctcacaccccctgagctcagctccaagcagagtcttctccacctcctgtggttagagcgagaggccaggccgtgaaaatgccgatcagcaggatcgccgtcgggagccaccaggaggtgtaccacccgggcgccctcaaggcggcgttcgccgagttcatctccacccttatcttcgtcttcgccggccagggctccggcatggccttcagcaagctgtccgccggcggcgctacgacccccgctggcctgatctcggcggcggtggcgcacgccttcgccctgttcgtggccgtgtcagtcggcgccaacatctccggcggccacgtgaacccggccgttaccttcggcgccttcgtcggcggcaacatcaccctgttccgcggcctcctgtactgggtcgcccagctcctgggctccaccgtggcgtgcctcctcctccgcttctcgaccggcggcctcgccaccggcaccttcggcctgaccggcatctccgtgtgggaggccctggtcctggagatcgtgatgaccttcgggctggtgtacacggtgtacgcgacggccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcatcggcggcggcctcgccggcgtcatctacgaggtgctcttcatctcccacacccacgagcagctccccaccaccgactactgagctgagggctgaggcttcggtagccgccgccgccgccgccaccgaagacgttcgcgcgcagccgccggttcctccgtccgtttgatcagttccgcctcgccgccgtttgagttagttttttccctcgcaccgcgtgctgcttgcatcgaccaccgccatgtaccatgaacccgtcgaactctccgccgccgctgcgccgctcgccatggtttgcttcgatcagtcgcctcaagtcggaactgtaaccgcctccgtcaattccgcaccccgtcctcatgattgggaaaaataggtgaatttcccgcggggtgccgcactctccatccataaaagatcccccagaaag

SEQ ID NO: 19112 - protein, 250 aa, Panicum virgatum
  misc_feature: Ceres CLONE 1804113
  misc_feature (13)..(233): Pfam Name: MIP Pfam Description: Major intrinsic protein
MPISRIAVGSHQEVYHPGALKAAFAEFISTLIFVFAGQGSGMAFSKLSAGGATTPAGLISAAVAHAFALFVAVSVGANISGGHVNPAVTFGAFVGGNITLFRGLLYWVAQLLGSTVACLLLRFSTGGLATGTFGLTGISVWEALVLEIVMTFGLVYTVYATAVDPKKGSLGTIAPIAIGFIVGANILVGGAFDGASMNPAVSFGPALVSWSWTHQWVYWVGPLIGGGLAGVIYEVLFISHTHEQLPTTDY

SEQ ID NO: 19113 - DNA, 1250 bp, Panicum virgatum
  misc_feature: Ceres CLONE 1804137
  misc_feature: Encodes the peptide sequence at SEQ ID NO. 19114
agccaagcgaagccaagccagcagagcagagcgcgactcgactcatcctttcggttccgccccttccacaaccctcgagaagcttccgcccctcctcacccctacagcgccgccgccgccgccgcggccacagcagcggaaaccctagccgctgtcctccccgcctctccgcccaccggcgttcccgccgccccgcgtcctacgccgccgaagcgatcggatctcgaagaccgtcgagccacgatggaggactgggatgctgaagattttcagccagccgcatctgttgttaaagcagagccacttaaaaatcaatgggctgatgaagatgttgaagaagatgacgtaaaagattcatgggaagaagaggaggaggaggagaaacctaagccaccgcctgtagaaaaggccgcagcaaaacctagcagtaaggctcctgcgaaaaagggaaaacaacaggcatctactagtgctgaagaaccagatgagcctcctcttagccccacttcagagaaaattcgccagcaaaggcttgtggaagaagctgatttcaagtcaaccacagaactctttgcaaagaagggtggcgaccaaaagtcactagatacatttatcccaaagtctgagagcgactttgcagaatatgcagagcttattgcaaataaactactcccctacgagaaaagctttcactacatgggtctacttaagaatgtcatgagactttccatgacatctttgaaaggtgcggatgcaaaagatatatcttcatccgtgacagcaattgctaatgagaagatcaaggctgagaaagaagctgcagcaggcaaaaagaaacaaggagccaaaaagaagcaactccacatcgagaaaggagacgatgacttcatcccaggccggggtggtggctatgatgatccagatgagtatgacttcatgtgatttggctgggagcgaaagtaggtttctgtcatgtataccttggcaagcagagattgttactagagtttgcggcatagttggcattccagaggctcgtggactggacacctgaaactattttgtatctatttgaggttgatttttgactctataggatgaggaaaccatttgtggtctagatcccacaagtgcgttttcttattcttgttcttttgcttttccgtatttattttttgccaactgtactatataccatgtatctggctattactttggagtcatgcaacatgcaagaaatcctggaggtc

SEQ ID NO: 19114 - protein, 232 aa, Panicum virgatum
  misc_feature: Ceres CLONE 1804137
  misc_feature (1)..(232): Pfam Name: eIF3_subunit Pfam Description: Translation initiation factor eIF3 subunit
MEDWDAEDFQPAASVVKAEPLKNQWADEDVEEDDVKDSWEEEEEEEKPKPPPVEKAAAKPSSKAPAKKGKQQASTSAEEPDEPPLSPTSEKIRQQRLVEEADFKSTTELFAKKGGDQKSLDTFIPKSESDFAEYAELIANKLLPYEKSFHYMGLLKNVMRLSMTSLKGADAKDISSSVTAIANEKIKAEKEAAAGKKKQGAKKKQLHIEKGDDDFIPGRGGGYDDPDEYDFM

SEQ ID NO: 19115 - DNA, 1009 bp, Panicum virgatum
  misc_feature: Ceres CLONE 1804144
  misc_feature: Encodes the peptide sequence at SEQ ID NO. 19116
tctcggtcctccatttaagctccacacctacaacttctctctccctgtctctctcctgcctccattgggcaaagcgctgccaggccgcgtggctagccccgtggtgtgtgcgccggtgagaggcatagagggatgatgtcgagggaacgcaagaagcaggcggcagccgttcttcaggagaagctgaagatcctccgctccatcacccactcccacgctctgagcgacgcatccataatcatggacgcgtcggcgtacatcaaggagctgaagcagaaggtggtgaggctgaaccaggagatcgcctgcgcgcagcaggacgcgctgagacacggctcctcctacccgacggtgaccgtggaaaccctagtgggcgggcacggcgggttcctcatcaacgtcttctccgacaagagctgcccggggctgctcgtctccgtgctcgaggccttcgacgagctggggctcagcgtcctccaggccaccgcgtcctgcgccgacgactccttccgcctcgaggccgtgggtggggagaacgtggcggagaacgtggacgagcacgtcgtgaagcaggccgtgctgcaggccatcaggagctgctccgagggcggcagcgagcacgacgacgaggagtaggcggagctatagctagcgcgtagcgcacacgccgcctcgtcgccctcccgtcctgaagatgagcgtctcatgaagccgggatcgctttgcccgccccgtttccctgcttcccactctaccagctgtattttttggcttctacgtttcgctggcgaaacgagtagtagctagctccctatctactagtgctgatggtctcggtgaataatccgtagcagcagcaccatttccatcctgtgtgatatagtattaattagcgccttaattatttatattataaatctgcctgtgacgacaataagatgatcgatcaggcatgtaagaatggtgggaggttggaagcaaagctgaccggaggtagcattcgaccccc

SEQ ID NO: 19116 - protein, 167 aa, Panicum virgatum
  misc_feature: Ceres CLONE 1804144
  misc_feature: Functional homolog of the protein sequence given in SEQ ID NO 50525
  misc_feature: Useful for making plants with modulated biomass
MMSRERKKQAAAVLQEKLKILRSITHSHALSDASIIMDASAYIKELKQKVVRLNQEIACAQQDALRHGSSYPTVTVETLVGGHGGFLINVFSDKSCPGLLVSVLEAFDELGLSVLQATASCADDSFRLEAVGGENVAENVDEHVVKQAVLQAIRSCSEGGSEHDDEE

SEQ ID NO: 19117 - DNA, 1045 bp, Panicum virgatum
  misc_feature: Ceres CLONE 1804148
  misc_feature: Encodes the peptide sequence at SEQ ID NO. 19118
ctaggccgcatcccttcttcgtttcctccccgcgccgccgcctccgctcgccgccgccgccgccgccgccaccatgggccgaagacctgcgaggtgctatcgccagatcaagaacaaaccatatcccaagtcaaggtattgtcgtggtgttcctgaccccaagatcaggatctatgatgttggaatgaagaagaagggagttgatgagttcccctactgtgtgcaccttgtctcttgggaaaaggagaatgtctctagtgaggctcttgaggctgcccgtatcgcgtgcaacaaatacatgaccaagtctgcaggaaaggatgccttccacctcagggtccgggttcaccccttccatgtgctccgtatcaacaagatgctttcgtgtgctggggctgataggctccagactggaatgaggggtgccttcggcaagccccagggtacctgtgctcgggtggacattggccaggttcttctttctgtgcgctgcaaggacaacaatgctgcccatgccagtgaggctctgcgtcgtgccaagttcaagttccctggtcgccaaaagatcattgagagcagaaagtggggcttcaccaagttcagccgtgctgattacctgaagtacaagagtgagggtagaatcgtgcctgatggtgtcaatgctaagctgcttggtaaccatggtcggcttgagaagcgtgctcctgggaaggctttccttgaggccgttgcttaagttgcccagacttctacagcaggaatgcgattccaaccgttttgctttagtctatcttattttactttgtggaacttaattccaagtgttggtggtattacagtgccatgtctgaacttacctatcttgttaaacatcgttctttatgcatggagttatctgtcacatgcgtcattggattacatctcacttgcggtatgggatggaattgtatctcacttgcggcagtatctggttggggatgtgtcgtatctgtgtctgaatgcttggtttttgaattacgttaatgtaccgtgttacggtttccac

SEQ ID NO: 19118 - protein, 220 aa, Panicum virgatum
  misc_feature: Ceres CLONE 1804148
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLEAVA

SEQ ID NO: 19119 - DNA, 982 bp, Panicum virgatum
  misc_feature: Ceres CLONE 1804154
  misc_feature: Encodes the peptide sequence at SEQ ID NO. 19120
gtctcttcgacagccgcaacctctatctcgtctctctcgtatcggctatccccacccgtctcccctcccccatcaaaaaaaaaaaacccctcgaaaagcggcggcggcggcggcgcggcatggcggaggttgagactgcggcggaggctgtggcggcgacgactccggaggtcgtggcgaccgagggcggtgctgctgcggaggccaagggtccgcacaagctgcaccggcagtggaccttctggtacgacatccagtcgaagcccaagcccggcgccgcgtggggcacctccctcaaaaaggcatacaccttcgacaccgtcgaggagttctggagcttgtatgatcagattttccgtccaagcaagttgattgggaatgctgattttcatctgttcaaggctggagtggagccaaaatgggaagatccagagtgtgcaaatggtggcaaatggactgtcccatgcaacagaaaggcaacctttgagaccatgtggcttgaaacgttgatggctcttattggagagcagtttgatgaaactgaggacatctgtggaattgttgctagtgctcgtcagagaggagataagctcgcattatggactaagactgccagcaatgaagctgtccaggtaaacattggcaagaaatggaaggatgttatcgactacaatgacaagatcacctacactttccatgatgactccagaagagagaagcccagcagaggtggacggtacaccgtgtaaggtgcacatcatgaaggaccgtggcttggattggatagcgggggtggagtgttcttttcggtatctactttcattcgacagcctcagctattgtgcgaggcagttttcccatctgttatgatgttatgtgtttttcagatagtcaatgtagtagtacaagaaagatacgctggaaagacattggtggccttcgtatggcattaaatttcgatctccatagcccctgaccaacc

SEQ ID NO: 19120 - protein, 209 aa, Panicum virgatum
  misc_feature: Ceres CLONE 1804154
  misc_feature (6)..(209): Pfam Name: IF4E Pfam Description: Eukaryotic initiation factor 4E
MAEVETAAEAVAATTPEVVATEGGAAAEAKGPHKLHRQWTFWYDIQSKPKPGAAWGTSLKKAYTFDTVEEFWSLYDQIFRPSKLIGNADFHLFKAGVEPKWEDPECANGGKWTVPCNRKATFETMWLETLMALIGEQFDETEDICGIVASARQRGDKLALWTKTASNEAVQVNIGKKWKDVIDYNDKITYTFHDDSRREKPSRGGRYTV

SEQ ID NO: 19121 - DNA, 1588 bp, Panicum virgatum
  misc_feature: Ceres CLONE 1804178
  misc_feature: Encodes the peptide sequence at SEQ ID NO. 19122
agttccatttggacctccgcctccttcctcccctcctcttcactctctcccttgcatcaccaacaagaaggctaacgcacaccaacccaagaacaaggaggggaagagaaggaaagggaaaaaaaaaggaattttgatcgcccagagtgtggtagtagaatagcaatttgatctctcctcgttcgaggtcagtgcgcgaggcaataatggtggccgtggaggctgcggcggcggcggcggcggcggcggcggtggagggctcgatccgggcggaggccaaggtggcgccggagccggaggccgaggtggaggtgaagggcgatgccccggccgcgggggaggccgaggaggaggaggagaaggagtacaagagcgacatgaggaagctggaggagctcatgtccaagctcaacccctgcgcgcaggagttcgtgccgtcgtcgcgccgcgccgcggcgccggcggcgaagccggcggggggaggcgtgctctccgccgacgcgccggtgttcgtctccgccgccgagtactacggcgctgccggagggcacctgcaggtggccggcggcggcgctgccggcggcgggagccgggactccagcagcgacggatccagcaacggcagcggccaccctctgaatcgccgggtcggtgtctcgagaaggagtagcttcaaccaggggaggcggaggatggggggccgaccccgacgggctgatagggaggatagtgtgcggcgaaccgtctacgtctctgacattgatcagcatgtgactgagcagaagcttgctgaagtgttttctaattgtgggcaagtggtagattgccgtatctgtggtgacccacattctgtcctgcgttttgcgttcatcgagtttgctgatgatgctggtgcaagagcagcactaacacttgggggaaccatgcttggttattaccctgttagagttttaccttctaaaacagcaattctacctgtgaaccctaaatttcttcctcgaactgaagacgagaaagaaatggtctcaaggactgtatattgtactaacatagataagaaggttaccgaggaggatgtaaagattttctttcagggtacatgtgggaaggtttcacgcctgaggctccttggtgactatgtacactccacgtgcattgcttttgttgagtttgctcaggcagaaagtgcaattatggccctgaacttcagtggcatggtccttggctcccttcctattagggtgagcccctccaagacaccagtccgtccgcggtctcctcgcgtgatgtccaactgagcctgtcccgctccaagccgccatcgcccttgaggctgccaccagtggcagatcatccccaggcagagcttcctctagttgtgatcatgctagagccgtcgcatcgcgaatcagtaacccgtggtgttttcctagtacctagtcgtcataggaaagtcaacttgctgctaatgttctctcggaggcccatgcatctcttgttgtcggaggcaccgttttcctttagtttctgttcgttgccgttatgttaattatggatgaattcttatataacagccttttcaggcccc

SEQ ID NO: 19122 - protein, 363 aa, Panicum virgatum
  misc_feature: Ceres CLONE 1804178
  misc_feature (180)..(248): Pfam Name: RRM_1 Pfam Description: RNA recognition motif. (a.k.a. RRM, RBD, or RNP domain)
  misc_feature (277)..(346): Pfam Name: RRM_1 Pfam Description: RNA recognition motif. (a.k.a. RRM, RBD, or RNP domain)
  misc_feature (63)..(80): Pfam Name: PAM2 Pfam Description: Ataxin-2 C-terminal region
  misc_feature: The sequence is a functional homolog of SEQ ID NO 1301 in the 10/666,642 US patent application
MVAVEAAAAAAAAAAVEGSIRAEAKVAPEPEAEVEVKGDAPAAGEAEEEEEKEYKSDMRKLEELMSKLNPCAQEFVPSSRRAAAPAAKPAGGGVLSADAPVFVSAAEYYGAAGGHLQVAGGGAAGGGSRDSSSDGSSNGSGHPLNRRVGVSRRSSFNQGRRRMGGRPRRADREDSVRRTVYVSDIDQHVTEQKLAEVFSNCGQVVDCRICGDPHSVLRFAFIEFADDAGARAALTLGGTMLGYYPVRVLPSKTAILPVNPKFLPRTEDEKEMVSRTVYCTNIDKKVTEEDVKIFFQGTCGKVSRLRLLGDYVHSTCIAFVEFAQAESAIMALNFSGMVLGSLPIRVSPSKTPVRPRSPRVMSN

SEQ ID NO: 19123 - DNA, 1011 bp, Panicum virgatum
  misc_feature: Ceres CLONE 1804201
  misc_feature: Encodes the peptide sequence at SEQ ID NO. 19124
aaaacaaccccttcctcatacctacacagtagagaacaatcaaggatggagctgccgacgaagatgctggttctgctgctggtcgcgttcggcgtaccgtttccgcattggctagcggcgccaccgatcaccttgactgagaggctggaggttagccagcagcatcccaccgcagcgacgtacatgagcttcatgatgagcctggattgtgccgtcaagagcaccactgtcgagtcgatcctgtatcgcccgttgctgggtgaacagaagctgtcgacgacgccggagtactgggtcaacatcgagctcacggacgcggccggaaggcgcctcctcacgttggccctccgctccgacaacctctacgtctccggcttcgcgaaccggcacggcgagtggttcgccttcaagggccagcaggcgaaactcccgggctcgacggcgctctcctacaccggcgactacgcagacattttcggcaaaggcgtggcctaccgcggcctaggctccgtccaggtcaaccgggcccaggcgttagccaacaccctcctgctcgccgactacaggtctggctctggccccgacactgctctcaagccagcactcggcttcttcattctcaccatctccgaggcggagcggttccccaccctccgcgccgcactcggccgtgccatggacgcgtcgacgccgcaaaccatgggtgagtccctggttcgcctcgccgtgaactggaagaggctctcctgcgccctacgtgcctgggaccggttcgggcggaccatggctgtgtggaacgcaaacaccgaggcgcgtgagctccggacgaacatcggcgtcacgactccggaggccgcgctggataatatccagccgctgctacgcagcaatggctgcacctggacccactgagtaacgatgcatcttgtgttcacggaattctccggttcacgaataaaataaataaatccatctttcgcaaaaataaacaaataaataaatccatttgtc

SEQ ID NO: 19124 - protein, 288 aa, Panicum virgatum
  misc_feature: Ceres CLONE 1804201
  misc_feature (25)..(285): Pfam Name: RIP Pfam Description: Ribosome inactivating protein
  misc_feature: SWISSPROT Homolog: EC 3.2.2.22 rRNA N-glycosylase
MELPTKMLVLLLVAFGVPFPHWLAAPPITLTERLEVSQQHPTAATYMSFMMSLDCAVKSTTVESILYRPLLGEQKLSTTPEYWVNIELTDAAGRRLLTLALRSDNLYVSGFANRHGEWFAFKGQQAKLPGSTALSYTGDYADIFGKGVAYRGLGSVQVNRAQALANTLLLADYRSGSGPDTALKPALGFFILTISEAERFPTLRAALGRAMDASTPQTMGESLVRLAVNWKRLSCALRAWDRFGRTMAVWNANTEARELRTNIGVTTPEAALDNIQPLLRSNGCTWTH

SEQ ID NO: 19125 - DNA, 1379 bp, Panicum virgatum
  misc_feature: Ceres CLONE 1804225
  misc_feature: Encodes the peptide sequence at SEQ ID NO. 19126
taggccacactcattctcggtcacgtgtgctgacccgcccgtctgtttgttgttgttgctgcctataggtgtgggggtgtgtgacatctcgtggccgagcttgtggttgccttcgtgggaaatggcattactggatgccgtggtgtattcccaaccccaaggccatttcggctacgggcccagggacgcgtcccacgggctctcttggtcgtcagacgcgaccagcttcggcgaatgggaccatttcctgctcgcctcactcgtgcagaatgccgaggagtggggggaggaggtgggttccaagaaggcctcgccggaacacgacgcggcgccgtcggttgtcgactcgccatcgccagtcacgacgacgaagaggaagagaaggcggcccaaggtcgtcaagaacgaggaggagatcgagagccagcggatgacccacatttccgttgagcggaaccgccgccggcagatgaacgagtacctcgctgtgctcagatctctcatgccaccttcctacgcgcaaaggggagatcaagcatctattgttgggggagcaatcaactacgtgagggagcttgagcagctgctccaatccctccaggtgcaaaggagcctgaaggagcataaccccaacttgtccagtccctttgctggtttcttcaggtttccacagtactccgctacctccgcctctcactgtcacggtgaccccagtaaccacacgaacgaggatcagaggcccaataggagcccccggtcaccgtcggtcgccgccgacatcgaagcaagcatggtggagggacacgccagcgtcaaggttcaggcgccgcggcggcccaggcagctgctgcggctggcagacggtctccagcagctcgggctcacgaccttgcatctcaatgtcagcacggccggcaccacagtcatgtactccttcagccccaaggtggaggatgaatgcaggcagctctgtggaggagattgctaccgcagttcatgagattctagggagggtaggaggaggcaggctttagttgataccgaaaccgtcttgtgaatttgtactgtgtcttggattcttgcatgcgcaacagttgtgttcgaaggccaaggaaatataaatatttaagtagctattttttttctttttttcacctgaggttagcatctatataatgcccaaaaaattttagtacacttcagatgtgactgatacattctagaccattgtaatagtcaccaaagcgtgcatccaatgggtaccgctattggcgtggagtagcctttcgctcctagatctgagcttgtttgtttcagcttgcaaatgtttggttgtgattgcgcatttgaagttcaaataaaaaccaaattttcaattg

SEQ ID NO: 19126 - protein, 292 aa, Panicum virgatum
  misc_feature: Ceres CLONE 1804225
  misc_feature (102)..(153): Pfam Name: HLH Pfam Description: Helix-loop-helix DNA-binding domain
  misc_feature: The sequence is a functional homolog of SEQ ID NO 2744 in the 10/374,780 US patent application
  misc_feature: The sequence is a functional homolog of SEQ ID NO 674 in the 10/225,066 US patent application
  misc_feature: The sequence is a functional homolog of SEQ ID NO 486 in the 10/666,642 US patent application
MALLDAVVYSQPQGHFGYGPRDASHGLSWSSDATSFGEWDHFLLASLVQNAEEWGEEVGSKKASPEHDAAPSVVDSPSPVTTTKRKRRRPKVVKNEEEIESQRMTHISVERNRRRQMNEYLAVLRSLMPPSYAQRGDQASIVGGAINYVRELEQLLQSLQVQRSLKEHNPNLSSPFAGFFRFPQYSATSASHCHGDPSNHTNEDQRPNRSPRSPSVAADIEASMVEGHASVKVQAPRRPRQLLRLADGLQQLGLTTLHLNVSTAGTTVMYSFSPKVEDECRQLCGGDCYRSS

SEQ ID NO: 19127 - DNA, 1234 bp, Panicum virgatum
  misc_feature: Ceres CLONE 1804230
  misc_feature: Encodes the peptide sequence at SEQ ID NO. 19128
ctcctccggagtccgggttacggacgggagcccgacatcgacgcatcccctgcttctatccaaagtccaatccatcctccggccgtgtcctccctggctcccttgcggcgaaaccctagccccgccccgccccgccccgccccgcccgtatgtcgactgcttgatcggcccagcagtcggacccacctctgcccttggcccccatctgatgttcctctcccgcatcgtcctgcgcgacctggactccatcgactcgccggcctccatggcgtcctcgaagaaggtggtgacccgcgacgagtgggagcggaagctccgcgacgtcaagatccgcaaggaggacatgaaccgcctcgtcatgaacttcctcgtcaccgagggcttcgttgacgccgccgacaagttccgcatcgagtccggcacccagccggagattgacctggcgaccatcacggatcggatggaggttaagaaagcagtccaatcggggaatgttcaggaggccatcgagaaaatcaacgatcttaatcccacgattctggacacaaatccccaactatactttcatcttcagcagcagaaactaatagagttgattcgtgcgggaaaaataagtgaagctttggagtttgctcaggaagaactcgcaccaagaggcgaagaaaatcaaacatttcttgaggaaatagagaaaaccgtagcactactggtttttgaagatgtaaaaaattgcccttatggggaactgttggatgtttctcaacgtttgaagactgcaagtgaagttaatgctgctattcttacaagccaaagtcacgagaaagatccgaaacttccaagcctgttaaagatgttgctttggactcaaaatcaactggacgaaaaggcggcatatccacgaatcaatgacttgaccactgcagagctgcaagatccatcgatatgagtatgctgccgaggatgtaacggaggtaggcaccacgcctctgcttggtgcctgcacacgttattccccggatctgtcaataggtcatcgcctgcagcgattgagtggtataacagccactcactgcaagcagttggtcagaaaacttcacctgtgctgtacctgtacatgatgtagaagacatttttcgtccccttccagtcagtggaaaattattgaatttcatttttcctggacatacctttcaaacttgttactgtacttgcaatacacaaatgcgttcagtcg

SEQ ID NO: 19128 - protein, 245 aa, Panicum virgatum
  misc_feature: Ceres CLONE 1804230
  misc_feature (44)..(70): Pfam Name: LisH Pfam Description: LisH
MFLSRIVLRDLDSIDSPASMASSKKVVTRDEWERKLRDVKIRKEDMNRLVMNFLVTEGFVDAADKFRIESGTQPEIDLATITDRMEVKKAVQSGNVQEAIEKINDLNPTILDTNPQLYFHLQQQKLIELIRAGKISEALEFAQEELAPRGEENQTFLEEIEKTVALLVFEDVKNCPYGELLDVSQRLKTASEVNAAILTSQSHEKDPKLPSLLKMLLWTQNQLDEKAAYPRINDLTTAELQDPSI

SEQ ID NO: 19129 - DNA, 348 bp, Panicum virgatum
  misc_feature: Ceres CLONE 1804233
  misc_feature: Encodes the peptide sequence at SEQ ID NO. 19130
gcacattcccagaccggccgactgctccgactgcatattcatttgatagggtattccgttctgactgcaataccaaagaagtatacgaggaaggggccaaggcagtcgccctctctgtagttagtggtattaactcaagtgtgtttgcgtatggtcaaacaagtagtggaaagacatacaccatgactggaataacggaacatacagctgcagatatctatgattacattgccaagcatgaggagagagcatttgtattgaaattttcagcaattgaaatatataatgaagttgtaagggatcttcttactgctgaaagcacatctcttaggctttgggacgatgcgg

SEQ ID NO: 19130 - protein, 115 aa, Panicum virgatum
  misc_feature: Ceres CLONE 1804233
  misc_feature (1)..(113): Pfam Name: Kinesin Pfam Description: Kinesin motor domain
TFPDRPTAPTAYSFDRVFRSDCNTKEVYEEGAKAVALSVVSGINSSVFAYGQTSSGKTYTMTGITEHTAADIYDYIAKHEERAFVLKFSAIEIYNEVVRDLLTAESTSLRLWDDA

SEQ ID NO: 19131 - DNA, 1038 bp, Panicum virgatum
  misc_feature: Ceres CLONE 1804234
  misc_feature: Encodes the peptide sequence at SEQ ID NO. 19132
attgctggccaacaactgctgctgcaggcaacccctctccctcttcgtctgcttcctcctgcgtgttactatggatgaagttgggtcatttcctccagggaaaaagattgccgttgtgtttgtcataggtggccctggcagtggcaagggcactcagtgttctatgattgtcaaacagtttggcttcacccatctaagcgctggagatcttctgcgtcaggaagctaaatctgatactgaacaaggtacgatgataaagaatctgatgcgtgaaggaaagcttgtgccgtccgagctcattgtcaagcttctgttaaaggcaatgcttcaaagtgggaatgacaagttccttgttgacggatttcctcgaaacgaagagaaccgccaagcatatgagagtattattaaaattgaacctgatttcgtactatttattgattgcccaaaagaagagttggagcggcgcattctaaaccgaaatcagggaagagatgatgataacattgacactatcaggaggcggtttgaagttttccaggaatcaactctacctgttgtgcagtactatgagaaaaggaggaagctcagaagggttgacggtgctaaatctgctgatgcagttttcaaagatgtgaaggccatattcactcaactgaacactcaggcctccgccactgcatcccctcattcccggccaacaactgctgcagcaggcaacccctctccctcttcgcctgcttcctcctgcgtgctactatgaattttgatggggaacggggcgcggtacatggtgttggtacgatcaacctgaggtttactttgggaaaggttgtgcggcattcccctcgatcaataaaaacatcgtcagcggtttcttgctgtgtcatgatggatttgagttggttttcgagtctaataaattagtcgtgtctagatttgaacaatttattagtaaaggctatgatagcggaggcttgttccgcttatccctttcggattttttgtaattcagttgtgaaccaggttaaccgtttgagt

SEQ ID NO: 19132 - protein, 229 aa, Panicum virgatum
  misc_feature: Ceres CLONE 1804234
  misc_feature (18)..(171): Pfam Name: ADK Pfam Description: Adenylate kinase
  misc_feature: SWISSPROT Homolog: EC 2.7.4.3 Adenylate kinase
MDEVGSFPPGKKIAVVFVIGGPGSGKGTQCSMIVKQFGFTHLSAGDLLRQEAKSDTEQGTMIKNLMREGKLVPSELIVKLLLKAMLQSGNDKFLVDGFPRNEENRQAYESIIKIEPDFVLFIDCPKEELERRILNRNQGRDDDNIDTIRRRFEVFQESTLPVVQYYEKRRKLRRVDGAKSADAVFKDVKAIFTQLNTQASATASPHSRPTTAAAGNPSPSSPASSCVLL

SEQ ID NO: 19133 - DNA, 383 bp, Panicum virgatum
  misc_feature: Ceres CLONE 1804238
  misc_feature: Encodes the peptide sequence at SEQ ID NO. 19134
aactcgacaagaatgggaagatctatgagcataaggtgcacaatgttgctatgaatccaccaacaaaattcaaggtcctaccggttcatgagctaatcagatcacttggttgtccttctactgcaaaaccaacttattttgaggcttcatctcaatatttgtgcgcggcaccatcttatttgagattagcacggataaaatgctacatctcgttgtgccgaatgctttcgctagcaaatctgggagaaggatagaggagtttaacatgaagcctccaaattttgtatttttgttttatgatagtgcacgaagttactgagtaaattgagtcataacagctgcatatatgttcagtgatagtttatagaataagaattcctctc

SEQ ID NO: 19134 - protein, 83 aa, Panicum virgatum
  misc_feature: Ceres CLONE 1804238
  misc_feature: Functional homolog of the protein sequence given in SEQ ID NO 50835
  misc_feature: Useful for making plants with modulated nitrogen use efficiency
LDKNGKIYEHKVHNVAMNPPTKFKVLPVHELIRSLGCPSTAKPTYFEASSQYLCAAPSYLRLARIKCYISLCRMLSLANLGEG

SEQ ID NO: 19135 - DNA, 1139 bp, Panicum virgatum
  misc_feature: Ceres CLONE 1804242
  misc_feature: Encodes the peptide sequence at SEQ ID NO. 19136
acaaagcggaaagcatcacacttgcacagttcctcctcagtctacactctcccactcccaccactcccctgcttcacccgaagcgtgccggcaggccggcagcgagcagtcaggagccatggctccgccgctgctgctcgtccttctcctcctcccgtccctcgccgccggccatcagcacccgtcctccttcggttcctccgccctctccgagtggcgctccgccaaggcctcctactacgccgccgaccccgaggacgccatcggtggggcgtgcggtttcggggatctgggcaagcacgggtacgggatggcgacggtggggctgagcacggcgctgttcgagcgcggcgcggcgtgcggcggctgctacgaggtcaagtgcgtcgaggatctcaagtattgtctccccggcacctccatcgtcgtcacggccaccaacttctgcgcccccaactacggcctccccgccgacgccggcggccactgcaacccgcccaaccaccacttcctcctccccatccaggcgttcgagaagattgccctctggaaggccggcgtcatgcccatccagtaccgccgtgttaagtgcctccgtgaaggtggtgtcaggttctctgtcaacggtcgacgcttcttcttcacagtgctaatcagcaacgttggtggtgcgggtgatgtgagatcggtgaagatcaaaggaacagagtcaggatggctctcgatgggccgcaactggggtcaggtgtggcacatcaactgtgacatgaggggtcagcccctgtccttcgagctcagctcaagcgatggcaagccgctgaccagtttcaatgtcgtgcccaaggattgggaatatggaaaaacatacaccgggaaacagtttctgctgtagaaggagtgccacaagatcagcttacagtttctaattttttgttctgattctacgagttgaactgcggtgtatattcctctgtggaacaagtaatatcattaggagaaaaatactagtgcagggcctcaaatagtagttcttgctcataaatgcattttcgtgtcccctgatagaaggccctattttgggtgtctccgttgtattacaacattttacctggcaagcaatgataatagtatctctgcag

SEQ ID NO: 19136 - protein, 257 aa, Panicum virgatum
  misc_feature: Ceres CLONE 1804242
  misc_feature (164)..(241): Pfam Name: Pollen_allerg_1 Pfam Description: Pollen allergen
  misc_feature (67)..(153): Pfam Name: DPBB_1 Pfam Description: Rare lipoprotein A (RlpA)-like double-psi beta-barrel
  misc_feature: Functional homolog of the protein sequence given in SEQ ID NO 50836
  misc_feature: Useful for making plants with altered carbohydrate content
  misc_feature: Functional homolog of the protein sequence given in SEQ ID NO 50837
  misc_feature: Useful for making plants with altered cell wall content and/or composition
MAPPLLLVLLLLPSLAAGHQHPSSFGSSALSEWRSAKASYYAADPEDAIGGACGFGDLGKHGYGMATVGLSTALFERGAACGGCYEVKCVEDLKYCLPGTSIVVTATNFCAPNYGLPADAGGHCNPPNHHFLLPIQAFEKIALWKAGVMPIQYRRVKCLREGGVRFSVNGRRFFFTVLISNVGGAGDVRSVKIKGTESGWLSMGRNWGQVWHINCDMRGQPLSFELSSSDGKPLTSFNVVPKDWEYGKTYTGKQFLL

SEQ ID NO: 19137 - DNA, 1171 bp, Panicum virgatum
  misc_feature: Ceres CLONE 1804247
  misc_feature: Encodes the peptide sequence at SEQ ID NO. 19138
acaaactagaagccgaatcaatcatcctcagagccagtacaggaacgaagggcaccttccagccacggcatggagaagagcaaggttcttgtcgtgggtggcgcgggcttcatcggccggcggcttgtcgcggcgagcctggcacagggccacccgactttcgtcctgatgcggtcgtagatcggcgtcgacgtggacaaggtccagacgctgctgtccttcaaggccaagggggcgcgcctggtggaggcgtcgctcgacgaccacgcggggctcgtcgccgccgtgaggcaggtggacgtagtcgtgtcggccttgtccgggacgtacatccgcagccaggtcaagctcgtcgaggcgatcaaggaggctgggaacgtcaagcgtttcctaccgtcggaattcggcatggacccgtcgaagatggagcatgctcttgcgccaggaagaattacattcgacgacaagatggaggtacggagggcgatagaggcggcgagcattccccacacctacatttcttgcaattgctttgcggcctacttttgtccgaacctcggccaaatcggcactcttctgcctcccaaagataaggttcgtgtatatggagacggcaatgtcaaagtcatttttgtggatgaagatgatgcggcaacatatataatcaagaccctagatgaccctcgcaccttgaacaagtcaatatacctaaggccatcggaaaacatcctttctcagagtgacctgatcgtgaaatgggaaaacctctctggaaatgttcttgagaaaatctacattccagctgatgagttcttggcttcaatgaaagataaggattttggcaatcaattcgtaatgggacacatctaccacattttttacgaaggttgccggacaaactttgacattggggaggacggagcagaagcaactcttctgtacccggaggttgagtacacccgcatggatgattatatgaaaagatatgtgtaacttttaatgtttttggtgacgtatcttatcatatcagaatccgtagacactgtgtctggaattataaggtgttacattgcacagtggcacatactatactttggtttgtaatcaagctttcataaagaacgtgcatatattgggcatgtagacacttcaataaaaaaatttggtttct

SEQ ID NO: 19138 - protein, 194 aa, Panicum virgatum
  misc_feature: Ceres CLONE 1804247
  misc_feature (2)..(185): Pfam Name: NmrA Pfam Description: NmrA-like family
  misc_feature: SWISSPROT Homolog: EC 1.3.1.45 2'-hydroxyisoflavone reductase
MDPSKMEHALAPGRITFDDKMEVRRAIEAASIPHTYISCNCFAAYFCPNLGQIGTLLPPKDKVRVYGDGNVKVIFVDEDDAATYIIKTLDDPRTLNKSIYLRPSENILSQSDLIVKWENLSGNVLEKIYIPADEFLASMKDKDFGNQFVMGHIYHIFYEGCRTNFDIGEDGAEATLLYPEVEYTRMDDYMKRYV

SEQ ID NO: 19139 - DNA, 1182 bp, Panicum virgatum
  misc_feature: Ceres CLONE 1804251
  misc_feature: Encodes the peptide sequence at SEQ ID NO. 19140
aagaaccccccactccactccactcaatccgcctcagccgcagccggccaccccacccaccgcaaggagcgagagccaccaaccaagaagcagccatggtgacggcggcggccgcgacgcagcgccgtgacgccgaggcggagctgaacctgcccccgggcttccgcttccaccccaccgacgaggagctcgtcgcgcactacctctgcgcgcgcgccgccgggcgcagcgcgccggtgcccatcatcgccgaggtcgacctctaccgcttcgacccctgggagctccccgagcgcgccctcttcggccgccgcgagtggtacttcttcacgccgagggaccgcaagtaccccaacggctcccgccccaaccgcgccgccgggaccgggtactggaaggccaccggcgccgacaagcccatccagcacgggggccggaccctggggatcaagaaggcgctcgtcttctaccacgggaagccgccgcgcgggatcaagaccgagtggatcatgcacgagtaccgcctcgccgacgccggcggcaagaagcccggcaacggctcgctcaggctggacgactgggtgctgtgccgcctctacaacaagaagaacgagtgggagaagatgcagcagcagaaggagaaggcaatgaagtcggaggcgtcgctctcgcactcccactcccactccgacacgcgcacgccggagtcggagatcgacgacgacacgttcccggggctgggctcgctgccggagttcgacggcatgcgccccgcccccgccggcgccgtcctgcccaaggaggaggtgcaggacttcggcaacctcggcggcgacgactggctcgcggggatcaacctcgactacctgcaggtgcccggggacgccgacttcttcaacaacatgaccctattctgaacctgagctctgctccgatttgctctgctctgctctgctccgaccccgaggagggatgcagctgcaactgtgaatagttcagatttgctttccattcagagaaacaaaaattattcctgctaatgcctggttgtagtgccgtagaccgtagtggtgtcgtgcagtagtggtatgcaggtcagcatggattggagtccagtataggattgaagctcatcattggagcttgtgatcagtgacaaaattctttcgtttctggttcagc

SEQ ID NO: 19140 - protein, 273 aa, Panicum virgatum
  misc_feature: Ceres CLONE 1804251
  misc_feature (19)..(145): Pfam Name: NAM Pfam Description: No apical meristem (NAM) protein
  misc_feature: The sequence is a functional homolog of SEQ ID NO 891 in the 10/374,780 US patent application
  misc_feature: The sequence is a functional homolog of SEQ ID NO 853 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Functional homolog of the protein sequence given in SEQ ID NO 50324
  misc_feature: Useful for making plants with altered terpenoid content
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50838
  misc_feature: Useful for making plants with modulated water use efficiency
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 854 in the 10/374,780 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 851 in the 10/374,780 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1012 in the 11/435,388 US patent application
  misc_feature: The sequence is a functional homolog of SEQ ID NO 852 in the 10/374,780 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 476 in the 10/666,642 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
MVTAAAATQRRDAEAELNLPPGFRFHPTDEELVAHYLCARAAGRSAPVPIIAEVDLYRFDPWELPERALFGRREWYFFTPRDRKYPNGSRPNRAAGTGYWKATGADKPIQHGGRTLGIKKALVFYHGKPPRGIKTEWIMHEYRLADAGGKKPGNGSLRLDDWVLCRLYNKKNEWEKMQQQKEKAMKSEASLSHSHSHSDTRTPESEIDDDTFPGLGSLPEFDGMRPAPAGAVLPKEEVQDFGNLGGDDWLAGINLDYLQVPGDADFFNNMTLF

SEQ ID NO: 19141 - DNA, 954 bp, Panicum virgatum
  misc_feature: Ceres CLONE 1804256
  misc_feature: Encodes the peptide sequence at SEQ ID NO. 19142
aagccagctgcaagtctcactcctaatcctaaaccacaagacacctcagtgttagtagtgcaatggcgaccagcaccatggccctctcctctacggccttcgccggcaaggccgtcaacgtgccatcgtctctcttcggcgaggcccgcgtgaccatgcgcaagaccgcggcgaagcccaagccggccgcctccggcagcccgtggtacggcccagaccgcgtgctctacctcggcccgctctccggcgagcccccgagctacctgaccggcgagttccctggcgactacggctgggacaccgccgggctctcggccgaccccgagaccttcgccaagaaccgggagctggaggtcatccactcccgctgggccatgctcggcgcgctcggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggcttcttcgtgcaggccatcgtcaccggcaagggcccgcttgagaacctcgccgaccatctcgccgaccccgtcaacaacaacgcctgggcctacgccaccaacttggtgcccgccaagtgaggcgtctgttcccgaactgtttgatttgtaggaggtccgaatgtgaccgcgcataggtttcagtatgtgccaggtcctaaattatgggggcccatcc

SEQ ID NO: 19142 - protein, 259 aa, Panicum virgatum
  misc_feature: Ceres CLONE 1804256
  misc_feature (58)..(226): Pfam Name: Chloroa_b-bind Pfam Description: Chlorophyll A-B binding protein
MALSSTAFAGKAVNVPSSLFGEARVTMRKTAAKPKPAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNLVPAK

SEQ ID NO: 19143 - DNA, 594 bp, Panicum virgatum
  misc_feature: Ceres CLONE 1804265
  misc_feature: Encodes the peptide sequence at SEQ ID NO. 19144
aagcagagccgcagcaaagaagcagagcacgccgtcgccgctctgcgggccccctgccccggaccccggtgattccgaggaaacagagcaatgccgcgcgctcccgtcgccacgctgctctcgctcggccggaggggctacgccgcggcggcggccggagcggaggtgcgcctgcgcgcggcgccctcggcggcgagggtctcgggcacgggggttggcagtaacgccgcggcggcggcggcggccagggaggtcttctggatgagggacccgcagacggggtgctgggcccccgaggaccgcttcgccgacgtcgacgcggccgagctccgcgcgcgcctgctcgccaggaaggactagggaggacctcgtcctttcggttgatgtcttgatgacgaaccattgacgattcaaacttgatgaagccgattaatagaatatcctcctttggctagaattctgttgctccagctccaaaaaccaattgaaatatcccaaacaatcaaattaccactctgctaggaaaaacaaaagatacccctaacatgctcctgttacatctggaatcctaatttcttttgtttctcatcacat

SEQ ID NO: 19144 - protein, 89 aa, Panicum virgatum
  misc_feature: Ceres CLONE 1804265
  misc_feature (1)..(86): Pfam Name: LEA_3 Pfam Description: Late embryogenesis abundant protein
MPRAPVATLLSLGRRGYAAAAAGAEVRLRAAPSAARVSGTGVGSNAAAAAAAREVFWMRDPQTGCWAPEDRFADVDAAELRARLLARKD

SEQ ID NO: 19145 - DNA, 1362 bp, Panicum virgatum
  misc_feature: Ceres CLONE 1804273
  misc_feature: Encodes the peptide sequence at SEQ ID NO. 19146
atcgcccgctgctctcctcttcgtcctcctcatcctcctctctcatctgttcactcccggccctgtcctccggcgcccatctccatctgaatcccagcgtaccaccagaggagggagatggccggaggcggcgacaactcccagacgaacggagctcgcgaccagagggccatggaggaggggaggaaggatgagttcgccggcgaccggggctgcgccgccgccatctccattcccttcgttcagaagatcatcgcggagatctttggcacctacttcctcatgttcgcggggtgcggcgcggtgaccatcaacgcgagcaagaacggcgccatcacgttcccgggggtggccatcgtgtgggggctggcagtgatggtgatggtgtacgccgtcggccacatctccggcgcgcacctcaaccccgccgtcaccctggcgttcgccacctgcggccgcttcccgtggcggcagctgccggcgtacgtgctggcgcagatgctgggctccacgctcgccgccggcacgctgcgcctcatgttcggcggccgccacgagcacttcccggggacgctcccgaccggctccgacgtgcagtcgctcgtcatcgagatcatcaccaccttctacctcatgttcgtcatctccggcgtcgccaccgacaacagagccatcggggagctggcagggctggccgtgggcgcaaccatcctgctcaacgtgctcattgccgggcccgtgtccggcgcgtcgatgaaccctgctcggagcgtgggcccggcgctggtgagcgggcagtaccggtccatctgggtttacctggtgggcccggtggcgggggccgtggcgggggcctgggcctacaacctgatccgcttcaccaacaagcccctccgcgagctcaccaagagcacctccttcctccggagcatgagcaggatgaactccgccgtctgatcactgatcaaccgcgagcccaccagtcagagctgatgtggcaggccatcatccttacgtggggcggcctgggggcatttcagtaatctagcacctattcacctgtgagagtatatatactactatatacttcattcgttccaaaatataggtcgttttggcttttttgattcatagtatttgttatgcacctagatataacatatgtctaggtacatagtaaaatatatgaatctaaaaaatcaaaatgacctatattttgaaacggatggaatatatgtgtgtgactgtgtgtgtggaggacatggggcatgaagggttggataatcagatggtgatggatgtggcagtgtccatgtacgcctgtttcgataactcgaattaatcagtgttggtcagactcag

SEQ ID NO: 19146 - protein, 279 aa, Panicum virgatum
  misc_feature: Ceres CLONE 1804273
  misc_feature (35)..(249): Pfam Name: MIP Pfam Description: Major intrinsic protein
MAGGGDNSQTNGARDQRAMEEGRKDEFAGDRGCAAAISIPFVQKIIAEIFGTYFLMFAGCGAVTINASKNGAITFPGVAIVWGLAVMVMVYAVGHISGAHLNPAVTLAFATCGRFPWRQLPAYVLAQMLGSTLAAGTLRLMFGGRHEHFPGTLPTGSDVQSLVIEIITTFYLMFVISGVATDNRAIGELAGLAVGATILLNVLIAGPVSGASMNPARSVGPALVSGQYRSIWVYLVGPVAGAVAGAWAYNLIRFTNKPLRELTKSTSFLRSMSRMNSAV

SEQ ID NO: 19147 - DNA, 1332 bp, Panicum virgatum
  misc_feature: Ceres CLONE 1804289
  misc_feature: Encodes the peptide sequence at SEQ ID NO. 19148
aagccggccagagctctcagcaatcctctgttcctcactcatcgtctccgttcctctgatcgaccttggctgggctttttgtcggaggagaagtagcaaaatggccgacgaagttcagcatctcaccagggccttctcaggtctgggcgggctcggcgtggacgagccggcgatggtgtcggcgctggcgcggtggcgcgggcagccggagaagcggtcgggcttccggaagggcttcccgggcttcttctcgagccacggcgagatggagcggtgcgaggaggagtacatgctccgcctggccgccgagttcgcgcggctcaagaacctggtggtgctgtgggcgatgcacccgtgggagcgcgacgcgcggctggcgcaccacgtcctccaccagcaccaccccgccgccatcgtcgtggaggtcgcctgcacgcgctccgccgacgagctcctcggcgcgcgccgcgcgtaccaggcgctctaccaccactccctcgaggaggacgtcgcctaccgcgccagggacaagccctactgcaacctgctggtggggctcgtgagcgcgtaccggtacgaggggccccgggtgaacgaggaggcggcgcgggcggaggccgaggcgctgggcgcggcggtgaagagcgccgccggcgggaagctgctggcggagaacggcgacgtggtccggatcctgagcaccaggagcaagcccgacctggtggagaccttgaggcgctacaaggagatccacggcaggcgcctcgaggaggatctcagcggccgcggcagggaggagacgacgaccctgctgctggaggccgtgctgtgcctcaccgcgccggccaagtacttcagccaggtgatggaggtggcgctgcgggagggggcggacgagcacgagaaggacgccctgacgcgggtggcggtgacgcggtcggagcacgacatggacgagatcagggcggcctacgaggagcagttcggggccaagctggaggacgccatcgcggccagggcgcacggccactacagggacgcgctgctctcgctggtgatgggcgcgcaccaccaccaccagtgaacgtacgtcaaccagctagcgctgcgctagctttctcttctcttcggtcgtctgcccgtgtccgtccgttcattcaatcgtggcgtccgtgtgtgtcgtgtgtgcgtgtgccaatgttggtctgttgcccatggagcctgtaacattttcctgatgactaggtagcaagtgagccgcctggtcaagagcccgatcaaagatactaccgcggcagcggcctctttagaaaaaaaagatcaccaggaaag

SEQ ID NO: 19148 - protein, 327 aa, Panicum virgatum
  misc_feature: Ceres CLONE 1804289
  misc_feature (251)..(318): Pfam Name: Annexin Pfam Description: Annexin
  misc_feature (171)..(245): Pfam Name: Annexin Pfam Description: Annexin
MADEVQHLTRAFSGLGGLGVDEPAMVSALARWRGQPEKRSGFRKGFPGFFSSHGEMERCEEEYMLRLAAEFARLKNLVVLWAMHPWERDARLAHHVLHQHHPAAIVVEVACTRSADELLGARRAYQALYHHSLEEDVAYRARDKPYCNLLVGLVSAYRYEGPRVNEEAARAEAEALGAAVKSAAGGKLLAENGDVVRILSTRSKPDLVETLRRYKEIHGRRLEEDLSGRGREETTTLLLEAVLCLTAPAKYFSQVMEVALREGADEHEKDALTRVAVTRSEHDMDEIRAAYEEQFGAKLEDAIAARAHGHYRDALLSLVMGAHHHHQ

SEQ ID NO: 19149 - DNA, 964 bp, Panicum virgatum
  misc_feature: Ceres CLONE 1804302
  misc_feature: Encodes the peptide sequence at SEQ ID NO. 19150
ggggagagaaaaaaaggaacgcagcttcagccatggcgcagcagctgctgctgctcctgcccgcgccatccagagccttctcgaagcccctcccctcccaatcccccacgctcgcctccctctcccttcgccaccacgtctccgtctccgccgccgcccggcgcggcctgctccgatgcgggatgaagcgttcaggcttggtggcggagctggagattgctaaggataagcagccgcagagcaggcgcgccaatggcatcttctggatcttgctgctcaatttcggcatctacgtggccgaccatttgttccagattcgggaaataaaatcactgtacctgtatcatgcactccctacatggtatcagtttgtgacatcaacattttgccatgccaactggaatcatctttcaagcaatctcttctttgtgtatatctttggaaagcttgtggaggaggaggaaggtaactttgctttgtggatgtcttacattttgactggtgccggggcaaacttgatttcgtggttggttctcccgacatcctctgtgtcacttggagcatctggtgctgtttttggccttttcaccattagtgttctagttaagatgtcatgggactggagaaagatccttgaggtgcttatcctggggcaatttgttgttgacaaggtcatggaagcagcacgagcaacaacaatcatgggtcaatcatttcaagtaaacaacattgctcatgtgtcaggtgctttcgtaggtgcagcattggtgttcctggtcagcagaatccacttttcatccaacgatgatagccccaagacaacaaaagagagtaaatagggaaaaaagtttatcaactaacatcatattatcattcattacatttctttatatgataacttgacattgttctaaaaattcagttatgacatttctgatttaaatgaaagatcatctaaaaattc

SEQ ID NO: 19150 - protein, 268 aa, Panicum virgatum
  misc_feature: Ceres CLONE 1804302
  misc_feature (104)..(254): Pfam Name: Rhomboid Pfam Description: Rhomboid family
  misc_feature: SWISSPROT Homolog: EC 3.4.21.105 Rhomboid protease
MAQQLLLLLPAPSRAFSKPLPSQSPTLASLSLRHHVSVSAAARRGLLRCGMKRSGLVAELEIAKDKQPQSRRANGIFWILLLNFGIYVADHLFQIREIKSLYLYHALPTWYQFVTSTFCHANWNHLSSNLFFVYIFGKLVEEEEGNFALWMSYILTGAGANLISWLVLPTSSVSLGASGAVFGLFTISVLVKMSWDWRKILEVLILGQFVVDKVMEAARATTIMGQSFQVNNIAHVSGAFVGAALVFLVSRIHFSSNDDSPKTTKESK

SEQ ID NO: 19151 - DNA, 1485 bp, Panicum virgatum
  misc_feature: Ceres CLONE 1804309
  misc_feature: Encodes the peptide sequence at SEQ ID NO. 19152
attgccatcctcagtccctctccctcctctctagtctctctctctctctctctctttttgaagagaatctctctctctccccaccaccaccaccaccacccctcacaagaagaagcagaaggccatggagctggacgagcaggccttcctggaggagatcctctccctgcggagggatgcctgggactgcaatgccatgggcgacttcttctccccggcggccgccatggactgctccttccaggaccgccaccagccgccgcccaccgtcagcgtcctccccaccttcacggcctcctacgaccagccgcagcctcagccgcaccccgggttcgactgcctcagcgaggtctacggcgccgccgccgcgttcggggggcccaatgccgacgactacggcgccgagatggggtttcttgacgtcatcgagcccaaggcgccgctaggggagggcggcctcggggtctgcaaggtggagcccggcctcgcggagggcggcggcgcgttcggcgccggcgccgcgccgccggccccggcgtccaagaagaagcgggtggagggcatgccgtccaagaacctgatggccgagcgccgccgccgcaagcgcctcaacgaccgcctctccatgctgcgctccgtcgtgcccaagatcagcaagatggacaggacatcgatcctgggcgacacgatcgactacatgaaggaactgctggagaggatcaagctgctgcaggaggagatcgacgagcagcagcaggagacgccgggcgtgctgagcgtgttccgggagctcaaccccaacgagatggtggccaggaacacccccaagttcgacgtggagcgcaaggagagcggcgagacccgggtggagatctactgtgccgccaagcccgggctgctgctgtcgacggtaagcaccctggagaacctgggcctcgacatccagcagtgcgtcgtcagctgcttcaacgacttcggcatgcacgcctcctgctctgagatgcagagggagaggatcagcgcggacgcgttaaagcaggagctgttcaagaacgccggctacggcggaggctgcttgtagagggggagatggctgggccggaggaagacgaagatgaaacccgagcaggcagcaataaatttaaattaagcttaagcagtagcggtggtagcagcagcagtagttgcagtgagtagcggaaaaggcaggcaggcaggcaggctgaggcaaagatttgggaggcctttttgcaatccatctccccatcataaccaaccatgttgtgtaccaaagcatgtcctacaactaccagcagcagcatatgctgatatgcagatgcaaagtgctgtggtgaatcttctcctactatttaacaagagcaaagctcgctgcctttccgcggctgcctccgagaagctttgtatcttctttctttttggatcaaaaacccggagctgaatgtcataaggcaatttacctgacgc

SEQ ID NO: 19152 - protein, 318 aa, Panicum virgatum
  misc_feature: Ceres CLONE 1804309
  misc_feature (149)..(196): Pfam Name: HLH Pfam Description: Helix-loop-helix DNA-binding domain
MELDEQAFLEEILSLRRDAWDCNAMGDFFSPAAAMDCSFQDRHQPPPTVSVLPTFTASYDQPQPQPHPGFDCLSEVYGAAAAFGGPNADDYGAEMGFLDVIEPKAPLGEGGLGVCKVEPGLAEGGGAFGAGAAPPAPASKKKRVEGMPSKNLMAERRRRKRLNDRLSMLRSVVPKISKMDRTSILGDTIDYMKELLERIKLLQEEIDEQQQETPGVLSVFRELNPNEMVARNTPKFDVERKESGETRVEIYCAAKPGLLLSTVSTLENLGLDIQQCVVSCFNDFGMHASCSEMQRERISADALKQELFKNAGYGGGCL

SEQ ID NO: 19153 - DNA, 966 bp, Panicum virgatum
  misc_feature: Ceres CLONE 1804337
  misc_feature: Encodes the peptide sequence at SEQ ID NO. 19154
atccattcagagctctcgcttcgaaaccgaaccagctcactctacccagctgccgtttctagagaatcccctgcgtttcgagatcccgctcgcaacgatgcctgccctcgccaagcccgcctcgcgccccgccaagaccaccgcggcgccgaagccgaagcccgccgccgccaagcccaaggccgcggccgccgccggcgcctcccacccgccctacttcgagatgatcaaggaggcgatctcggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcctacaagctctccgacgctgccaagaaggagccccccaaggccaagcccgcagccgccaagaccgtcacggccaagccggccaaggccgccgcgaagccgaagaagagcgccgccgccgcgaagccgaagaagaccgcggcggccgccgccgggaccaagcgcaaggcgccggagwagaaggtcgtggcgaagccgaagaagtcccccgcggcgaaggccaaggccaagcccaagactgtcaagtcccccgcctccaagaaggcccggaaggtcgccgcatgagatgtttccataggtcttagctatgattggggagtggttgtcccgtagcggagttgtgacaaatgaagatcgtttcccaagtgtctctgatccggtggggtgggaggttccccaagcgtctgtgatccggggttggggggcgttccccatgggtttcggatccggggtggtgttgggtcagttcaatctatccaggtcggggtcagggtaacagatgattaggttttttgtgatggagagatatctcggtatcttcaataggataggaacatgcagtttgccag

SEQ ID NO: 19154 - protein, 194 aa, Panicum virgatum
  misc_feature: Ceres CLONE 1804337
  misc_feature (36)..(106): Pfam Name: Linker_histone Pfam Description: linker histone H1 and H5 family
  misc_feature (160)..(160): Xaa is any aa, unknown, or other
MPALAKPASRPAKTTAAPKPKPAAAKPKAAAAAGASHPPYFEMIKEAISALKERTGSSSHAIAKYMEDKHGPSLPANYKKMLSIQLRGFAAKGKLVKVKASYKLSDAAKKEPPKAKPAAAKTVTAKPAKAAAKPKKSAAAAKPKKTAAAAAGTKRKAPEXKVVAKPKKSPAAKAKAKPKTVKSPASKKARKVAA

SEQ ID NO: 19155 - DNA, 701 bp, Panicum virgatum
  misc_feature: Ceres CLONE 1804338
  misc_feature: Encodes the peptide sequence at SEQ ID NO. 19156
gaccacacgtcgccacgccaccgcccgccccaaggacccttaccttgttcggccacgcgggccgtgcgccgctttgcctccgccatttccgcatttagaagctccccccgccgcagcccaggtagtttcttcttctttagccgcctgccaagatattattagtggtgtgatacatatttaagcagcggcaagtgaggcggggcggggatggcggcgggcggcggcgcggcggcgccgttcgtgtggaagacgtacatgatggtggaggatccagggacggacggggtcatcggctggggccgggggaacaacagcttcgtcgtcgccgaccccttcgtcttctcgcagacgctgctgcccgcgcacttcaagcacaacaacttctccagcttcgtgcgccagctcaacacctatggcttccgcaaggttgatccggaccggtgggagttcgcgcacgcgtcgttcctgcgcggccagacgcaccccctgcgcaacatcgtccgccgcggcagcagcgccgcgggaggaggcggcggcaagaggaaggacgccggctccgcggagccctccgcggacgacatggccatggtggccacggaggtggtgcgcctcaagcaggagcagcgcgccatcgacgaccgggtggcctccatgtggcgccgcgtgcaggagaccgagcgccggcccaagcagatgctcgc

SEQ ID NO: 19156 - protein, 164 aa, Panicum virgatum
  misc_feature: Ceres CLONE 1804338
  misc_feature (9)..(164): Pfam Name: HSF_DNA-bind Pfam Description: HSF-type DNA-binding
  misc_feature: Functional homolog of the protein sequence given in SEQ ID NO 50839
  misc_feature: Useful for making plants with modulated heat sensitivity
  misc_feature: The sequence is a functional homolog of SEQ ID NO 1233 in the 11/479,226 US patent application
  misc_feature: The sequence is a functional homolog of SEQ ID NO 144 in the 10/666,642 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1687 in the 10/412,699 US patent application
MAAGGGAAAPFVWKTYMMVEDPGTDGVIGWGRGNNSFVVADPFVFSQTLLPAHFKHNNFSSFVRQLNTYGFRKVDPDRWEFAHASFLRGQTHPLRNIVRRGSSAAGGGGGKRKDAGSAEPSADDMAMVATEVVRLKQEQRAIDDRVASMWRRVQETERRPKQML

SEQ ID NO: 19157 - DNA, 545 bp, Panicum virgatum
  misc_feature: Ceres CLONE 1804375
  misc_feature: Encodes the peptide sequence at SEQ ID NO. 19158
attaggcaattacctgcctgattcgctccgctccaaaaccgatggggcgtcgtccgcgccgccgtccacgccgaagggcaagtgccccctgaacacgctcaagctgctggcgtgcgtggacgcgctcaacgggctggtgcacgccgtggtcggcgccaaggccagcgagaagtgctgcccgctgctgcaaggcgtggccgacctcgacgccgcgctctgcctctgcaccaccatcaaggccaaggcgctcagcatcaacctcgtgctccccatcgccatcgaagtgctcgtcaacgagtgccacaagaacgtgcccgccagcttccagtgcccgtaatcaaactcaactcagcttccatgcatgctgggttaaggttatatggtatttgattgatgataaaccagtcaagcatttacatgcatatataatttgtttttataattgtgtatcaatattgtaacatgaaccagtgtgagagttgtggccttggggcttgtagtgactaaaaagatttatatatgaataaagcgtgtgtgtcatatat

SEQ ID NO: 19158 - protein, 111 aa, Panicum virgatum
  misc_feature: Ceres CLONE 1804375
  misc_feature (28)..(110): Pfam Name: Tryp_alpha_amyl Pfam Description: Protease inhibitor/seed storage/LTP family
  misc_feature: Functional homolog of the protein sequence given in SEQ ID NO 50191
  misc_feature: Useful for making plants with modulated salt sensitivity
LGNYLPDSLRSKTDGASSAPPSTPKGKCPLNTLKLLACVDALNGLVHAVVGAKASEKCCPLLQGVADLDAALCLCTTIKAKALSINLVLPIAIEVLVNECHKNVPASFQCP

SEQ ID NO: 19159 - DNA, 460 bp, Panicum virgatum
  misc_feature: Ceres CLONE 1804399
  misc_feature: Encodes the peptide sequence at SEQ ID NO. 19160
actcggcgcccgcacccgacaacgcacgcgcccgcaccaccatggccggcgctggcctcgccgtctccatccccatgcaaaatgatagatccagttgttggcaagctctcgaaggacaacgaggggaagctgaaatgctacaagctcaacacagatgagagcccggacatagcaagccagtccggggtccggagcatccccaccatgatgatattcaagaacggcgagaagaaggattcggtgatcggggctgtgcctgagagcacactgaccgcatgcatcgataaatttgtggagaggtgaaatgcccagcggatctcttgaaagcggctgcctttcaaaagcctgtgttcagatcagtggacccgtacgcagaaacagttctatatacctggttgtagatatcggaatcacattcgattattgtttgatgaaggcggcatgagttgctttccgcccc

SEQ ID NO: 19160 - protein, 100 aa, Panicum virgatum
  misc_feature: Ceres CLONE 1804399
  misc_feature (5)..(97): Pfam Name: Thioredoxin Pfam Description: Thioredoxin
  misc_feature: SWISSPROT Homolog: EC 1.8.1.8 Protein-disulfide reductase
  misc_feature: Functional homolog of the protein sequence given in SEQ ID NO 50158
  misc_feature: Useful for making plants with modulated heat sensitivity
TRRPHPTTHAPAPPWPALASPSPSPCKMIDPVVGKLSKDNEGKLKCYKLNTDESPDIASQSGVRSIPTMMIFKNGEKKDSVIGAVPESTLTACIDKFVER

SEQ ID NO: 19161 - DNA, 476 bp, Panicum virgatum
  misc_feature: Ceres CLONE 1804405
  misc_feature: Encodes the peptide sequence at SEQ ID NO. 19162
agtacaggaagcacaagaaagccacttctagccatcaacaacgacttcttcttcaccatcatcgtcacctaactcagacagcatcgatcgatccgcaggtattagcgactgaagaagaagaagatgagctcctccgcggaaccagctgtgtgcggcggcggcggcaagatcacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtttgaataataatggatgtgtgttctttccctataaatcaaataaataagcaagggatgtgtg

SEQ ID NO: 19162 - protein, 75 aa, Panicum virgatum
  misc_feature: Ceres CLONE 1804405
  misc_feature (17)..(75): Pfam Name: potato_inhibit Pfam Description: Potato inhibitor I family
MSSSAEPAVCGGGGKITSWPEVVGMSIEEAKKVILKDKPDADIQVLPVGTPVTKDFRPNRVRIFVNTVAETPHVG

SEQ ID NO: 19163 - DNA, 1353 bp, Panicum virgatum
  misc_feature: Ceres CLONE 1804449
  misc_feature: Encodes the peptide sequence at SEQ ID NO. 19164
gtttttctggaggcttcctgggggtgcgtggagacagagggagagggggaagaacgaagaagaacaggcgccatccgcttgcttccttccccttctctccctcccccaccgccggcgcctctttccgcgggtcctcgccgacagggcatcgcgtcgctgtacccgtgagtgcgtgccggaggaatttgacttctccggcgacaacggcatggatgccggggcagagaagtgccgcgacgccgcggcggcggccggggaggccggcagcgacctctacgcggtccttgggctcaagaaggagtgctccgacaccgagctgaaggtcgcctaccggaagctcgccatgagatggcacccagacaaatgctcctcctccagcagcgtgaagcacctgcaggaagccaaggagaagttccaagagatccagagcgcctattccgtcctctccgacgctaacaagcggttcctctacgacgtgggtgtatatgacaatgaggccgacgaggacagtctgcagggaatgggggacttcattggtgagatggcccagatgatgagccaggcgcgtccgacggcttaaaaaagaaggaattgttatcaaagctccgtgtcctgcatggtttttagtggatactaaaagctgaatttttagaggcaggaaagctttgaggagctgcaacagctgttcgtggacatgttccagtccgatcttgattcaggattctgcaatgggcctgccaagggccatcaggtgcatgggcaagcccaaagtagaacatcctcaacctcgccttcatcatcaccatctcctcctccgcctactgtagtaacggaggtagaggtgccatcatgtaatggcttcaataagcggggttcatcagcaatggactcggggaaacctccaagaccacttgatgctggtgtgagtcagagccaggctggcttttgttttgggatgagcgacacaaagcaagctcagaagatgcgaggcccaaacaccagccggaggaggaacggccggaagcagaagttgtcatcgaagcatgatgtttcatccgaagatgacaccgcaggttctcagcaccagcagcatgtagcagtttgatccttggtgtagttattcgttggtccttggcagtgtcaaggaccctagtgtagccagggcactgggcacagcatgctgcctttgccagctgctgtgatctgaagaggagtttagctcatcataggccttgagacctccatgtgaaacacgtcgatgcttctgcaattttctttctccgcatgtgttgccacttgccagcgttgtaccaagacagtgatttccaattgattcagttcttattgacatcc

SEQ ID NO: 19164 - protein, 123 aa, Panicum virgatum
  misc_feature: Ceres CLONE 1804449
  misc_feature (21)..(89): Pfam Name: DnaJ Pfam Description: DnaJ domain
  misc_feature: Functional homolog of the protein sequence given in SEQ ID NO 50840
  misc_feature: Useful for making plants with modulated nitrogen use efficiency
MDAGAEKCRDAAAAAGEAGSDLYAVLGLKKECSDTELKVAYRKLAMRWHPDKCSSSSSVKHLQEAKEKFQEIQSAYSVLSDANKRFLYDVGVYDNEADEDSLQGMGDFIGEMAQMMSQARPTA

SEQ ID NO: 19165 - DNA, 863 bp, Panicum virgatum
  misc_feature: Ceres CLONE 1804455
  misc_feature: Encodes the peptide sequence at SEQ ID NO. 19166
gaaacatcacccaaatccaaagcaaacggaaaaacactcgctcacctagtcacctgtctgtccatcgctctagctcagctcccagtcagtgatagctgcaagcgacagcgcagccagcgccaccaagagctgggaggaaggttgtagaagatggggaagctctggacgatcctcactcacctccactcccttgcagggccaacggtcatgctcctgtaccccctgtacgcgtcggtgcaggcgatggagagcctgtccaagcttgacgacgagcagtggctcgcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgataagttcgtcagggagcagctcaggaagcacggcctctccgccggcggcggctccagcggcaaggtcaagaaggacgacaagtcgccctygtcttctcccaaggacaaggagaagcccaagagcaagtttctcgccttcgtcacccccaagaaggatcaggaaggtttctgaaacaggccgcagggtgcggtgacatgatcccggcggcttgtcgatgcagagcctatagtgtttctagtgtccaggagcgtttgttcatgcttgtcactggaaatagagcggtttgatgtatttggggatcttgcgtttgaacatatcgctgatatattgaatggagacgagagcaaactttctgtgttgatcatgtgaatgtgactggagagatctgacaaaaagtcaatacaatgttctgggacaggctttccagtctc

SEQ ID NO: 19166 - protein, 150 aa, Panicum virgatum
  misc_feature: Ceres CLONE 1804455
  misc_feature (4)..(101): Pfam Name: TB2_DP1_HVA22 Pfam Description: TB2/DP1, HVA22 family
  misc_feature (124)..(124): Xaa is any aa, unknown, or other
MGKLWTILTHLHSLAGPTVMLLYPLYASVQAMESLSKLDDEQWLAYWILYSFITLMEMVLESLIYWIPIWYELKLLFIAWLVLPNFRGAAFIYDKFVREQLRKHGLSAGGGSSGKVKKDDKSPXSSPKDKEKPKSKFLAFVTPKKDQEGF

SEQ ID NO: 19167 - DNA, 718 bp, Panicum virgatum
  misc_feature: Ceres CLONE 1804471
  misc_feature: Encodes the peptide sequence at SEQ ID NO. 19168
attcataggctggtgttggtgatctcagatcgcagctccattccttctcctcccctgcacagactggtcctttaatttgaagcaacaaggagagaaagatgtccagtgtttggaagaccaaggttctgcctggcctcaacaagttctttgacaaggatggcaagaaggcggcggcggctgagttcttgaagtccttcaacaaggaggagattggcaaggagattgaggacaagaagacagagctggagcccaaggttgtggaggcttatgaagcatctcctcctgaagttaaggctcttttcaaggacaagaaaccagtcaagatcaccaagaagaactcggctgcagcaaccaagttcctcgacgagctggctaagattgagttccctggagccaagctggtgagcgacgcggtggccaagtccggcaccacgcccctctccccggcgatcaccttcatcttggacaaggttgcgccgttcatccccaaggaggagcccaaggccgagccggaggccacctcccgggaagtcgccgtggaggagaagaaggaggaggccgagccggcggccgctgcggctccggaggaggctgctgcgccggcggaggcggtagwggagaagaaggctgaggaggagaagccagcggaagaagaagatgaggggggggaggggccaccagcctgaggaggagaagaagtgatctgatcagcggtggt

SEQ ID NO: 19168 - protein, 195 aa, Panicum virgatum
  misc_feature: Ceres CLONE 1804471
  misc_feature (2)..(195): Pfam Name: DREPP Pfam Description: DREPP plasma membrane polypeptide
  misc_feature (173)..(173): Xaa is any aa, unknown, or other
MSSVWKTKVLPGLNKFFDKDGKKAAAAEFLKSFNKEEIGKEIEDKKTELEPKVVEAYEASPPEVKALFKDKKPVKITKKNSAAATKFLDELAKIEFPGAKLVSDAVAKSGTTPLSPAITFILDKVAPFIPKEEPKAEPEATSREVAVEEKKEEAEPAAAAAPEEAAAPAEAVXEKKAEEEKPAEEEDEGGEGPPA

SEQ ID NO: 19169 - DNA, 499 bp, Panicum virgatum
  misc_feature: Ceres CLONE 1804477
  misc_feature: Encodes the peptide sequence at SEQ ID NO. 19170
ggtagccgccggttcacttctccaggaaagggttggtcctcatggcgccgccgcagcccaagtcgggcctcttcgtgggcatcaacaagggccatgtcgtcaccaagcgcgagctgccgctgcgcccgtcccaccgcaaagggaaagcaacgaagcgggtgaccatggtcaggggcctgatcagggaggttgctgggttcgctccttatgagaagcgtatcactgagcttctgaaggttggcaaggacaagcgtgctctgaaggttgctaaaagaaagctcggaactcacaagagggcaaagaagaagagagaggagatggccaatgtcctcaggaagatgagatctgctggtacccacactgataagaagaaatagagcatctcaagtacgtgaagctggcggcaacattgtcctgtgtcggtttcccctacctgtagaacctaatagacttgtcaaagtacctgccagcaaaacattgtgttgttagttatgtgttg

SEQ ID NO: 19170 - protein, 111 aa, Panicum virgatum
  misc_feature: Ceres CLONE 1804477
  misc_feature (5)..(103): Pfam Name: Ribosomal_L36e Pfam Description: Ribosomal protein L36e
MAPPQPKSGLFVGINKGHVVTKRELPLRPSHRKGKATKRVTMVRGLIREVAGFAPYEKRITELLKVGKDKRALKVAKRKLGTHKRAKKKREEMANVLRKMRSAGTHTDKKK

SEQ ID NO: 19171 - DNA, 546 bp, Panicum virgatum
  misc_feature: Ceres CLONE 1804543
  misc_feature: Encodes the peptide sequence at SEQ ID NO. 19172
gtcccagtcgcaccaccccccaccaggccagagctcgcgcgcgcacacgcatacacaccgtgcccctcggcgccgccagagcagagtctgtgcttcgagctactagcaagtcatcaagccctctcggcctctcacggtcccgatggctccacgcgccgtcgccgtcgccgccgccgtgctgctcctcgccgcggccgtgctcgtcgtttccgcgtcggcgcaggagttcaccgcggcgccgtcgtccgagcccgcgcccgcgccggtcgccggggcggcgtctgctccggccgtggccgtggccgtggggtcgtccgcgctggtggccctgctcgtggccgcgctgatgcgataggatcgtgctttctcttgcagatttgagcgggcggcttcttgagagtcgtatcgtgcgaggccttgatgctattcgttattcttttctgtaccatacatatatagttgtactatgtaaactctgtgccttacatacatatgtacgaataaagttggatgaccttgtcgtccccttctatgaaaattcttcag

SEQ ID NO: 19172 - protein, 70 aa, Panicum virgatum
  misc_feature: Ceres CLONE 1804543
  misc_feature: Functional homolog of the protein sequence given in SEQ ID NO 50208
  misc_feature: Useful for making plants with altered carbohydrate content
MAPRAVAVAAAVLLLAAAVLVVSASAQEFTAAPSSEPAPAPVAGAASAPAVAVAVGSSALVALLVAALMR

SEQ ID NO: 19173 - DNA, 905 bp, Panicum virgatum
  misc_feature: Ceres CLONE 1804573
  misc_feature: Encodes the peptide sequence at SEQ ID NO. 19174
ctctctgcccccctagcgcgcggagcacgagcccttggtagatcccgatggcctcgcgacggcgcacgctcctcaaggtcatcatcctcggcgacagcggggtcgggaagacttcgctgatgaaccaatatgtgaacaagaagttcagcaatcagtacaaggctacgatcggcgccgatttcctcaccaaggaggtccagttcgaggacaggctcttcactcttcagatatgggatactgctggacaggaaaggtttcagagtcttggtgttgcattctatcgtggagctgattgttgtgttctagtttatgatgttaactctatgaagtcatttgataatctgaacaactggcgtgaagaatttctaattcaggctagcccatctgatcccgataacttcccttttgttctgcttggaaacaaagttgatattgatggtggcaacagccgtgtggtctctgagaaaaaggcaaaggcttggtgtgcctcaaaaggcaacataccttactttgagacatctgcaaaagaaggaactaatgtggaagatgcttttcaatgcatggtaaaaaatgccctaaagaatgaacctgaagaagaattgtacgtgcctgacactgtcgatgtggtgggtggcaatcggacccaaaggtcatcaagctgctgttagttgatggtctttggagtgccacatcaattattcattatacagtcatgagctcgtgtataaagtcaaccttctgtatgtgataattgaccttaatcgatcacccgttatgtatgaaatcaataattcttgcatatgttttcatatggtaactttacttgatgtgcaggttatcaaggtatttatcatgcaggagaatgcactgtgaataatatatttacataccactaggggcagttt

SEQ ID NO: 19174 - protein, 206 aa, Panicum virgatum
  misc_feature: Ceres CLONE 1804573
  misc_feature (10)..(178): Pfam Name: Ras Pfam Description: Ras family
  misc_feature (10)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50193
  misc_feature: Useful for making plants with modulated water use efficiency
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDIDGGNSRVVSEKKAKAWCASKGNIPYFETSAKEGTNVEDAFQCMVKNALKNEPEEELYVPDTVDVVGGNRTQRSSSCC

SEQ ID NO: 19175 - DNA, 469 bp, Panicum virgatum
  misc_feature: Ceres CLONE 1804596
  misc_feature: Encodes the peptide sequence at SEQ ID NO. 19176
tgtggagaaaactgaaggatattctggctctgatattcgccttgtgtgcaaggaggcagcaatgcagcccctaagacggttaatgacagttctggaacgcaaccaagaagaggtccctgaggatgagttgcctgaagtcggtccgataacgtcagaagatattgaacttgctttaaggaatacaaggccgtctgctcatcttcatgcacacagatatgaaaagttcaaccaagattatggcagccatgtccatggctgaaggagtctgttgtaagatatttgtactcagtatggaactcgtgcatgggctgttagatcaatgttgagtttccatagatgagatgaaggtatccttgtaaacacactgcttatgtttgtatcctgtacattatcattcatttgacaagtaataagctcttgggtaatagtttagcctcaccgggaataagcagaaactagggttctacct

SEQ ID NO: 19176 - protein, 85 aa, Panicum virgatum
  misc_feature: Ceres CLONE 1804596
  misc_feature: SWISSPROT Homolog: EC 3.6.4.3 Microtubule-severing ATPase
VEKTEGYSGSDIRLVCKEAAMQPLRRLMTVLERNQEEVPEDELPEVGPITSEDIELALRNTRPSAHLHAHRYEKFNQDYGSHVHG

SEQ ID NO: 19177 - DNA, 505 bp, Panicum virgatum
  misc_feature: Ceres CLONE 1804606
  misc_feature: Encodes the peptide sequence at SEQ ID NO. 19178
atgctgtatttaggagagaggagaaaggaaaaaccgagctctaatctccctccccgacggagatcgcctgctcctggagcaaccaccgctccttcccgcaccggcgcggacgccactcccgccagttcttgtgctaggatctgtgccgtggggcgtcaaacagctcgcagatggacggtggcgggggcgacctgcggagcactatcaagaagtggaacgtcttatacccggtctacctcaactccaagaagacggttgctgaaggccgccgcatcgccgccagcaaggcctgccctgaccccacctgcatcgagatagccgactgctgctcgcacctcaagatcccccacgccattgagcttgataaggcgtaccctcgggatttcttccaggtggggagggtcagggtgcagctcaagaaggatgacggctcccctgtcaatcctgctattaaaacaagaagcagctgatgatccaatagcagagctagttcccaagcatcatg

SEQ ID NO: 19178 - protein, 99 aa, Panicum virgatum
  misc_feature: Ceres CLONE 1804606
  misc_feature (16)..(89): Pfam Name: SRP19 Pfam Description: SRP19 protein
MDGGGGDLRSTIKKWNVLYPVYLNSKKTVAEGRRIAASKACPDPTCIEIADCCSHLKIPHAIELDKAYPRDFFQVGRVRVQLKKDDGSPVNPAIKTRSS

SEQ ID NO: 19179 - DNA, 265 bp, Panicum virgatum
  misc_feature: Ceres CLONE 1804606-R
tgattgaagtagcagaggtggttttcagccatcgtggtaggggagagaagctggaatgggcattcgagctcttcagtttgggggcagtttgaggaactcaaaaggtggaaaaaagaataagtgagggcagtataatctcacatttttgattccatcccaagaataagttgaagtggaattgtccttggggggcgaagaaatcatggtgacttctgggattgtgattctttgtaaaatttccatacacatctttcttttattatcc

SEQ ID NO: 19180 - DNA, 1204 bp, Panicum virgatum
  misc_feature: Ceres CLONE 1804627
  misc_feature: Encodes the peptide sequence at SEQ ID NO. 19181
atccgaaagccaaagcgagtctcaccagtcaaagagcgagttctagtagctttgctgatctgttctgctgtttttagtttggaaagcctttagttccggcgatcatggaggacgagaggaacacccagcaccaccaggtcggcgaggcccaggagaaggccgccgatcaggtggaggtgaaggacagggggctcctggacacccttctcggcaggaagaagcccgaggaacaccaggaggaggagctggtgaccggcatggagaaggtcacggtggccgagcctcagaagcacggcgagcacaagaaggaggagcacgagaccggggagaagaaggagagcctcctcgccaagttgcaccgcaccagctccagctccagctcgtcgagcgacgaggaagaggaggtgatcgacgagaacggagagattgtcaagaggaagaagaagaagggcctcaaggagaagatcaaggagaagctacccggccacaaggaccacgccgagggcgaccaccacacggccgtgccggccccggcgcccgcgcccatgggaacgcacgcttacaaggaggacgagcacaagccgtacgtgccggccccggctcccccgcccgcggtggagacgcacgtccaccaccacgaccacgccgtcgtcgtccagaaggtcgaggacgactccccgccggcgccggaggaggagaagaagggcctccttgacaagatcaaggagaagctccccggcggccacaagaagccggaggacgccgccgccgccgccgcgcccgctgtccacgcgccagcgccggcgccgcacgcagaggacgtgagcagcccggacggcaaggagaagaagggcctgctgggcaagatcatggacaagatacccggctacaacaagggctccggcgaggaggaccacaaggccgccgccggcgagcacaagaccagctcttcttaagatggcccgcgcgtcgtgaccttgatcggaagcgtttgtttgccgtgcgtttggttctgctttgctttattaagtttgtttcaagatgggattgcgcggtcaaggcccggctttagtttggttccgagtcggggactggaagttgttgggtttgttgaattattatcagcagttgcgtcggtattgtaattcggctgggctacctggggattatgccttaacatttatatctttggtttctgcctagc

SEQ ID NO: 19181 - protein, 283 aa, Panicum virgatum
  misc_feature: Ceres CLONE 1804627
  misc_feature (39)..(278): Pfam Name: Dehydrin Pfam Description: Dehydrin
MEDERNTQHHQVGEAQEKAADQVEVKDRGLLDTLLGRKKPEEHQEEELVTGMEKVTVAEPQKHGEHKKEEHETGEKKESLLAKLHRTSSSSSSSSDEEEEVIDENGEIVKRKKKKGLKEKIKEKLPGHKDHAEGDHHTAVPAPAPAPMGTHAYKEDEHKPYVPAPAPPPAVETHVHHHDHAVVVQKVEDDSPPAPEEEKKGLLDKIKEKLPGGHKKPEDAAAAAAPAVHAPAPAPHAEDVSSPDGKEKKGLLGKIMDKIPGYNKGSGEEDHKAAAGEHKTSSS

SEQ ID NO: 19182 - DNA, 256 bp, Panicum virgatum
  misc_feature: Ceres CLONE 1804630
  misc_feature: Encodes the peptide sequence at SEQ ID NO. 19183
gccgctccggtcggcgctgtcgggtgctttatcgctagcccccccgctcctgatccggatgatatcaaccccgccctcctgttgatcacacctgatctcgtcgcggggtgtatggctgactccctcgccgcgggcgggcaggggacaaccaaggcggatgtcgagaacttcccgggctacaccgacggtaacatcggcccagaacacctggaacgctgccgcgcggagtttctcctctacggcactgaaatcggtt

SEQ ID NO: 19183 - protein, 85 aa, Panicum virgatum
  misc_feature: Ceres CLONE 1804630
  misc_feature: SWISSPROT Homolog: EC 1.8.1.9 Thioredoxin-disulfide reductase
AAPVGAVGCFIASPPAPDPDDINPALLLITPDLVAGCMADSLAAGGQGTTKADVENFPGYTDGNIGPEHLERCRAEFLLYGTEIG

SEQ ID NO: 19184 - DNA, 198 bp, Panicum virgatum
  misc_feature: Ceres CLONE 1804630-R
gctccacccccatcagtgagaagggggtttaggaatctgttcacgtgcaggcctagaagcctccccccaccataaattctgccggatcagccccaaaaaaagctggggcccctcagcaccttctgcacgccatctgttggccacgagggcaaatccggtcgcctatttttcggtgttccaacccccacccaatcacaa

SEQ ID NO: 19185 - DNA, 1523 bp, Panicum virgatum
  misc_feature: Ceres CLONE 1804638
  misc_feature: Encodes the peptide sequence at SEQ ID NO. 19186
ggcggacagatgaccgaacgaaaaccgcacaaatgctgtggagagctgctggcgtgccaaatatccatcaaaacgtgtgatcgccgtcagcatctgcaatactacgccattcccttcccaaaaaaaagtatctatagaccattaccctaagcgctctcctttcgctcgagcgtgcagggaagggtcacggagatggagagcgctatccccaatccccccaacgcaaggtacgtgccatacctccacgctgcgttcttaatcgcgtggcggttttatttccttttaaactaatttaatctgggatttgaaaataacctaccacagattttttttagtgattcatggccgctaactaacacggatagcatactgctcgagcgggtttgaaccttgacaggatcgcggtggtcaccggcgggaacaaagggatcgggctggaggtgtgccggcagctcgccggcgccggcgtcaccgtcgtcttgacggccagggacgagacgaggggcgcagccgccgtggagaagctcagagaagcagggctctccgatgtcattttccatcagctggagatcaccgatgccccgagcatcgctaggttggctgatttcttgaaggcccgttttgggaagctagatatccttataaataatgctgcaatccttggggttgaatacctcctagatccttcactgaccagcgaggaaaagttcagtggcatggataagggtcagaggcttgagtggctgaccagtggtgtccgggggacctacgacgctgccagagagggcctgcagacaaactactacggcaccaagcatgtcatcgaagccttactgccgctgctgcaagcttcttccgatgggagaatcgttaatgtctcatccgaatggggcctaaggctaatcaccaacgaggagctgaagcaggagctgaacgacgtcgagaagctcaccgaggcgaggctggacgaggtgctcgacgcgttcctgaacgacttcaaggctggggagctgggggcgcgcgggtggccggagcatttctcggcgtacaaggtgtccaaggtgaccatgaacgcctactcgaggatcctggcgaggcggcaccccgagctgcgcgtcaactgcgcgcatcccggctacgtgaacaccgacatgagcatccactccgggcccctgacgcccgaggagggcgcggccaacgtggtgaaggtggcgctgctgccggagggcggggtcaccggcgccttctttgcagacggcgaggaggcgccgttcgtgtgacgctcacactacacacgcggcctacacgagcacggccgatcggcagttcggcactggccctgtcgttcgccgttctactccaactgccttgtatcaacgtgcagtgaagattattagctgctggatctttagttcctctgtccatggtgtcgaagtccaaaattgttggcacacgctggtattttaatttgtccacggaagtgtacttgttactttgaattactcattcacggaagatgtgtc

SEQ ID NO: 19186 - protein, 187 aa, Panicum virgatum
  misc_feature: Ceres CLONE 1804638
  misc_feature: SWISSPROT Homolog: EC 1.1.1.184 Carbonyl reductase (NADPH)
MDKGQRLEWLTSGVRGTYDAAREGLQTNYYGTKHVIEALLPLLQASSDGRIVNVSSEWGLRLITNEELKQELNDVEKLTEARLDEVLDAFLNDFKAGELGARGWPEHFSAYKVSKVTMNAYSRILARRHPELRVNCAHPGYVNTDMSIHSGPLTPEEGAANVVKVALLPEGGVTGAFFADGEEAPFV

SEQ ID NO: 19187 - DNA, 299 bp, Panicum virgatum
  misc_feature: Ceres CLONE 1804645
  misc_feature: Encodes the peptide sequence at SEQ ID NO. 19188
atctgataacatataggaggaagagagacatattggtagaatgtgtttgtgttacacctttgcagttgcaatggggatcgtttaaagcctattgctatagatctcttattgatgggatggaacacattgccatggtgaagggtgatgttggcgatggccatgatatcctagtaagagtgcattcggaatgcctaactggggacatatttgatcctgcaatgtgcaactgtgggaatcaacttagcctgcccatgcacccatgattgacaacaccggctcgggccggagtagtttatctt

SEQ ID NO: 19188 - protein, 86 aa, Panicum virgatum
  misc_feature: Ceres CLONE 1804645
  misc_feature (12)..(84): Pfam Name: GTP_cyclohydro2 Pfam Description: GTP cyclohydrolase II
  misc_feature: SWISSPROT Homolog: EC 3.5.4.25 GTP cyclohydrolase II
LITYRRKRDILVECVCVTPLQLQWGSFKAYCYRSLIDGMEHIAMVKGDVGDGHDILVRVHSECLTGDIFDPAMCNCGNQLSLPMHP

SEQ ID NO: 19189 - DNA, 584 bp, Panicum virgatum
  misc_feature: Ceres CLONE 1804645-R
  misc_feature: Encodes the peptide sequence at SEQ ID NO. 19190
aacaaccctgcgaaatacactggactcaagggttatggtttaagtgtcttgggcagagtgccgttgcttacaccaataaccaatgagaatcggcgctatatggaaacgaagcgactaaagatggggcatgtttatggaacccaccctagtggtcatcatacaagtggtagtggcatgactgatggtggcacgaaaggggaggcagggcaagagcaaactccagaatcttaacagcatatatctgtgttacttctggcagtaaatagactcccaaattccattgcaatatcttctatctttcactgctgctcaagcttttggtcatatgagtcgcgtaagtcttgtctgtgttgctgacgttgatacccaaactaccctgtggtctgagggactcgtgcaagaattctcatggaaagtacgagtagaggatatgctttcttcggtacttttaatgcttttttattttagatttagaaaccgttgacgtattcagctgttggacgtttgtatgagcgtagtgacattgtttactgtaccgtagtgttcttctgaaatgaagttcgatgactgcagtatttggcacg

SEQ ID NO: 19190 - protein, 76 aa, Panicum virgatum
  misc_feature: Ceres CLONE 1804645-R
  misc_feature: SWISSPROT Homolog: EC 3.5.4.25 GTP cyclohydrolase II
NNPAKYTGLKGYGLSVLGRVPLLTPITNENRRYMETKRLKMGHVYGTHPSGHHTSGSGMTDGGTKGEAGQEQTPES

SEQ ID NO: 19191 - DNA, 1027 bp, Panicum virgatum
  misc_feature: Ceres CLONE 1804658
  misc_feature: Encodes the peptide sequence at SEQ ID NO. 19192
ttcttccttgcaacacggagacgctatccgttgctgctgcaggcagagatggccggagcagagcttgcaaacggcctgcacgagagcaccgtggccatggaggaaggcagacgaggaggaggtgagagctcggagcaggatgtggccgtcagccgccccatgttctccgtcccgttcgtgcagaagatcctggccgagatgttcgggacctacttcctgatcttcgccgggtgcgcggcggtggcggtgaacctgcgaacgggcggcacggtgacgttcccgggcatctgcatcgtgtggggcctcgccgtgatggtgatggtgtactcggtgggccacatctccggcgcgcacctcaaccccgccgtctccgtcgccttcgccacctgcggccgcttcccctggtggcaggtgccgtcgtacgcggcggcgcaggtgatgggcgccacggccgccagcctcacgctgcggctgctcttcgggaacgcgcgggagcacttcttcgggacggtgccggcggcgtcggacgcgcagtcgctcgtcatcgagttcatcatctccttcaacctcatgttcgtcgtctccggcgtcgccacggacaacagagccattggtgaactcgctggcctcgccgttggagctaccgtcctgctaaacgtcctcttcgcagggcctatttcaggagcgtccatgaacccggcgaggaccctgggcccggcgatcgtcgccggccgctacgccggcatctgggtgtacttcgccgggcccatcgtggggacggtggccggcgcgtgggcctacaacctcatccgcttcaccgacaagccgctgcgagagatcacccagacctcctccttcctgcgaagtgtcaggaggaactagcttagcactgaaaatagatacagttaacagtggctggtgtttgcacacggtatatgcttggcttgttagtttaacctctgaaagattgggtcacctaactgtggcaatttttccttgtggaggaagcagtaacctttctgacctc

SEQ ID NO: 19192 - protein, 277 aa, Panicum virgatum
  misc_feature: Ceres CLONE 1804658
  misc_feature (37)..(251): Pfam Name: MIP Pfam Description: Major intrinsic protein
MAGAELANGLHESTVAMEEGRRGGGESSEQDVAVSRPMFSVPFVQKILAEMFGTYFLIFAGCAAVAVNLRTGGTVTFPGICIVWGLAVMVMVYSVGHISGAHLNPAVSVAFATCGRFPWWQVPSYAAAQVMGATAASLTLRLLFGNAREHFFGTVPAASDAQSLVIEFIISFNLMFVVSGVATDNRAIGELAGLAVGATVLLNVLFAGPISGASMNPARTLGPAIVAGRYAGIWVYFAGPIVGTVAGAWAYNLIRFTDKPLREITQTSSFLRSVRRN

SEQ ID NO: 19193 - DNA, 1709 bp, Panicum virgatum
  misc_feature: Ceres CLONE 1804659
  misc_feature: Encodes the peptide sequence at SEQ ID NO. 19194
actcctcgtgccacctccgcctcttccttgtgatctccgaattcccatctcagattccaagggccccccgtgcgatcccccggctctccccgcccaccatatatccagaggctccgccccccgcctcgaacccctcgcgaaagtcgccgccatattgttctgatttgagccgggcggattgatcccggggagcggcgttgccgttcttgatcctaagagtggttcttggttggtttgcgggaggaaagaagtcatgataccttctgtgaagctctctcctgcccctggagccttttcaggcttcagcctgcgctcaaaatcagcttcaattccatccatctccagtttcaaaccctcaaaatacgtggtatcctccctgagaccactctaccttgcaccgctagatggtccgcgcactgccgagcttaagcctcggaggcagccacttgagttccggtgcgcagcttctgctgctgatgacaaggagtccaagactgaggtggtgccggtacagtcggaaggtgcacagaagctaaaaatctccatctatttcgcgacctggtgggcgctcaatgtgatatttaacatttacaacaagaaggttctcaacgcttttccatacccctggctcacctccacactctccctcgcctgtggctctgcaatgatgcttttctcatgggccacccgccttgttgaggcccccaagaccgacctagatttctggaaagttcttttcccggttgctgtggcacatacaattggccatgttgctgcaacggtcagcatgtctaaggtggcggtgtcattcacacacataattaaaagtgcagaacctgcgttcagtgttttggtgtcgaggttcctccttggagagacatttcctgttcctgtctatctttctcttcttccaatcattggtggatgtgctcttgctgctgtcacagagctgaattttaatatggttggatttctgggtgctatgatatccaaccttgcttttgttttccgcaacatcttctcaaagaggggcatgaaggggaagtccgtcagtggcatgaattactatgcttgcctgtcaataatgtcccttgtcatactgactccatttgctattgctatggaaggcccccaaatgtgggctgctggttggcaaaaggctcttgcagaagttggccccaatgttatctggtgggttgctgctcagagcgtgttctaccacttgtataaccaggtttcctacatgtctcttgatcagatttctccattgacgtttagcattggcaatacaatgaagcgtatatcagtgattgtttcgtcaatcataatcttccacacacctgtccgccctgtcaatgccctaggagctgccattgccatccttggcacattcctgtactctcaggcgaaggcatgaggttgaaactttggcaagatcagtgggccatggatgatgaacttctctgcagaatcagtggcaagcaatgaatccagttttgcttgtgcaagtatcatgtagatatagggttaggtttccatatgaggtctaataatggatgaatggctactgtttccctgtgccatgttgaccacaaaccgaaatccataggccatcaagtgtggttgagtgtatctgaataatactgtaacggaattcgccggcgctgtttctttctgggtatataatcggtcgttcaaatcccggtttc

SEQ ID NO: 19194 - protein, 387 aa, Panicum virgatum
  misc_feature: Ceres CLONE 1804659
  misc_feature (239)..(384): Pfam Name: TPT Pfam Description: Triose-phosphate Transporter family
MIPSVKLSPAPGAFSGFSLRSKSASIPSISSFKPSKYVVSSLRPLYLAPLDGPRTAELKPRRQPLEFRCAASAADDKESKTEVVPVQSEGAQKLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFLGAMISNLAFVFRNIFSKRGMKGKSVSGMNYYACLSIMSLVILTPFAIAMEGPQMWAAGWQKALAEVGPNVIWWVAAQSVFYHLYNQVSYMSLDQISPLTFSIGNTMKRISVIVSSIIIFHTPVRPVNALGAAIAILGTFLYSQAKA

SEQ ID NO: 19195 - DNA, 1228 bp, Panicum virgatum
  misc_feature: Ceres CLONE 1804663
  misc_feature: Encodes the peptide sequence at SEQ ID NO. 19196
ggagagaagaaaaaaaagctcttcaacccaacccgcaagaaaacttccccccgcaccagagcaagggagagacgaggagtcgacgagcccagaccccgagctccagcgcaacgccgccgccgcagccgccgccgatggatccgaagctgacggaggtgacccagatgttcgcccgcttcaaggcggcgtacgcccgcaacgacctcgacgcctgcgtcaccctcctctcacagctcaaggtccagctcaccaaattccccagccttccgccattgtttcagcagacacccaacgccgtggaggagctcaaacttgcacgggacatttatgagcatgcggttgttttgagcgtgaaacttgaggaccaagatgcttttgaacgcgatttctgccagctcaagccttattatatggatatatgtggcataattcccccctcaccagaggagtacccaattttaggactcaatcttttgaggttgttggtccagaatagaattgcagagttccacactgagctggagcttctgcctgtcaaggcacttgagcatccttgcatcaagcatgccgtcgagcttgagcaatcctttatggagggtgcctacaaccgagtgttgagcgctcggcaggctgtgccgcacgagacctatgtttacttcatggaccttctcgccaaaacagttagagatgagatcggtgggtgcagcgagaaggggtatgattccctatccataagtgatgccaaacaaatgctgatgttcagctcggaccaagaactgcaccagtacatcacagaggagcacccggaatgggagattaagaacggctccgtcttcttccagaaggccaaggagtcgcagccctgcaaggagatcccatccttgcagctaatcaaccagacgctcagctacgccagggagctggagcgtattgtatgatttagttccacaataatttcgatgaatgtttttcccctgcggtcacttggcatggcctgtactatcattatgtttcatcacagctcttgtgtctgaaaaatttcatcatgtgaatctctggagctgtatctgcccgaccgatattgaattgttagctgtttcttcccctgcggtcacttggcatggcctgtactatcattacgttttatcacagctcttgtgtctgaaaaatttcatcgtgtgaacctctggagctgtatctgtctgacggatattgaattgttagctcc

SEQ ID NO: 19196 - protein, 267 aa, Panicum virgatum
  misc_feature: Ceres CLONE 1804663
  misc_feature (24)..(209): Pfam Name: SAC3_GANP Pfam Description: SAC3/GANP/Nin1/mts3/eIF-3 p25 family
MDPKLTEVTQMFARFKAAYARNDLDACVTLLSQLKVQLTKFPSLPPLFQQTPNAVEELKLARDIYEHAVVLSVKLEDQDAFERDFCQLKPYYMDICGIIPPSPEEYPILGLNLLRLLVQNRIAEFHTELELLPVKALEHPCIKHAVELEQSFMEGAYNRVLSARQAVPHETYVYFMDLLAKTVRDEIGGCSEKGYDSLSISDAKQMLMFSSDQELHQYITEEHPEWEIKNGSVFFQKAKESQPCKEIPSLQLINQTLSYARELERIV

SEQ ID NO: 19197 - DNA, 1312 bp, Panicum virgatum
  misc_feature: Ceres CLONE 1804664
  misc_feature: Encodes the peptide sequence at SEQ ID NO. 19198
gcctgcgactgcgaggcccacgtcctcgcgtgcctcgctgaggcctccgctgccgtggtcgatttcgccgcgccgtcggccactgaagcccgaggtcatctcagagccgcgcagcaacgctccagtagcgatccgagcagcggcgcgccgaccgccggaacggatggggtggatctggactgtcttcgcggcgggagccgtgctcctctgggcgatctctctggggcggatcctgtccttccccgcgccgacctgcgtgcccgcgagcccgcacttcatgccccctcttcgcggcgacaggaggagccggaacgttctgctggtcgtcgcccaccccgacgacgagtccatgttcttcgctccaactattctgttcctcaagtcaaagggtcacaatattcacattctgtgcatgtctcaaggtaatgctgatggtcttggaattactcggaaacaagaattgtactgtgcctgtgacactcttaagattccacgtgaacaagttaaagtcttggaccacccaaaattgcaggatggatttcatgagaaatgggaccatgggctattagcagaacttaccatggaacatatccaactgtgggccatcgacacgattgtgacatttgattcatatggagtatcaggccacccaaaccaccaagatgttcatcacggcatatgcaagtttctccatgcgaacgggcaaggaagcattgaagcttgggaacttgcaagcctgaatattcttcgcaagtacagtggtccgctcgacatttggttatcatcgttgatctccttctcaagttcaaagcaaccaatctatacgctggttaacaatagtccatccagaagttatgaggctatggcggcacacagaagtcagtggatttggtttagaagattgtttgtcatgttctcaagttatacatacattaatgtgctacagaaagtttagcatgtgacgtcatatcagaacaagtaaatattctgccatacttgcctccaatgtaactcgttcttcacagggccacaggcaactataagcgagcttctgaagaaaagtgttggttctgagcggggacttcagaaacacaatcgaggttgcacaagattttttttttagagtagttgcacaagaatttaggaatgctggtggctccttgtcttttattatcgattgttttcgttgtacgctgtccatagtcagtgctcatagggtgatgttcatagaactcttgatcccaaactctgtactgtttgcgtgggttgttgaagttgaaatacagtcaatcagtattgcagtatgctcacc

SEQ ID NO: 19198 - protein, 263 aa, Panicum virgatum
  misc_feature: Ceres CLONE 1804664
  misc_feature (52)..(176): Pfam Name: PIG-L Pfam Description: GlcNAc-PI de-N-acetylase
  misc_feature: SWISSPROT Homolog: EC 3.5.1.89 N-acetylglucosaminylphosphatidylinositol deacetylase
MGWIWTVFAAGAVLLWAISLGRILSFPAPTCVPASPHFMPPLRGDRRSRNVLLVVAHPDDESMFFAPTILFLKSKGHNIHILCMSQGNADGLGITRKQELYCACDTLKIPREQVKVLDHPKLQDGFHEKWDHGLLAELTMEHIQLWAIDTIVTFDSYGVSGHPNHQDVHHGICKFLHANGQGSIEAWELASLNILRKYSGPLDIWLSSLISFSSSKQPIYTLVNNSPSRSYEAMAAHRSQWIWFRRLFVMFSSYTYINVLQKV

SEQ ID NO: 19199 - DNA, 1600 bp, Panicum virgatum
  misc_feature: Ceres CLONE 1804672
  misc_feature: Encodes the peptide sequence at SEQ ID NO. 19200
gccggccagctccccgcccagtccgacgccttcacggtgaacggcaagaccggcctgctctacccgtgcgcgaatgatacgtttacggcggtggtggagcccaacgcgcgggtgctgctccgggtcatcaacgccggcctcaactcgcacctcttcttcaaggtggccggccacaacttcaccgtcgtcgccgtggacgcgggctacacctccaacctcaacacggacacgctggtgctcgcgccgggccagaccgtggacgcgctggtcgacaccgccgccgcgccggggagctactacatggcggtgcaggcgcacgacaccatgagcccgctgacgttcgccgcgtcggacaccaccaccgccaccgccatcctccagtacaacggcacgtcgaccagcccgcccgcgatgcccgccatgccgtccagctccgacgccgcgacggccaacgccttctacttcgggctgaggggcctgggcacgcccgccgtgccgtcgcccgtggacgtgagcatgaccatcgagctggggctcggccagctgccgtgcgacccgtcgcagacgaggtgtaacgggaccgccgccgccgcggccatgaacggcgtctcgttccggctcccgggcccgcaggcgtccctcctcggggcgcacgccaacggcctcgccggggtcttcacggccgacttcccggacggcccgccgccgagcggcacggccatggcggtggggaccaaggtgaggaaggtcagcttcaactcggtggtggagatcgtgctgcagaacccgtcggctgtcccgacggagaaccacccgatccacctccacggcttcaacttcttcgtgctggcgcagggggtgggacccttcaccccggccagcgtggcatacaacctggtggacccggtggcacgcaacaccatcgccgtgcccggcggtggctgggccgtcatccgcttcgtcgccaacaacccaggcatgtggttctttcactgccacctggacccgcacgtgcccatgggcctgggcatggtgttccatgtggacagcgggacgacgcccggctcgacgctgcccccgccgccggcgaactgggtgggggtatgcgacgcgcagagctacgccgccgccgccgcagcggaggtagcgccggcgccggcgctatcaccggccccagcgccggccctggcaccagcatcagccccgggtccagcaaattcgccgcgggcggcggccgggtcgccggtgatacctccgcgcgcggtggatcacaaaccgtcgcccaaccttccccagcacagggacggcgggctcccctcttccagatccactgctgggccgagagctgctgggcatctcaccggtctcctctgtatcattcttcttctcttcgttcttcaccaacacaaggcctagcgcgtaagaaactgcttaaaatttacagttttgttcgttcgtgtaagtaaagtgatcattggttttcgtttttgagatttgagatttatacatgtgtatatcagcatatggatatgattcgatgtaattgtgacattctccttctcctcaggggaagatgtgcataacaaagttcagagttcgg

SEQ ID NO: 19200 - protein, 471 aa, Panicum virgatum
  misc_feature: Ceres CLONE 1804672
  misc_feature (229)..(352): Pfam Name: Cu-oxidase_2 Pfam Description: Multicopper oxidase
  misc_feature (2)..(131): Pfam Name: Cu-oxidase Pfam Description: Multicopper oxidase
  misc_feature: SWISSPROT Homolog: EC 1.10.3.2 Laccase
AGQLPAQSDAFTVNGKTGLLYPCANDTFTAVVEPNARVLLRVINAGLNSHLFFKVAGHNFTVVAVDAGYTSNLNTDTLVLAPGQTVDALVDTAAAPGSYYMAVQAHDTMSPLTFAASDTTTATAILQYNGTSTSPPAMPAMPSSSDAATANAFYFGLRGLGTPAVPSPVDVSMTIELGLGQLPCDPSQTRCNGTAAAAAMNGVSFRLPGPQASLLGAHANGLAGVFTADFPDGPPPSGTAMAVGTKVRKVSFNSVVEIVLQNPSAVPTENHPIHLHGFNFFVLAQGVGPFTPASVAYNLVDPVARNTIAVPGGGWAVIRFVANNPGMWFFHCHLDPHVPMGLGMVFHVDSGTTPGSTLPPPPANWVGVCDAQSYAAAAAAEVAPAPALSPAPAPALAPASAPGPANSPRAAAGSPVIPPRAVDHKPSPNLPQHRDGGLPSSRSTAGPRAAGHLTGLLCIILLLFVLHQHKA

SEQ ID NO: 19201 - DNA, 1107 bp, Panicum virgatum
  misc_feature: Ceres CLONE 1804679
  misc_feature: Encodes the peptide sequence at SEQ ID NO. 19202
gagcctgcagccacacagccttcatcacggccgtagcagtctagcagaggcagaggcagaggcagagcagagcgcgcagggtccatggccgtcgccggcgcgcgggcctccgtcctcctcccctccaccctcgcggcttgcacatccccccgcccgcggctcctcgcgctccagctccgccaccgccgcccgcgcggctccctcgcctcggcgccggccgcgggcagggggcggctccgggtgcgcatggcgaggacggagtccaccggcgtcgccgtcggcttccgtgcgccgcagttcgagctcccggagccactgacggggaagctctggacgttagatgatttcgagggcaaccctgcactgctggttatgttcatttgcaaccactgtccatttgtaaaacatctgaaaaaggatattgcaaagctcacctctttctatatggagaaaggacttggtgcagttgccatatcgtcaaactcaattaggacgcatccccaggatggtccagagcgcatggctgaagatgcaaaattgttcgaatatcctttcccctatctttacgatgagtctcaagaagtagcaaaagcttttggagcagtctgcacaccagagtttttcttgttcaaaaaggatggacgaaggcctttcgaacttttctaccatggacagttcgatgattcaagacccagtaacaatgtgccagtaacaggaagggatctaagccgcgcaattgactgcgcactcagtggccaagaattgccttttgtacaaaaacctagtgttggctgcagcatcaaatggcacccatgaaaagctctaatgttggtgtgcgttgagaaatattcagatttttcacttctcagagcaaagatgtggaacattcgattgagcgcaggtgcataggagcagatttttcaagtcagtatcgattgccttgggaacagaattgtgttgggagaaatatgtgaattttgcatcgtaaagcagagctgtcagagcaaaaatatagcgctagtgcagagaaaggcccatgtagagaagtatatatatgtactaaacacaagtgctttacatgtactcatgtgtaggaggtcgtttttt

SEQ ID NO: 19202 - protein, 189 aa, Panicum virgatum
  misc_feature: Ceres CLONE 1804679
  misc_feature (11)..(141): Pfam Name: AhpC-TSA Pfam Description: AhpC/TSA family
MARTESTGVAVGFRAPQFELPEPLTGKLWTLDDFEGNPALLVMFICNHCPFVKHLKKDIAKLTSFYMEKGLGAVAISSNSIRTHPQDGPERMAEDAKLFEYPFPYLYDESQEVAKAFGAVCTPEFFLFKKDGRRPFELFYHGQFDDSRPSNNVPVTGRDLSRAIDCALSGQELPFVQKPSVGCSIKWHP

SEQ ID NO: 19203 - DNA, 1197 bp, Panicum virgatum
  misc_feature: Ceres CLONE 1804698
  misc_feature: Encodes the peptide sequence at SEQ ID NO. 19204
ataaccaaagacgccgttgtgcgggagacgacgagggaaagtgaagagcaggagcagcgtcggactagtgagccatgctcgcctcgccggcgctcgccggcgcgcactccttcgcggcgtccgtgtccggcagcctccgcgtccccctaccttccgtccccgcgccctcgcccacgccggcgcggcgcgcagcgctgtccgtcgtcgccaaggtcaaggtgcctacgccccaggacgaccgcatcgcccgccatgtccgcctccggaagaaggtgagtggcaccacggagaggcccagactgagtgttttccgctcaaacaagcatttgtacgctcaagtcattgatgatacaaagcaatgcactttggcttcggcttcaaccatgcacaaatctctctccaaggaattggaatactccgctggaccaacaatcgaagtagcacaaaagattggtgaagtgattgccaagtcttgcctggagaaaggaattaccaaagttgtctttgaccgaggtggtttcctctaccacggccgcataaaagctcttgctgatgctgctagagagcacgggcttgagttctgaatctttaccccgaatgtttgttcatatttcaatgatcgcctgcaatcttttcttttcaccccctcgatgttgaacagagtttgtagtcacctgccttgttttgcagagtgcagattgggccaaactttgatggcatcagatttttgccccagtcttgcattcaaaagcttctcaacatgatattatgaatctcccaccattcatgctctctggcccacaccatattcattcctgacattgatcctttggatccgaatcccaagtacagggaactgtaacaggatgatgatggcgaacatggaatattttctactctcttgaggtgccgtgtcggttctgttacagcgtgaggaatcgcacgatcactatactgtatgacaagtgcaatctgatgttttctgtcgtctgcatgttatattggttttgctacctcttaaaaataatatacgtgcaatgaagaatacactgataggccacctacagccaggattagtcgctcttgggctactgctcacagcgtcacctgttacgtgtatgacagcgtcgttctgctcctatctttactgccatttttcctgttcatcaactcaatgtattataaaacatatttgtc

SEQ ID NO: 19204 - protein, 169 aa, Panicum virgatum; identical to SEQ ID NO: 12484
  misc_feature: Ceres CLONE 1804698
  misc_feature (51)..(169): Pfam Name: Ribosomal_L18p Pfam Description: Ribosomal L18p/L5e family

SEQ ID NO: 19205 - DNA, 1184 bp, Panicum virgatum
  misc_feature: Ceres CLONE 1804700
  misc_feature: Encodes the peptide sequence at SEQ ID NO. 19206
atttttaatattttctcccgccttacacgaaacaacaccaccgttttatatagctgcctcctcttctcagcgctctcccgcgtgctgccgcctggcctctcttcttctctcgttctcttccctgctcggctcaggggcttgtatcaacgaggaagaggaagtaagcaaacgctgcataatggtgtccaaagctgcaatttttgccacggccgtactggccgtccacctcgccgccccggcgtcggctcagacgagcagcccccccgcgccggcgcccatgtcactcgcgccgaccccagcgccggcgccggcgccgcactacgtggacctcgccgagctcctcagcgtggccggcccgttccacacgttcctcaactacctggagaagaccaacgtgatcgagaccctgcagagccaggccaacaacaccaaggtgggcatcaccatcttcgtccccaaggactcggcgttcgcggcgctcaagaagtccaccttctccaacctcacctccgaccagctcaagacgctgctcctgtaccacgcgttccccaagttctactccctggccgagttcaagaacctgagctcgctcaacccggtgaacaccttcgcggggtcgccgtacacgctcaacctcaccgacgacatgggcagcatctacgtgcagtccatgtggtccaggcccaagatcgccagcagcgtgtacgccaccaaacccgtcgcgatctacgcgctcaacaaggtgctcctgcccatgcagctcttcagcaaggacccgccgctcgcgccggcgccggcgcccgcgccggagtccggggcgtccgacgcccccagcccggcggacggtaaagcagacgggctgaccggcggcaagggtgactcgacgagcggcgcgtacaacgtcggcgccgtcagcgttgccaattccttgctgctagccgcggcaggatgcttgatgctcctgtggtgagacttgagggttcttgccattctctgagcagagtgtccatgcttcgccacacttgatttcgttttgaattggttcatggagtcattcttttggacatatggtagatgacgttaggatcgaactggagtattttacgtcacattactctcataatttctatcattttttgatggatgaatgattgaatgaatacaaaaaaaaagttttcactgcc

SEQ ID NO: 19206 - protein, 263 aa, Panicum virgatum
  misc_feature: Ceres CLONE 1804700
  misc_feature (60)..(192): Pfam Name: Fasciclin Pfam Description: Fasciclin domain
  misc_feature: Functional homolog of the protein sequence given in SEQ ID NO 50841
  misc_feature: Useful for making plants with altered carbohydrate content
  misc_feature: Functional homolog of the protein sequence given in SEQ ID NO 50842
  misc_feature: Useful for making plants with altered cell wall content and/or composition
  misc_feature: Useful for making plants with altered lignin content
MVSKAAIFATAVLAVHLAAPASAQTSSPPAPAPMSLAPTPAPAPAPHYVDLAELLSVAGPFHTFLNYLEKTNVIETLQSQANNTKVGITIFVPKDSAFAALKKSTFSNLTSDQLKTLLLYHAFPKFYSLAEFKNLSSLNPVNTFAGSPYTLNLTDDMGSIYVQSMWSRPKIASSVYATKPVAIYALNKVLLPMQLFSKDPPLAPAPAPAPESGASDAPSPADGKADGLTGGKGDSTSGAYNVGAVSVANSLLLAAAGCLMLLW

SEQ ID NO: 19207 - DNA, 1306 bp, Panicum virgatum
  misc_feature: Ceres CLONE 1804701
  misc_feature: Encodes the peptide sequence at SEQ ID NO. 19208
aggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagatagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaaactgctgctcgagaaggggtacactgtcaagggcaccgtcaggaacccagatgacccgaagaacgcgcacctcaaggcgctggacggcgccgccgagcggctcatcctctgcaaggccgacctcctggactacgacgccatctgccgcgccgtggagggctgccacggcgtcttccacaccgcctcccccgtcaccgacgaccccgagcaaatggtggagccggcggtgcgcggcacggagtacgtgatcagcgcggcggcggaggccggcacggtgcggcgggtggtgttcacgtcctccatcggcgccgtgaccatggaccccaaccgcggggccgacgtggtggtcgacgagtcctgctggagcgacctcgacttctgcaagaaaaccaggaactggtactgctacggcaaggcggtggcggagcaggcggcgtgggaggcggcgcggcagcgcggcgtggacctggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttcgagagccccgccgcctccggccgccacctytgcgccgagcgcgtcctccaccgcgaggacgtcgtccgcatcctcgccaagctcttccccgagtaccccgtccccaccaggtacgcgtacgttgctccatcgtactacggcttctagttaataaatcgtttacttcgtagtagtcgatttatttggctgtttcggctgcctccgtgcatgctgaacgagctaccaaccacagctaccaaccacagtttgcaaatagcagtttttttttaacgaactaggcatgagagctgcagattatattaaaaagaagatgaaagctcagattgagcaatac

SEQ ID NO: 19208 - protein, 303 aa, Panicum virgatum
  misc_feature: Ceres CLONE 1804701
  misc_feature (28)..(267): Pfam Name: Epimerase Pfam Description: NAD dependent epimerase/dehydratase family
  misc_feature: SWISSPROT Homolog: EC 1.1.1.219 Dihydrokaempferol 4-reductase
  misc_feature: Functional homolog of the protein sequence given in SEQ ID NO 50843
  misc_feature: Useful for making plants with altered carbohydrate content
  misc_feature: Functional homolog of the protein sequence given in SEQ ID NO 50647
  misc_feature: Useful for making plants with altered cell wall content and/or composition
  misc_feature: Useful for making plants with altered lignin content
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPEQMVEPAVRGTEYVISAAAEAGTVRRVVFTSSIGAVTMDPNRGADVVVDESCWSDLDFCKKTRNWYCYGKAVAEQAAWEAARQRGVDLVVVNPVLVVGPLLQPTVNASIAHILKYLDGSARTFANAVQAYVDVRDVAAAHLRVFESPAASGRHLCAERVLHREDVVRILAKLFPEYPVPTRYAYVAPSYYGF

SEQ ID NO: 19209 - DNA, 987 bp, Panicum virgatum
  misc_feature: Ceres CLONE 1804704
  misc_feature: Encodes the peptide sequence at SEQ ID NO. 19210
atccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgttcatgtcgacgagcgtcggcggcggccgcgcgctgccgtcgctgcaggccggccggccggcgccgtacccgcggctcgcgctgccgtcggcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcaccctcctcggcgccatcggcgctctcggagaccgcggcaccttcgtcgacgacgccactggcctcgacaaggccgtcatcccacccggcaagggcttccgtggcgccctcggcctcagcgagggagggccgctgttcgggttcaccaagtcgaacgagctgttcgtggggcggctggcgcagctcttcaacgtcctcttcttcttcatcgccgccatcaaccctggcaccggcaagttcatcatcggcgaggacgagaagtagagagagaccgagggaaatgatgcgcctggttgtttgtggttgatcgatcagtgcgtctctgcgcgtgtgcgtgcaactcgctgtgtattgcacgtgaggctttggaggttagggtgttgcgttgggttgtcttgtaaaacaagagcttatctaatatccaatggctgccggtgttctcttagagt

SEQ ID NO: 19210 - protein, 224 aa, Panicum virgatum
  misc_feature: Ceres CLONE 1804704
  misc_feature (62)..(210): Pfam Name: Chloroa_b-bind Pfam Description: Chlorophyll A-B binding protein
  misc_feature: Functional homolog of the protein sequence given in SEQ ID NO 50302
  misc_feature: Useful for making plants with modulated light quality response
  misc_feature: Useful for making plants with modulated nitrogen use efficiency
MAQSMFMSTSVGGGRALPSLQAGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFTLLGAIGALGDRGTFVDDATGLDKAVIPPGKGFRGALGLSEGGPLFGFTKSNELFVGRLAQLFNVLFFFIAAINPGTGKFIIGEDEK

SEQ ID NO: 19211 - DNA, 964 bp, Panicum virgatum
  misc_feature: Ceres CLONE 1804707
  misc_feature: Encodes the peptide sequence at SEQ ID NO. 19212
ggcctatagcgacagcaagcagcaagaacacgcgagcaccagagagggagagagagagagggccgggccgggccggccgggaataaagcgagcgagcgagcgaacggcatccatggccgaccaccacgggcagggggggcgcgacggcccgggggcagaggagatcaaggagcaggaccggctgctgcccatcgccaacgtcgggcgcatcatgaagcagatcctgccgcccaacgccaagatctccaaggaggccaaggagacgatgcaggagtgcgtgtccgagttcatcagcttcgtcaccggggaggcctccgacaagtgccacaaggagaagcgcaagaccgtcaacggcgacgacgtctgctgggccttcggcgccctcggcttcgacgactacgtcgaccccatgcgcaggtacctccacaagtaccgcgagctcgagggcgaccgcggcgccgccgccgcgtcctcccgcgggggcggaggctccacgtccacctcggccggccccgacgccggggcaggagcaggacccagcagcggtcatttcatgttcggcgccatggacaggagcgataacaacagctcctccaggcccttttaatccatcttaattcttgcccaagagctcatcgctttctactcatttttggagaggtagcgtagatcgatgggaacaccaggagcgaggaacaggctagtgatgtatttgatcggtgaagatggccggagctgagacctaccggccggaggatcatatatatcgtcggtcggaggtgcatgtaactgcactgcacatgatcgatcgactcggtttgatttatttaattggcatcagaatgttaatttgcattgtctctagtctgcacattgttacgtagcttaattaatttcagttgattttagttttgtagccggcggccggtaagaataatatatattctagattcaaaagttatag

SEQ ID NO: 19212 - protein, 164 aa, Panicum virgatum
  misc_feature: Ceres CLONE 1804707
  misc_feature (23)..(88): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: Functional homolog of the protein sequence given in SEQ ID NO 50466
  misc_feature: Useful for making plants with modulated drought sensitivity
  misc_feature: The sequence is a functional homolog of SEQ ID NO 62 in the 10/675,852 US patent application
  misc_feature: The sequence is a functional homolog of SEQ ID NO 22 in the 10/675,852 US patent application
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 791 in the 10/374,780 US patent application
  misc_feature: Functional homolog of the protein sequence given in SEQ ID NO 50465
  misc_feature: Useful for making plants with modulated biomass
  misc_feature: The sequence is a functional homolog of SEQ ID NO 64 in the 10/675,852 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 60 in the 10/675,852 US patent application
  misc_feature: The sequence is a functional homolog of SEQ ID NO 12 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 14 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 66 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 42 in the 10/675,852 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 38 in the 10/675,852 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 788 in the 10/374,780 US patent application
  misc_feature: The sequence is a functional homolog of SEQ ID NO 44 in the 10/675,852 US patent application
  misc_feature: The sequence is a functional homolog of SEQ ID NO 803 in the 10/374,780 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 795 in the 10/374,780 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 22 in US patent 7166765
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: The sequence is a functional homolog of SEQ ID NO 793 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
MADHHGQGGRDGPGAEEIKEQDRLLPIANVGRIMKQILPPNAKISKEAKETMQECVSEFISFVTGEASDKCHKEKRKTVNGDDVCWAFGALGFDDYVDPMRRYLHKYRELEGDRGAAAASSRGGGGSTSTSAGPDAGAGAGPSSGHFMFGAMDRSDNNSSSRPF

SEQ ID NO: 19213 - DNA, 526 bp, Panicum virgatum
  misc_feature: Ceres CLONE 1804709
  misc_feature: Encodes the peptide sequence at SEQ ID NO. 19214
aagcttgcagctaaatcctaccctagtgccattagtggtaagcaattaagcagcgtcgcggcctcttgggtgagagagaggagggactgggatggaggcggggctggcggcggggtactgggacgtgggcaggctgccgtgcggggcgtgcgggggctcgccggcggcggtgcactgccggacgtgccccggcggcgcgtacctgtgcgcggggtgcgacgcggggcacgcacgggcgggccacgagagggtctgggtctgcgaggtgtgcgagcgcgcgccggccgcggtcacgtgccgggccgacgccgcggcgctctgcgccgcgtgcgacgccgacatccacgacgccaacccgctggcgcgccgccacgagcgcgtgcccgtgcagtccatcggggcggccgcgcccgccgcggacccgctgctgttcggcttcggcgccgccgcaacggaagagaaggatgacgccgcggcggccgccgggatgcttgccggtggcgcgatcggcggcggcgctaatagt

SEQ ID NO: 19214 - protein, 144 aa, Panicum virgatum
  misc_feature: Ceres CLONE 1804709
  misc_feature (52)..(99): Pfam Name: zf-B_box Pfam Description: B-box zinc finger
  misc_feature: Functional homolog of the protein sequence given in SEQ ID NO 50844
  misc_feature: Useful for making plants with altered lignin content
  misc_feature: Useful for making plants with modulated cold sensitivity
MEAGLAAGYWDVGRLPCGACGGSPAAVHCRTCPGGAYLCAGCDAGHARAGHERVWVCEVCERAPAAVTCRADAAALCAACDADIHDANPLARRHERVPVQSIGAAAPAADPLLFGFGAAATEEKDDAAAAAGMLAGGAIGGGAN

SEQ ID NO: 19215 - DNA, 470 bp, Panicum virgatum
  misc_feature: Ceres CLONE 1804709-R
ggcggcgggcttcccgaccgcggccgccgccgcgccgccgccgaagcagccgcaggcgccgcagccagccgcttaccacccctacgtggtggacttcgccgccggctacggggtcgtgcccaccttctgatcgacgcgccgcgggcgtcgtgtgtgattgttgcgccgcgtgccacgtttttgagccggccgatcgatcgatccgcgccggcgtaacgcacgcatcggtgttcgacgcgcgtgccgtcgtgctgcatgcgcgcgtgtttgctagaacggtgaagctctagttggcgatcaccggttttgggctggcctcgatcggttaaattagcaggctagggcgtacttcctagttcctactacgtgtttgctggaaacggcaagtttccactttccagttctgtaattttggatcagggagatgcttagcatctgacgaagctctttgaatgattcgctatgctagt

SEQ ID NO: 19216 - DNA, 598 bp, Panicum virgatum
  misc_feature: Ceres CLONE 1804710
  misc_feature: Encodes the peptide sequence at SEQ ID NO. 19217
ctcgcacgctcaggcattcctactcccagcttctgctctcctctcttcgttctctctcgtctcctcttctcgatcgagcgctcgatctgcggccctgttgttgacctgcgaaacgccggcctgagacgtcgaagggggcgtggtgaccagcagatggatccatggatcagcagccagccttctctgagtcttgacctgcacgtcggcctgccgccgctcagccgccaccaggcgccggtcgccttggccaagcccaaggtgctcgtcgaggagaacttcctgcagcctctaaagaaagaaccagaggtcacggccctcgagacggagctccagcggatgagcgaggagaaccggcgcctggccgaggcgctcacggcggtggccgccaagtacgaggcgctgcggagccagtacacggagatggtcgccgcgggcgccgccgccaccaccggcccgtcctccgcgtcggagggcgggtcggtgtcgccgtcgcggaagcgcaagacgagcgagagcctggacaccgcggcggcggcggcggcggggctcctggtggcgtgcgggcggcgcggcgcgtagtaggcggcggccgcggcgg

SEQ ID NO: 19217 - protein, 141 aa, Panicum virgatum
  misc_feature: Ceres CLONE 1804710
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
MDPWISSQPSLSLDLHVGLPPLSRHQAPVALAKPKVLVEENFLQPLKKEPEVTALETELQRMSEENRRLAEALTAVAAKYEALRSQYTEMVAAGAAATTGPSSASEGGSVSPSRKRKTSESLDTAAAAAAGLLVACGRRGA

SEQ ID NO: 19218 - DNA, 1057 bp, Panicum virgatum
  misc_feature: Ceres CLONE 1804716
  misc_feature: Encodes the peptide sequence at SEQ ID NO. 19219
ctcccctccactcccgtccccttccccgagccgccgccgccgccatggccatgaagggacccggtctcttctccgacatcggcaagaaggccaaagatctgctcacgaaggactacacctacgaccagaagttcaccatctccaccgtcagcgcctccggagtgggcctcacttccacagctgtgaagaaaggagggctttatactcttgatgtcagctcagtttacaagtacaagaatactcttgttgatatcaaagtggacactgaatcaaacatctctaccaccttgactgtgttggatgccctgccatccacgaaacttgtgacgtctgtgaagctgcctgactacaattctggaaaggtggaattgcaatacttccatgagaatgcaagttttgctactgttgttggcacaaagccatctcctgtggttgaactttctgggacagttggtgctcaaggagtttcgtttggtgccgaagctgggtacgacactgctacaggaaaacttaccaagtacactgctgcaattggtgtaaccaagccagactaccatgctgcattcattctggccgataaaggtgacaccattaaagtgtcaggtgtttatcaccttgatgagaagcagaaagcctcagctgtggctgaactaacacggaggctctcaacaaatgagaacacactcactgttggtggcctatacaagattgatcctcagacagccgtgaagacaaggctcaacaacactggaacgcttgccacgcttcttcagcatgagcttaaacccaagtcactcttgacaatctccggtgaattcgataccaaggccctggacagggcccccaagtttggcctggcacttgcattgaagccctgatcagatcattcccggttgattgctggtgaattttggattctttggttgtttttgcaaagctgtagccaataatttgttccacggatatgttctgttaacctggcaaaggtttgacgctgtgtgggaaggatccggatgggtcgtctacaagattttttacccatcggtttttgttgtcg

SEQ ID NO: 19219 - protein, 277 aa, Panicum virgatum
  misc_feature: Ceres CLONE 1804716
  misc_feature (5)..(270): Pfam Name: Porin_3 Pfam Description: Eukaryotic porin
MAMKGPGLFSDIGKKAKDLLTKDYTYDQKFTISTVSASGVGLTSTAVKKGGLYTLDVSSVYKYKNTLVDIKVDTESNISTTLTVLDALPSTKLVTSVKLPDYNSGKVELQYFHENASFATVVGTKPSPVVELSGTVGAQGVSFGAEAGYDTATGKLTKYTAAIGVTKPDYHAAFILADKGDTIKVSGVYHLDEKQKASAVAELTRRLSTNENTLTVGGLYKIDPQTAVKTRLNNTGTLATLLQHELKPKSLLTISGEFDTKALDRAPKFGLALALKP

SEQ ID NO: 19220 - DNA, 860 bp, Panicum virgatum
  misc_feature: Ceres CLONE 1804722
  misc_feature: Encodes the peptide sequence at SEQ ID NO. 19221
agaacagaagacaaccagacttctgatccacaacaccacacttgctaggtagcgagacctgtcgagaggaaccaccgaccggtgcaacatggagtacggccagcaggggcagcacggccacggaaccaccggccgcgtcgaccagtacggcaacccggtcggcggcgtcgggcacggcaccgggaccgggaccggcggcatggggtacggtgggaccaccagaaccggcggcatgggccagctgggggagcacggcggcgccggcatgggtggcggccagttccagcctgcgagggaggagcacaagaccggctgcgtcctgcaccgctccggcagctccagctccagctcgtccgaggacgacggcatgggcgggaggaggaagaagggcattaaggagaagatcaaggagaaattgcccggaggccacaagaaggacgaccagcacaccacggccaccggcggtgcctacgggcagcagggacacaccggcatgactggcacgggaaccggcggcgccgcctacaccgagggcaccggcgagaagaagggcatcatggacaagatcaaggagaagctgcccggacagcactaattaagcgcggccgcgcggtacgcgcgagaagccgtgtgcttgtctgtcacggcgttccgagataataagatgaacccagcaggaatggagtgtcccttgaacgcgtccgctcgcggggggcggacggtttgcacctgtgtcctagaggttctccgtttcacatgtgtgtgtgcagtgtagtttgtatggaacgtcatacatagagtactgtactgtgtaaactgctttaatggtgtttttctgaataaatatacgtggtttgtgt

SEQ ID NO: 19221 - protein, 168 aa, Panicum virgatum
  misc_feature: Ceres CLONE 1804722
  misc_feature (14)..(168): Pfam Name: Dehydrin Pfam Description: Dehydrin
MEYGQQGQHGHGTTGRVDQYGNPVGGVGHGTGTGTGGMGYGGTTRTGGMGQLGEHGGAGMGGGQFQPAREEHKTGCVLHRSGSSSSSSSEDDGMGGRRKKGIKEKIKEKLPGGHKKDDQHTTATGGAYGQQGHTGMTGTGTGGAAYTEGTGEKKGIMDKIKEKLPGQH

SEQ ID NO: 19222 - DNA, 1230 bp, Panicum virgatum
  misc_feature: Ceres CLONE 1804723
  misc_feature: Encodes the peptide sequence at SEQ ID NO. 19223
acattcctaccctctagctaagctaataccaccaccagcagcagcagtagcagccgccatggcggcgagcggcaagaagctcccgccgttcctcttcacgctgctgcttctgctctccaccgccgtgacgcccatcctctcgctgccggccgccgaccacgaggtcgactgcgactgcgacaagcccaaggcgcccaagccgtcgcacccgcccaagaccaaaccctcccacccgtcgcccaagcccaggaaccccaagccgcccaagggcccctcctacccgtcgccggcgacgcgcccgcccaagggccgcccctccaacccgccgatcactcgtcctcgtccgccggtcgtcggcccccccaagggccccgtcacgcgcccgccggtcgtggggccaccggtcacgcgcccgccggtcacacgtccgccggtcgtcatcagcccgccggtgacctacccaccaccgattaccggccctccgacgacgacgccaccggtcactggcccaccggtcacggtccccccgatcaccggcccgccctcgacgacgcctccggtcaccggcccgcccttgacgaaccctcccggcggtggaagctcgacgccgtgcccgccgcctcctcccgcgaccccgactccgacgccgtcgtcgccgacgtgcccggcggactcgctgaagctgggcgcgtgcgtggacctgctgggcgggctggtgcacgtcgggctcggcgaccccgtggtgaacaagtgctgcccgctgctggagggcctggtggagctggaggcggccgtgtgcctctgcaccaccatcaagctcaagctcctcaacatcaacatctacctgcccctggcgctccagctcctcatcacctgcggcaagacgccgccgcccggctacacctgcaccgtctgatcgatcaatgcaactagctagtaacccttgcacaagcaggggttttggagtgagtttcttctgtaatttgaagagagatcaaccgacatgagaggatgtcatcgtctgcttcttcctagctatggtagctgtgtttagttgtttttctgttgtggttcgatcgatctcaagttctcaaccggcctgttaagtcgtttcagactttcagttaatttggctggccctcggcagcttgattgttggtgttggtgtggtttcagtttgattcgagagagtcgttgatggctgatttctactgccatcaggtgacgatg

SEQ ID NO: 19223 - protein, 285 aa, Panicum virgatum
  misc_feature: Ceres CLONE 1804723
  misc_feature (202)..(283): Pfam Name: Tryp_alpha_amyl Pfam Description: Protease inhibitor/seed storage/LTP family
  misc_feature: Functional homolog of the protein sequence given in SEQ ID NO 50191
  misc_feature: Useful for making plants with modulated salt sensitivity
MAASGKKLPPFLFTLLLLLSTAVTPILSLPAADHEVDCDCDKPKAPKPSHPPKTKPSHPSPKPRNPKPPKGPSYPSPATRPPKGRPSNPPITRPRPPVVGPPKGPVTRPPVVGPPVTRPPVTRPPVVISPPVTYPPPITGPPTTTPPVTGPPVTVPPITGPPSTTPPVTGPPLTNPPGGGSSTPCPPPPPATPTPTPSSPTCPADSLKLGACVDLLGGLVHVGLGDPVVNKCCPLLEGLVELEAAVCLCTTIKLKLLNINIYLPLALQLLITCGKTPPPGYTCTV

SEQ ID NO: 19224 - DNA, 683 bp, Panicum virgatum
  misc_feature: Ceres CLONE 1804737
  misc_feature: Encodes the peptide sequence at SEQ ID NO. 19225
gtctaaccggctcaacctgaccagcgtcgagtccaccaccgtctcgtcttgtctgacgaggtccaccacgccagcggaccgagcgcgccaactcgccaccgccaccgccaccgcgcgccgggaatggcgccgcttctcgccctcctcctcctttgcctctccgtcacccgccggtgctccgccaccaccgccgccgccgccgcggcctcgccgtccccgcccccgcccccgccgcccgcgccgctggtccctgcgctcttcgacatcggcgactccgcggaggacgtcggcaccaacaactacctcggcacgctcgcccgcgccgaccgcgagccctacggccgggacttcgacacgcaccgccccacggggcgcttctccaacggccgcatccccgtcgactacctcgcggagcggctgggcctccccttcgtgcctccctaccttgagcaaaacatgcgcacgggcgccggcagtgttggcctctcaaacgttgatgggatgatccagggcgtcagctacgcgtccgcggcagccggcatcatctccagcagtggctctgagctggggatgcatgtgtcgctgacccagcaggtgcagcaggtcgaggacacatactagcagctgtccctggctctaggggaggcagcggcagccaacctgttcatgaggtcagtgttctt

SEQ ID NO: 19225 - protein, 165 aa, Panicum virgatum
  misc_feature: Ceres CLONE 1804737
  misc_feature: SWISSPROT Homolog: EC 3.2.1.51 Alpha-L-fucosidase
MAPLLALLLLCLSVTRRCSATTAAAAAASPSPPPPPPPAPLVPALFDIGDSAEDVGTNNYLGTLARADREPYGRDFDTHRPTGRFSNGRIPVDYLAERLGLPFVPPYLEQNMRTGAGSVGLSNVDGMIQGVSYASAAAGIISSSGSELGMHVSLTQQVQQVEDTY

SEQ ID NO: 19226 - DNA, 663 bp, Panicum virgatum
  misc_feature: Ceres CLONE 1804737-R
  misc_feature: Encodes the peptide sequence at SEQ ID NO. 19227
cagtacaatgagacaggaaatcaagaatttgtacaacataaatgttcgcaaggtcatactgatgggcctacctcctgttggttgtgcaccccatttcctcgaggagtatggcagtcaaactggggaatgcatcgattatgtcaacaatgtcgtaattgagttcaactatgccctgagacacatgtccaatgagttcatcagccagcacccagattctatgatcagctattgctatacttttgaggggtctgtggacatattaaataaccgtgagcgttatggttttgtcaccaccactgacgcttgctgtgggctgggcaagtatggaggcttgatcatgtgtgttcttccacagatggcctgcagcgatgcatcaagccatgtttggtgggatgaattccacccaactgatgctgttaaccgcatcctggcagataatgtgtggtcaggtcagcacaccaagatgtgctatcctttggacttgcaacagatggtaaaactgaagctgtaggaccaatctgaagctagtagcctaacatttgttttgaagaaatgtttataattgtttataattgtgaatctgaaagaggggacacgccgaaatgtttagaactgtgaattacagagagctataaagatagacctgccagttttagacagctc

SEQ ID NO: 19227 - protein, 169 aa, Panicum virgatum
  misc_feature: Ceres CLONE 1804737-R
  misc_feature: SWISSPROT Homolog: EC 3.2.1.51 Alpha-L-fucosidase
STMRQEIKNLYNINVRKVILMGLPPVGCAPHFLEEYGSQTGECIDYVNNVVIEFNYALRHMSNEFISQHPDSMISYCYTFEGSVDILNNRERYGFVTTTDACCGLGKYGGLIMCVLPQMACSDASSHVWWDEFHPTDAVNRILADNVWSGQHTKMCYPLDLQQMVKLKL

SEQ ID NO: 19228 - DNA, 654 bp, Panicum virgatum
  misc_feature: Ceres CLONE 1804740
  misc_feature: Encodes the peptide sequence at SEQ ID NO. 19229
aagaaccccccactccactccactcaacccgcctcagccgcagccggccaccccacccaccgcaaggagcgagagccaccaaccaagaagcagccatggtgacggcggccgcgacgcagcgccgtgacgccgaggcggagctgaacctgcccccgggcttccgcttccaccccaccgacgaggagctcgtcgcgcactacctctgcgcgcgcgccgccgggcgcagcgcgccggtgcccatcatcgccgaggtcgacctctaccgcttcgacccctgggagctccccgagcgcgccctcttcggccgccgcgagtggtacttcttcacgccgagggaccgcaagtaccccaacggctcccgccccaaccgcgccgccgggaccgggtactggaaggccaccggcgccgacaagcccgtccagcacgggggccggaccctggggatcaagaaggcgctcgtcttctaccacgggaagccgccgcgcgggatcaagaccgagtggatcatgcacgagtaccgcctcgccgacgccggcggcaagaagcccggcaacggctcgctcaggctggacgactgggtgctgtgccgcctctacaacaagaagaacgagtgggagaagatgcagcagcagaaggagaaggcaatggagtcgg

SEQ ID NO: 19229 - protein, 186 aa, Panicum virgatum
  misc_feature: Ceres CLONE 1804740
  misc_feature (18)..(144): Pfam Name: NAM Pfam Description: No apical meristem (NAM) protein
  misc_feature: The sequence is a functional homolog of SEQ ID NO 891 in the 10/374,780 US patent application
  misc_feature: The sequence is a functional homolog of SEQ ID NO 853 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 890 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 854 in the 10/374,780 US patent application
  misc_feature: Functional homolog of the protein sequence given in SEQ ID NO 50324
  misc_feature: Useful for making plants with altered terpenoid content
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Functional homolog of the protein sequence given in SEQ ID NO 50838
  misc_feature: Useful for making plants with modulated water use efficiency
  misc_feature: Functional homolog of the protein sequence given in SEQ ID NO 50326
  misc_feature: Useful for making plants with modulated light quality response
  misc_feature: The sequence is a functional homolog of SEQ ID NO 851 in the 10/374,780 US patent application
  misc_feature: Functional homolog of the protein sequence given in SEQ ID NO 50323
  misc_feature: Useful for making plants with altered cell wall content and/or composition
  misc_feature: Useful for making plants with altered lignin content
  misc_feature: Functional homolog of the protein sequence given in SEQ ID NO 50322
  misc_feature: Useful for making plants with modulated oxidative stress sensitivity
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 1012 in the 11/435,388 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 852 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 612 in the 11/435,388 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Functional homolog of the protein sequence given in SEQ ID NO 50328
  misc_feature: Useful for making plants with modulated nitrogen use efficiency
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 476 in the 10/666,642 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 344 in the 10/666,642 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
MVTAAATQRRDAEAELNLPPGFRFHPTDEELVAHYLCARAAGRSAPVPIIAEVDLYRFDPWELPERALFGRREWYFFTPRDRKYPNGSRPNRAAGTGYWKATGADKPVQHGGRTLGIKKALVFYHGKPPRGIKTEWIMHEYRLADAGGKKPGNGSLRLDDWVLCRLYNKKNEWEKMQQQKEKAMES

SEQ ID NO: 19230 - DNA, 572 bp, Panicum virgatum
  misc_feature: Ceres CLONE 1804740-R
tcgctctcgcactcccactcccactccgacacgcgcaccccggagtcggagatcgacgacgacacgttcccggggctgggctcgctgccggagttcgacggcatgggccccgcccccgccggcgccgtcctgcccaaggaggaggtgcaggacttcggcaacctcggcggcgacgactggctcgcggggatcaacctcgactacctgcaggtgcccggggacgccgacttcttcaacaacatgcccctattctgaacctgagctctgctctgctctgctccgaccccgaggagggatgcagctgcaactgtgaatagttcagatttgctttccattcagagaaacaaaaattattcctgctaatgcctggttgtagtgccgtagaccgtagtggtgtagtgcagaagtagtggtatgcaggtcagcatggattggagtccagtgtaggattgaagctcatcattggagcttgtgatcagtgacaaaattctttcgtttctggttcagcaatttatcatctcttagatttggttcttcagaattcagatgggcaaatggcattcagccatttt

SEQ ID NO: 19231 - DNA, 1104 bp, Panicum virgatum
  misc_feature: Ceres CLONE 1804749
  misc_feature: Encodes the peptide sequence at SEQ ID NO. 19232
gtaacgctgcgcttctttgccttcgcttcagcagcatctgcggagcggcggctgctactcgcctgctcctccaggggggaagggcaccggcgacggcggccggcgaggagctggaccctcgagcccggatgccacctcccgagagctacagctagaacaagatcactaatgtctgcctatggcaatggatccacctacaactgatgctggtgatgaactggggagctactcgtccttgggtttgatagtatcatactcacagaaagacaatgctaaatttccaaaggttcttttgcttctgtcagcatatcttgacaagatagttaaggagaatgaagtgttacttgattccagtaaaataaaggagtcaaccactatctttcatggtcagagggtgccagaacttagcataaagctctatgcagaacgtatcttcaagtatgcacagtgcagcccatcttgctttgtgctgggactcatctacatggagagatatctacagcaaccaaacatttacatgacgtcatttagtgttcatcgcttgctgattacaagtgttgttgttgctgccaaattcatagatgattcgtttttcaacaatgcatactatggaagagttggaggaattagcacaagagagatgaacaagcttgaactggatttgttgttcagtctggacttcaggctcagagtcaatttagagactttcagaagctactgcttgcagttggagaaagaagcgctagttcttgttctagaaagaccgatccaaatccaagccaccaacgggactaaatccctgatttgtaacagcagtgttgatgaaacttgcaagcatgagctcgtgtgtcaaaggtacagcagccaggctctccaaggatgtagctggtaaatcaggtttacaacagacagttttgaaaaagtgtgagggtctgaggactgataattcttttatttgacaatgtgcactcagatggcttcaaatcatcttctttttagttagtgaggcagttgttttacttttctacaacactgtaattcttgagccacgttgaaaacgtcattcctgaagtctggaagcgtttcagtctggtcacgctatcc

SEQ ID NO: 19232 - protein, 235 aa, Panicum virgatum
  misc_feature: Ceres CLONE 1804749
  misc_feature (33)..(168): Pfam Name: Cyclin Pfam Description: Cyclin
MDPPTTDAGDELGSYSSLGLIVSYSQKDNAKFPKVLLLLSAYLDKIVKENEVLLDSSKIKESTTIFHGQRVPELSIKLYAERIFKYAQCSPSCFVLGLIYMERYLQQPNIYMTSFSVHRLLITSVVVAAKFIDDSFFNNAYYGRVGGISTREMNKLELDLLFSLDFRLRVNLETFRSYCLQLEKEALVLVLERPIQIQATNGTKSLICNSSVDETCKHELVCQRYSSQALQGCSW

SEQ ID NO: 19233 - DNA, 266 bp, Panicum virgatum
  misc_feature: Ceres CLONE 1804750
  misc_feature: Encodes the peptide sequence at SEQ ID NO. 19234
cagccaccgtcattctgtcatccatgaccaggaaactggagagcggtactgcccgctcgacaatcttgttatgaaccaagatgaagagctttttactgtgagcaacagttccctgtcagaatttgctgttctgggctttgagttgggttactccatggagaacccaaactcactggtcctatgggaagctcagtttggtgattttgcaaatggagctcaagttatatttgatcagttcctgagtagtggggagtcaaaatggctcc

SEQ ID NO: 19234 - protein, 88 aa, Panicum virgatum
  misc_feature: Ceres CLONE 1804750
  misc_feature: SWISSPROT Homolog: EC 1.2.4.2 Oxoglutarate dehydrogenase (succinyl-transferring)
SHRHSVIHDQETGERYCPLDNLVMNQDEELFTVSNSSLSEFAVLGFELGYSMENPNSLVLWEAQFGDFANGAQVIFDQFLSSGESKWL

SEQ ID NO: 19235 - DNA, 667 bp, Panicum virgatum
  misc_feature: Ceres CLONE 1804750-R
  misc_feature: Encodes the peptide sequence at SEQ ID NO. 19236
tcataaaggaccagaacaatcacaaggaccttgaggagggaatcaaccgtctagttctttgctctggaaaggtgtattatgaacttgatgaagaaagaaggaagacggagcgcactgatgttgccatatgtagagttgaacagctctgcccgttcccatacgacctcatccagcgggagttgaagagatatccaaatgccgagatcgtgtagtgccaggaggagccgatgaacatgggtgcgtacagctacattaacccccgcctgctgacggcgatgaaggcgctgggccggggtagcatcgaggacatcaagtacgtgggcagggccccatcggcggccaccgcgacgggcttctactcggtgcacgtgcaggagcagacggagctggtgcagaaggcgctgcagcgcgaccccatcaactactcgttctgattctgatgaaagaaatcccctgtagattcttggagtagccctggaattggagacctttttgattttgataccactagtaccgtagagagagcaggtccgagtcatacctgtgcagcagccatttggtgaagggaagggaaataattcgtttcggatgtacggtaccggatgaacgaaaaactcccgttttagcgcatgttttgttctgcatcgcgtaaattttataagctggc

SEQ ID NO: 19236 - protein, 69 aa, Panicum virgatum
  misc_feature: Ceres CLONE 1804750-R
  misc_feature: SWISSPROT Homolog: EC 1.2.4.2 Oxoglutarate dehydrogenase (succinyl-transferring)
IKDQNNHKDLEEGINRLVLCSGKVYYELDEERRKTERTDVAICRVEQLCPFPYDLIQRELKRYPNAEIV

SEQ ID NO: 19237 - DNA, 1625 bp, Panicum virgatum
  misc_feature: Ceres CLONE 1804752
  misc_feature: Encodes the peptide sequence at SEQ ID NO. 19238
aaacaaaaaggaaaacaaacggcagcacgggaagagcgagaaacgggggctaccttcccagctcccaacagcagcgaccagcgagcgacccacccaggcgcccgctcgccgccgcttccgctcctctcctctccctcctcccccctcccgagggcggctggtcggtctcgccggcgaccccacgtctctctaccccgcctggatccggagacctcgcgcgcgcgctcgcgatctgctaggattccctccggcggggcccaccacccatgccgtcggcggcggcgacctccgcggcggcgctccttttcctccccctcctcgccgccgcgggggagggggcggtctgcccgaggccgcccgccgcagaaaccgtcctgcgccgcgcgcccgtcgcctgcgcggcggcggacgccccggggccccggcgtcgccacgccgccgtcgtggagggtgatgatggggctctgcaaaaggcaatagcacttgtgctgcagaacagggaagattttgttgctattcttttttatgcttcgtggtgtcctttttctaaaattttcaggacagattttcaaaagctatcgtccttttttccgactattgctcatttttctttcgaagaatctcatatcaaaccaagagtattgtcaagatatggagtcagtgccttcccaactcttttccttgtgaactctacaatgcgtgtgcgctatcatggatctcgaaccatgaattcccttgctatgttctataaagatgttacaggtatgaatcctgtgtcattggacacaatatccctggaggcagtggaggatacagtaattataatcgataatgacaaaaagagcaaaaaggaggattctcttttattatgggcaagatcaccagacaggttacttcatcaagatacatgtcttgcattggctagttcttttgtgctcttgaggttgcttcatctccttcttcccaagatcaatgcatgcatgaagcaagcatggaggatgcgactttatgaattgaaaaggttgtttcctagcttgtcttgaggaagtcaatgtggacatggaaacatgaactgattgtctaaacagggcagcatacacataagcgatgcatgcagcaaaccagatcttgagggaggtggggtggtttctgtcaatgtctgctcataagttaatcaacattgttggctcgtggctgactagtgaaaatgatagttctagcagtatatcaccaaggtctcatcaaagatagttctaatagttcagtatatccccaaggtctcatcagtggatgtatcgtattcccttggtcttgactcattctgtgtgactatctgtggtctttccttggaaatgtcctttcaagcttgcgtggtgttcttggaaatgccggcgtgaatggtgatcatctatatcagcggccatctctgtgcaaattcaaatttgtatcttggtcttatcctggataaacaaaaatacaacatgtattctaagaaagatggttcttctaggttagtcgcacatgattgatatgtttgtgattgacaaggggtcactacctaccagttgagctaagctcagttttcgctaatatattctgcaagaggttaaaaccctcatatcctc

SEQ ID NO: 19238 - protein, 258 aa, Panicum virgatum
  misc_feature: Ceres CLONE 1804752
  misc_feature: SWISSPROT Homolog: EC 5.3.4.1 Protein disulfide-isomerase
MPSAAATSAAALLFLPLLAAAGEGAVCPRPPAAETVLRRAPVACAAADAPGPRRRHAAVVEGDDGALQKAIALVLQNREDFVAILFYASWCPFSKIFRTDFQKLSSFFPTIAHFSFEESHIKPRVLSRYGVSAFPTLFLVNSTMRVRYHGSRTMNSLAMFYKDVTGMNPVSLDTISLEAVEDTVIIIDNDKKSKKEDSLLLWARSPDRLLHQDTCLALASSFVLLRLLHLLLPKINACMKQAWRMRLYELKRLFPSLS

SEQ ID NO: 19239 - DNA, 1198 bp, Panicum virgatum
  misc_feature: Ceres CLONE 1804753
  misc_feature: Encodes the peptide sequence at SEQ ID NO. 19240
acacgcacaccacccaccggacctgagcacaccagcaaggacagcaaggaggagcagccatggcctcgtcggtggccgccgcggcgagcacattcctgggcacccgcctggcggacccggcgccgcagaacgggcgcatcgtggcccggttcgggttcggcaagaagccggcggccccgaagaaggcggccaagacgtcgaccatctccgaccggccgctgtggttccccggcgcggtggcgcccgactacctcgacgggtcgctggtcggcgactacgggttcgacccgttcgggctcggcaagccggtggagtatctgcagttcgacctggactcgctggaccagaacctggccaagaacgaggccggcggcatcatcggcacccggttcgagtcctcggaggtcaagtccaccccgctccagccctacagcgaggtcttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcgtcctacctggggcagccgctgcccttctccatctcgacgctcatctggatcgaggtgctggtgatcgggtacatcgagttccagcgcaacgcggagctggacccggagaagaggctctacccggggggctcctacttcgacccgctcggcctgtcggccgacccggagaagaaggagcggctgcagctggcggagatcaagcacgcgcgcctcgccatggtcgccttcctcggcttcgccgtgcaggccgccgccaccggcaagggcccgctcaacaactgggccacccacctcagtgacccgctgcacaccaccatcttcgacacgttcggagcaggatcctcttaagcccgcccgcccgccgccattgctagctccgtccatcgatccaagccttgagttaactgtgatctcggtctcagctatcatacgctggagacgatggatgtgaatccgtccgtggtatcattttgtgatgagtgagagggtgtgggaagatccatcctatcctttgttaatggaggacttgttgattaggagaaccgctgctagctgctgggacttggtgatttgtaatatatgaaccagtgatgatgaattaatgcattcacttgtac

SEQ ID NO: 19240 - protein, 289 aa, Panicum virgatum
  misc_feature: Ceres CLONE 1804753
  misc_feature (60)..(258): Pfam Name: Chloroa_b-bind Pfam Description: Chlorophyll A-B binding protein
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
MASSVAAAASTFLGTRLADPAPQNGRIVARFGFGKKPAAPKKAAKTSTISDRPLWFPGAVAPDYLDGSLVGDYGFDPFGLGKPVEYLQFDLDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLSADPEKKERLQLAEIKHARLAMVAFLGFAVQAAATGKGPLNNWATHLSDPLHTTIFDTFGAGSS

SEQ ID NO: 19241 - DNA, 1253 bp, Panicum virgatum
  misc_feature: Ceres CLONE 1804754
  misc_feature: Encodes the peptide sequence at SEQ ID NO. 19242
accacactcgagtatccatccagtctccactgttcagtggccaacttgtcatgtcctcgtcggccactccatgctcggcggcaccggcgccgccgcacgtcgtcgaggactgcttcggcgtcgtgcagctgctcagcgacggcacggtgcggcggtccacggattactcggcgctcccgctcgtcggcggcgtgccgccggacctgcccgtggagtggaaggacgtcgtctacgacgacacgcacggcctccggctccggatgtaccggcccaccaccaccggcggcggcgggggcggggagaagcagaggaagctgccggtgctcgtgtacttccacggcggcggcttctgcctcgccagcttcgagctgatcaacttccacgccggcgcgctccggctcgccgccgagctcccggcgctcgtgctctccgccgactaccgcctcgcgcccgagcaccgcctccccgcggcgctcgacgacgccgagtccgccttctcctggctccgcgcccaggccacagcgtcccccgccgccgccgacccgtggctcgccgagtcggccgacttcggccgggtgttcgtgatcggcgactccgccggcggcaacatctcgcaccacatctcggtgcgccacggctccggccggctccccctcggccccctccggctcgccgggtgcgtgatgttctggccctacttcggcggcgaggagccgacgccttccgaggcggcgtccccgcccggcgagcccctaggcacggcgctgttcgaccagatgtggcgcctggcgctgccgccgggcgcgaccaaggaccacccggccgcgaacccgttcgcgccggggagcgtcccgctcggcgacctcggcgacgacttcccgccggcgctcgtgctggaccctgaccaggacgcgctgcacgaccgcgtggcggactacgtcgccaggctgagggccgccggcaaggccgtcgagctcgtcgtcttccccgggcaggggcacgcgttcttcgtcacggagccgtgcggggaggcctcggacgagctgatccgggtcgttaggcgtttcgtgcacggtggttaactgatgaattgtaatcttgtctgcgtgtctaataatatgccaatttttaactgcatgcatgtatctttacgcgttttattcagcagttttgaggcctcatttagatacactgtgtaaagtttttgaaacagaattttttcacatttgaaatattaaatatagactaattat

SEQ ID NO: 19242 - protein, 343 aa, Panicum virgatum
  misc_feature: Ceres CLONE 1804754
  misc_feature (92)..(321): Pfam Name: Abhydrolase_3 Pfam Description: alpha/beta hydrolase fold
  misc_feature: SWISSPROT Homolog: EC 3.1.1.3 Triacylglycerol lipase
MSSSATPCSAAPAPPHVVEDCFGVVQLLSDGTVRRSTDYSALPLVGGVPPDLPVEWKDVVYDDTHGLRLRMYRPTTTGGGGGGEKQRKLPVLVYFHGGGFCLASFELINFHAGALRLAAELPALVLSADYRLAPEHRLPAALDDAESAFSWLRAQATASPAAADPWLAESADFGRVFVIGDSAGGNISHHISVRHGSGRLPLGPLRLAGCVMFWPYFGGEEPTPSEAASPPGEPLGTALFDQMWRLALPPGATKDHPAANPFAPGSVPLGDLGDDFPPALVLDPDQDALHDRVADYVARLRAAGKAVELVVFPGQGHAFFVTEPCGEASDELIRVVRRFVHGG

SEQ ID NO: 19243 - DNA, 1592 bp, Panicum virgatum
  misc_feature: Ceres CLONE 1804757
  misc_feature: Encodes the peptide sequence at SEQ ID NO. 19244
tcatcgatcatgagcactcgcaaactacaagctaccaccttatcacaacgcgatcgatcgacccaaccaaaggtagcttaattagtgatcatcgatcactcgagggaggaggagaaaattaaagaaaaaggaagcaggtgctgcggtgaagtggccggtgagggagcgagctgatcgaccatgggtaccatcgggttcccggtgacgaggacgagcaggtcgctggtggcgccgtcgtcggcgacgccgcaggagacgctgcacctgtcggtgatcgaccgcgtggcggggctgcggcacctggtgcggtcgctgcacgtgttcgacggccgccgcggcgaggcggcggtgaggacgccggcggagacgctgcgggcggcgctggggaaggcgctggtggactattacccgctggcggggcggttcgtggaggaggacggggaggtgcgggtggcgtgcacggcggggggcgcctggttcgtggaggcggcggcggcgtgcaccctggaggaggtgaagcacctggaccaccccatggtcatccccaaggaggacctgctgccggagccgacgccggacgtcaaccccctcgacatgccgctcatgatgcaggtgacggagttcgcgtgcggcggcttcctggtgggcctcatctccgtgcacaccatcgccgacggcctgggcgccgggcagttcatcaacgcggtggcggactacgcgcgtggcctcccgaggccccccgtgctccccgtctgggcgcgcgacgtcatcccggcgccgtccacgatcgtgtccccgccgccgcggttcgacctcctggacctccgctacttcaccgtggacctcagcccggagcacatcgccaaggtcaagtccagcttcttcgaggcgacggggcagcgctgctcggcgttcgacgtgtgcgtcgccaagacctggcagtcccgcgtccgcgcgctccggctggacggcgacgacccggcgcggcccgtccacgtgtgcttcttcgccaacacgcggcacctcctgccgcagctggcgcccgggttctacrgcaactgcttctacaccgtgagggcgacgcggccctgckgcgaggtggcggcggccggcgtggtggaggtggtgcgcgccatccgggacgccaaggcgcggctgggcgcggacttcgcgcggtgggcggcgggcgggttcgagcgcgacccctacgagctcaccttcagctacgactcgctcttcgtctccgactggacgcggctggggttcctggaggcggactacgggtggggcgcgccggcgcacgtcgtgccattctcctaccaccccttcatggccgtcgccgtcatcggcgcgccgccggcgcccaagcccggcgcgcgcgtcatgaccatgtgcgtcacggagaagcacctgcccgagttccaggagcagatgaacgccttcgccgccgggaaccaccagtgacgacaacgtgtacgtacgcccatcgccatgatcgatccatccatcgtctagcttgctatgctatatatgcctcaacaactgctgaatggatttgtttgcttgcgtgtaatttggatttcaaattcgcc

SEQ ID NO: 19244 - protein, 427 aa, Panicum virgatum
  misc_feature: Ceres CLONE 1804757
  misc_feature (6)..(421): Pfam Name: Transferase Pfam Description: Transferase family
  misc_feature: SWISSPROT Homolog: EC 2.3.1.167 10-deacetylbaccatin III 10-O-acetyltransferase
  misc_feature (292)..(292): Xaa is any aa, unknown, or other
  misc_feature (305)..(305): Xaa is any aa, unknown, or other
MGTIGFPVTRTSRSLVAPSSATPQETLHLSVIDRVAGLRHLVRSLHVFDGRRGEAAVRTPAETLRAALGKALVDYYPLAGRFVEEDGEVRVACTAGGAWFVEAAAACTLEEVKHLDHPMVIPKEDLLPEPTPDVNPLDMPLMMQVTEFACGGFLVGLISVHTIADGLGAGQFINAVADYARGLPRPPVLPVWARDVIPAPSTIVSPPPRFDLLDLRYFTVDLSPEHIAKVKSSFFEATGQRCSAFDVCVAKTWQSRVRALRLDGDDPARPVHVCFFANTRHLLPQLAPGFYXNCFYTVRATRPCXEVAAAGVVEVVRAIRDAKARLGADFARWAAGGFERDPYELTFSYDSLFVSDWTRLGFLEADYGWGAPAHVVPFSYHPFMAVAVIGAPPAPKPGARVMTMCVTEKHLPEFQEQMNAFAAGNHQ

SEQ ID NO: 19245 - DNA, 1751 bp, Panicum virgatum
  misc_feature: Ceres CLONE 1804758
  misc_feature: Encodes the peptide sequence at SEQ ID NO. 19246
actgcagacgctgaaccgccgccgcctcctcgcccgcaccactccccaagcgcctccccgccggcgccggcgccggaccccgcccgcggccccgcagccagggatcgcgcgaccctgctctacgcgccgccaccggccaggaccgcgcgtggagacgcctcctccccaacagatctagccgccagcagccagagcgagcgtagcctactcctgcctgctcccacggcccccattgctggatcttcaatcgggccgcgcagaatggccgaatcccagctcaaatacccctatttctccggcatttccaaaccctagcccgcctaggttagaggagcaactgagaagattccgagggggcacatcgttggactagaaagcgtgcctgacaatatccgtgtgcagcagctgcttgattgaatgcccctgatgaagcaagctcttccaggaataaggatgtgtagctctaactgccagaagagtggccctgacagaatcagcgccctaccagatgaacttctgcttcatgtcatgtacttcctaaccctgcaggaggcagtgcagacaagcctgctttcacggaggtggaagaatctctgggcatctttgatgtggctcaatttcgacgcggccaagttcagcagcatcagaacttacagaaagtttgtcaacaatgcgctccagtaccgaagctcgttgccgatgctggtgccactggatgcattttggatttctactgtctgcgacaattctgatgattcccttgactattctgacatccagccatggattcaccatgcccttaatagcaaggcctgggctctaggcatactgaagcattccggccccaagcccctttctatggagagttatccctttcctttcacctcggtgtacttgaaaattttaggcctttcccattgttttatagatgactggtttgtccagaatctctcttcctgttgcccggtgttagacgacctagacttgatgagttgtgccatccatgtcaccatgttttcgtcaaccacattgaagagtttggccattaccatcacacaaactgataaagatttccctatagagtttcagtatcttgtgatagatatgccaaacctagtctccctgagcctagaggagattccgagaagaattattcacctcatggatgtgtcatctgtgaaaacagcctcaattttccttttctcactctcttttggacactctcaggttcagtgcagtattctcagtgctctttcaaatgccaccagcttgacgttggtatctccatctgtctatgaagatgtggtgccaaaggtattggggcgtgatcttccaaggtgtgcaacattcagtaaactgaaacgacagcatcttggcgagtggtttctaagtggtgggtgctatccactaatatacttacttcggcgctctccaaacatagaaaaacttatcctgcaacttgacacaggatctggatttggtgactgggtcgtgtgaccatggattagagcttctgacacctggaagacttgttatttctcctcctgatgacagttcctatgacttagctagtgcgactgcctgtgcgcaactaatgtctcctttagcgacttagcgtatttgtttgctgcttttatctttctgatgaccttttttggcccaaaactggacttcaccgttatttcgggaatcgtcttgtagttgtctgtctgccaattcatggcgccatgacttagtggcgcattggagct

SEQ ID NO: 19246 - protein, 356 aa, Panicum virgatum
  misc_feature: Ceres CLONE 1804758
  misc_feature (21)..(67): Pfam Name: F-box Pfam Description: F-box domain
MKQALPGIRMCSSNCQKSGPDRISALPDELLLHVMYFLTLQEAVQTSLLSRRWKNLWASLMWLNFDAAKFSSIRTYRKFVNNALQYRSSLPMLVPLDAFWISTVCDNSDDSLDYSDIQPWIHHALNSKAWALGILKHSGPKPLSMESYPFPFTSVYLKILGLSHCFIDDWFVQNLSSCCPVLDDLDLMSCAIHVTMFSSTTLKSLAITITQTDKDFPIEFQYLVIDMPNLVSLSLEEIPRRIIHLMDVSSVKTASIFLFSLSFGHSQVQCSILSALSNATSLTLVSPSVYEDVVPKVLGRDLPRCATFSKLKRQHLGEWFLSGGCYPLIYLLRRSPNIEKLILQLDTGSGFGDWVV

SEQ ID NO: 19247 - DNA, 938 bp, Panicum virgatum
  misc_feature: Ceres CLONE 1804760
  misc_feature: Encodes the peptide sequence at SEQ ID NO. 19248
cttctctcccccatcgcatccgaatccgatcctcctcgatttcagttgtgagatcgacatggacatgaaggggccgccctcggcgccgccgtccaagaaggcggacgcgcgcactctggtggcgcacgtcctggccgccgccgccgccgcgctggtgctgctctggtgcgtccacttccgcggcggcctggccttccgctccacggccgacaagcagctcatcttcaacgtccaccccgtgctcatgctcctcggccccatcgtcctcggcggcgaggccatcctgtgctaccgctccctcccgctcgcccgcgacgccaggaagaaggcgcacctggcgctgcacgccgcgggcctcgccgccggcgccctcggcgtctacgcggtcttcaagttccacgccgagagcggcatccccaacctctactcgctccactcctgggtcggcatcgccaccatctccctctacgcgatccagtgggctgtgggcttcctcgccttcttcttcccgggcgcctcgccggccaccaggcgcacggccctgccatggcacgccgtcgccggcctcctcgtcttcgtgctcgccgtcggcacggcgcagctcggcttcctcgagaagctcaccttcctgcagggcccgcccctgcgcctgcccaagtacggcgccgagacgatgctcgtcaacttcacggcgctcgttgtgctcctccttggcgtcgccgtcgtgctcgccacggtcaccatcgacggcacaaggtccaacaccatcatgtaaaatcaaagagacatgcatatatacatgcatgcggctagtgtattgagtgcgcgcgcgcgcgctgtacgtacaaattagttagtattgatgatttgtattaattattactctgtactacatactctccgatgtatatatgtgtatatatatatacatgttaatt

SEQ ID NO: 19248 - protein, 238 aa, Panicum virgatum
  misc_feature: Ceres CLONE 1804760
  misc_feature (19)..(238): Pfam Name: Cytochrom_B561 Pfam Description: Cytochrome b561
MDMKGPPSAPPSKKADARTLVAHVLAAAAAALVLLWCVHFRGGLAFRSTADKQLIFNVHPVLMLLGPIVLGGEAILCYRSLPLARDARKKAHLALHAAGLAAGALGVYAVFKFHAESGIPNLYSLHSWVGIATISLYAIQWAVGFLAFFFPGASPATRRTALPWHAVAGLLVFVLAVGTAQLGFLEKLTFLQGPPLRLPKYGAETMLVNFTALVVLLLGVAVVLATVTIDGTRSNTIM

SEQ ID NO: 19249 - DNA, 980 bp, Panicum virgatum
  misc_feature: Ceres CLONE 1804762
  misc_feature: Encodes the peptide sequence at SEQ ID NO. 19250
attcccactccctctcgcctccgcacagacccgtcagacaccccgtccctccctcctcgccgtggaaccaacgcccagcgcgcgcgcgcgcgagcacgagaacccccaccgcgtatggaagttgctgcggcgaagcaactcctccccatggcgcggggccccaactccccgtcctcgtccacctcctcctcctccccgtcctccgccgcctccccgtcgccgcgccagccgcagtcccagcccgtcccgccgtcgcccaagcccgtgccgcgcatcatcgacaccacgcccttcccgaccaccttcgtgcaggccgacaccaccaacttcaagcaggtcgtgcagaggctcaccggctccgacacgccgccgtcggcccagaacaagcccgccaagacccaccaccaccaccaccacggcgccagcggcctcgccggcgggcccaagaagccggccttcaagctctacgagcgccggatcggcaagaacaacctcaagatgatcgcgccgctggcgatggccgcggccgcggccgcgggggcgtcgccgcggaagccgggccccgaggtgctgtcgcccagcgtgctcaacttcccgtccctggcgctcgggagccccgtcacgccgctggtgtcggaccccttcaaccggtcgccggcgtccgcgtcgccgggcgaggaggccgccgagcgcgcggccatcgcgcgcaagggcttcttcctgcacccgtccccgagggccgccgagccgccgcggctgctgccgctgttccccgtcacgtcccccaggatggcgccctccgccgccgccgccgcggcgccgtcgtcgcagtgaccgggcaccgcgctgccggagaattcctagtatttgcgtgagaaacttgctgtttaactactccttgcgtgatgtaatttttgctcatactagtcctgaaccgatcgccaagaaacggaaagaagaatcacactcttgagcttctc

SEQ ID NO: 19250 - protein, 239 aa, Panicum virgatum
  misc_feature: Ceres CLONE 1804762
  misc_feature (58)..(88): Pfam Name: VQ Pfam Description: VQ motif
MEVAAAKQLLPMARGPNSPSSSTSSSSPSSAASPSPRQPQSQPVPPSPKPVPRIIDTTPFPTTFVQADTTNFKQVVQRLTGSDTPPSAQNKPAKTHHHHHHGASGLAGGPKKPAFKLYERRIGKNNLKMIAPLAMAAAAAAGASPRKPGPEVLSPSVLNFPSLALGSPVTPLVSDPFNRSPASASPGEEAAERAAIARKGFFLHPSPRAAEPPRLLPLFPVTSPRMAPSAAAAAAPSSQ

SEQ ID NO: 19251 - DNA, 1221 bp, Panicum virgatum
  misc_feature: Ceres CLONE 1804765
  misc_feature: Encodes the peptide sequence at SEQ ID NO. 19252
attcagatccgccactattcttcttcatttcttcttccacagctagctagctagcagccggtgggtgcagcagcagcagcagcagcaggacaccgatccgcccgactacaagcaaggatgctggccatcttccagaagcaggtggcgcacgcgccgcaggagctcaacagcccccggagcggcggcgccgccaagcccaggagccccgacgagatcctccgggacttccacgccgcgcaccccgccgacgccttctccacctccttcgggggcggcgccgcgctcgcctgcgtcggcgcgcgcgcctgccctgctgccggggccggccaccaccagcgcatgttctgcggcctcgacgacatctactgcgtcttcctcggccgcctcgacaacctcagcgccctcatccgccagtacggcctctgcggcaagtccaccaacgaggcgctgctcgtcatcgaggcctaccgcaccctgcgcgaccgcgggccctaccccgccgaccaggtcgtcaaggacctcgccggatcattcgccttcgtcgtcttcgacaacaagtccggcgccgtattcgcagccctgagcgccgacggcggcgttccgctcttctggggcatcgcggcggacggctccgtggtgatctgcgaggaccgggagatcgtcaagcgcgggtgcggcaagtcgtacgcgcccttccccgtggggtgcatgttccacagcgaaggcggcctcaagagcttcgagcaccccatgaacaggctcaaggcgatgccccgggtcgacagcgagggcgtcatgtgcggcgccaccttcaaggtcgacaccttcaccaagatcaactccatgccgcgcgtcggcagcgcaaccaactgggccgccgcatgggacgacaaagccatctagagctgctagctactagtagaacatcatatcttttcacacactctttttttcaatcaaatcaagagcgccgctgctagccatgtgccctttctttcttgttttcttcctttttcgtcgcccgctatatatgctagctgctgctttaatttttccttccgatccactacactaatgtatctcaagaccacgtacggaagcatgccgcctttgttttactgcttgatgtcgtcctcttcctccttgtgttggcacattgtacatttccctgtgcttgtggacttggctgttgaacatgatcaataacagtttgtttgcctc

SEQ ID NO: 19252 - protein, 261 aa, Panicum virgatum
  misc_feature: Ceres CLONE 1804765
  misc_feature: SWISSPROT Homolog: EC 6.3.5.4 Asparagine synthase (glutamine-hydrolyzing)
MLAIFQKQVAHAPQELNSPRSGGAAKPRSPDEILRDFHAAHPADAFSTSFGGGAALACVGARACPAAGAGHHQRMFCGLDDIYCVFLGRLDNLSALIRQYGLCGKSTNEALLVIEAYRTLRDRGPYPADQVVKDLAGSFAFVVFDNKSGAVFAALSADGGVPLFWGIAADGSVVICEDREIVKRGCGKSYAPFPVGCMFHSEGGLKSFEHPMNRLKAMPRVDSEGVMCGATFKVDTFTKINSMPRVGSATNWAAAWDDKAI

SEQ ID NO: 19253 - DNA, 1070 bp, Panicum virgatum
  misc_feature: Ceres CLONE 1804767
  misc_feature: Encodes the peptide sequence at SEQ ID NO. 19254
acacagcaactcccgcgccacaagctttcgctgccatggcactcgtctcggcctcctcctcctcctccaccgccgtcgcggcgctccccaggaatgggcagcgggcgccgtccttcctcggcggcaagacgctgctgaggcaggccgaggcggcgcggccatcgttcgccgtgcgagccgcggcggaccccgacaggcccatctggttccccggcagcaccccgccgccgtggctcgacggcagcctccccggcgacttcggctttgatccctggggcctcggatctgacccggagagcttgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggccgacatcatcaagcccgggagcgtcaacaccgaccccatcttccccaacaacaagctcaccggcaccgacgtcgggtaccctggtggcctgtggtttgacccgctcggctggggcagcggctcgccggagaagatcaaggagctgcgcaccaaggagatcaagaacggccgcctcgccatgctcgccgtcatgggcgcctggttccaggccgagtacaccggcaccggccccatcgacaacctcttcgcccacctcgccgaccccggccacgccaccatcttccaggccttcacccccaaatgaggagttggagttagcgatttgagattgcgaccaagcatgcatgggggtggagattgttaggttgatggtcgatcgatgcgacttttttctgtttgtggggcggaagactgtccatgcatgatgattgaatggtttgtggagcgatgcatgcctgttgatcgtgcacttgtactgtgttgtaaccaatgtaaaaatgcaatactcgttagatgctatgctctgtcactgaagcaacgacgacttgatgatttgtgc

SEQ ID NO: 19254 - protein, 259 aa, Panicum virgatum
  misc_feature: Ceres CLONE 1804767
  misc_feature (62)..(230): Pfam Name: Chloroa_b-bind Pfam Description: Chlorophyll A-B binding protein
  misc_feature: Functional homolog of the protein sequence given in SEQ ID NO 50113
  misc_feature: Useful for making plants with modulated oxidative stress sensitivity
  misc_feature: Functional homolog of the protein sequence given in SEQ ID NO 50109
  misc_feature: Useful for making plants with modulated nitrogen use efficiency
MALVSASSSSSTAVAALPRNGQRAPSFLGGKTLLRQAEAARPSFAVRAAADPDRPIWFPGSTPPPWLDGSLPGDFGFDPWGLGSDPESLRWNVQAELVHCRWAMLGAAGIFIPEFLTKIGILNTPFWYTAGEQQYFTDTTTLFIIELILIGWAEGRRWADIIKPGSVNTDPIFPNNKLTGTDVGYPGGLWFDPLGWGSGSPEKIKELRTKEIKNGRLAMLAVMGAWFQAEYTGTGPIDNLFAHLADPGHATIFQAFTPK

SEQ ID NO: 19255 - DNA, 1097 bp, Panicum virgatum
  misc_feature: Ceres CLONE 1804768
  misc_feature: Encodes the peptide sequence at SEQ ID NO. 19256
actagtggttgatatctatattaagacctcacctacttatactacgcaacaacagctgcagagtaagctcgcagttgcaaagctccagagatcaggcagcagcaatggccagctcggttgcaaacactactagtagcaagcgccgccgcctcctcctgctcctcgccgccgccgtggctctgacgatcctggcgccgccgccggtgtcggcactacggcgccgcgctgtgcatctgacggtgtacgtccaggagatcctggacgggccggggcagacggagaagctgctgatcaagggccccggcccggcgaacccgtccctgtggcccccgcacaactacttcggcgacacgatcgtgatggacgacctcgtcaccgaggccgtcgccaacaactccaagcccatcggccgcgtgtacggcatctacatgacggcctccatgacccgcccggtgtacacggtgagcttcacgctgcatctcaccgcggggccctacaacgggagcacgatcgtgatggccggcatcgacgacgacgacatgggggtcagggagcacgccgtggtgggcggcaccggcgcgctccggggcgccgagggctacgtgtttggcatcgtcaagccgtttacgtcctcgtacgtagtgatggagctggacatttacatgaccgtgccggtgccggtgccgaggcccaaagccagagcggctgctgcctcccctctcataaccgaccagtgatccaccactagcttgctactcaataatcgatcattgcattgtgccctactgccctttgcttcgatgggtacgtacgtgttagcgctgcgcctctctcgtgctgctacaccaacaagcaaggtgagaaataaaataaatatatttcgcctcctccacccaagcagctgagctccggttgaataattcttgtaccccttggtgtccagctagtttttcggttttgcaagatgtaggcatggctggttgttaggccatgcagtttgtggagctctgagtcgcgctgccttcagttgtaaacttttcctttatatataattaagcaatgatcaagggtgaaaaatgctgctaagtttgcggcac

SEQ ID NO: 19256 - protein, 210 aa, Panicum virgatum
  misc_feature: Ceres CLONE 1804768
  misc_feature (16)..(189): Pfam Name: Dirigent Pfam Description: Dirigent-like protein
MASSVANTTSSKRRRLLLLLAAAVALTILAPPPVSALRRRAVHLTVYVQEILDGPGQTEKLLIKGPGPANPSLWPPHNYFGDTIVMDDLVTEAVANNSKPIGRVYGIYMTASMTRPVYTVSFTLHLTAGPYNGSTIVMAGIDDDDMGVREHAVVGGTGALRGAEGYVFGIVKPFTSSYVVMELDIYMTVPVPVPRPKARAAAASPLITDQ

SEQ ID NO: 19257 - DNA, 430 bp, Panicum virgatum
  misc_feature: Ceres CLONE 1804778
  misc_feature: Encodes the peptide sequence at SEQ ID NO. 19258
  misc_feature (367)..(367): n is a, c, t, g, unknown, or other
aaaaaaacctctgccttccattgccaaagcctcacgaatggacgccagcagcgggagcatgcacgttctgatgctgccatggctggccttcggccacatcatccccttcaccgagctcgccaagcgcatcgctcgccagggccaccgcgtcactctgctctcgacgccaagaaacactcaacgactcatccgcattcctccggacctggccggccttgtccgtgtcgtggacataaagctgccgcgcgtgcagcgcctgccggagggcgccgaggcgagcatcgacctcccgtccgacgacctccgcccgtacctccgccgggcctacgacgccgccttcgccgagaagctttcggacatcctgcangacgccgggccggggaggccgaactgggtcctcatcgactacgccgcgcactgggcgcccgcg

SEQ ID NO: 19258 - protein, 130 aa, Panicum virgatum
  misc_feature: Ceres CLONE 1804778
  misc_feature: SWISSPROT Homolog: EC 2.4.1.115 Anthocyanidin 3-O-glucosyltransferase
  misc_feature: Functional homolog of the protein sequence given in SEQ ID NO 50846
  misc_feature: Useful for making plants with altered carbohydrate content
  misc_feature (110)..(110): Xaa is any aa, unknown, or other
MDASSGSMHVLMLPWLAFGHIIPFTELAKRIARQGHRVTLLSTPRNTQRLIRIPPDLAGLVRVVDIKLPRVQRLPEGAEASIDLPSDDLRPYLRRAYDAAFAEKLSDILXDAGPGRPNWVLIDYAAHWAP

SEQ ID NO: 19259 - DNA, 681 bp, Panicum virgatum
  misc_feature: Ceres CLONE 1804778-R
  misc_feature: Encodes the peptide sequence at SEQ ID NO. 19260
gcagcgccgagttcgagccggagtggctgcgggtgctcggcgagctctaccggaagccggtgatcccggtcgggctgttccctccgccgcccgcacaagacgtcggcggccacgaggcgacgctgcaatggctggacaggcaggcgccgggatccgtcgtgtacgcggccttcggcagcgaggccaagctgacaggcgcacagctgcagacaatagcgctcggcctcgaggcttccggcctgccgttcctctgggcattcaggccgccggtcgacgccgacgaaggcgaaagcgggttgccggagggcttcgaggagcaggtcagcggccgagggctcgtgtgccgcggctgggtgcctcaggccaggttcttggcccatggatcgatcggggcgttcttgacccacgccggctggaactccatcaccgaaggcctcgcccgcggcgtcaggctggtgctcctaccactgatgttcgatcagggcctcaacgcgaggcttctggtggagaagaaggtaggcgtcgaggtggcgcgagacaaggacggctctttcgcgccaaaagacattgccgctgccttgaggaaggtcgtggtggaagacgaaggcgaggtgttcggggataaggttaaagagctcgccaaggtgtttggaaatgatgaagtgaatgatcggtgcgtgc

SEQ ID NO: 19260 - protein, 226 aa, Panicum virgatum
  misc_feature: Ceres CLONE 1804778-R
  misc_feature: SWISSPROT Homolog: EC 2.4.1.238 Anthocyanin 3'-O-beta-glucosyltransferase
SAEFEPEWLRVLGELYRKPVIPVGLFPPPPAQDVGGHEATLQWLDRQAPGSVVYAAFGSEAKLTGAQLQTIALGLEASGLPFLWAFRPPVDADEGESGLPEGFEEQVSGRGLVCRGWVPQARFLAHGSIGAFLTHAGWNSITEGLARGVRLVLLPLMFDQGLNARLLVEKKVGVEVARDKDGSFAPKDIAAALRKVVVEDEGEVFGDKVKELAKVFGNDEVNDRCV

SEQ ID NO: 19261 - DNA, 933 bp, Panicum virgatum
  misc_feature: Ceres CLONE 1804783
  misc_feature: Encodes the peptide sequence at SEQ ID NO. 19262
agccagctcccagctctcctctcacactgctccactccctcacctagaagagaccacagaaccggatccagagcagagcgtgttgcgccggcctagctcttgggtcgtcaagtctccgttcgttctttctttctccaaccggcagctgatctcctgtgttaatcccgaccggagctgcctgcgatgggcatcgtcgacgtcgtctccgtgttctgcaccctgccgaggactcgccggcacctcaagaagaggaagcagttccagacggtggagatgaagatgcggatcgactgcgaggggtgcgagcgcaaggtgagcaaggcgctggagggcatggagggcgtgagctccgtggaggtggcgccgcggcagcacaaggtgacggtggccgggtacgtggacgccggcaaggtgatgcggcggttggcgcggcggacgggcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgcctgcgccgtcatgtaggagtagctagtagccggggaggagtagtagatagagtagcaagttgctgctggtgtttgttgctgttggatcattttttttcctactttatattctctgctacgcttgtgtgcgctctagttggatgttgatttggaaatccttagtggtagtaagtaaggcttgtaaaggctagctagtagtagtgtttgttgccttgttgatctctgtttcatttctgcaaaggaagatattttgacaaacgacagtagatattatcaaagctgcattatggaggct

SEQ ID NO: 19262 - protein, 156 aa, Panicum virgatum
  misc_feature: Ceres CLONE 1804783
  misc_feature (29)..(91): Pfam Name: HMA Pfam Description: Heavy-metal-associated domain
  misc_feature: Functional homolog of the protein sequence given in SEQ ID NO 50155
  misc_feature: Useful for biocontainment applications
MGIVDVVSVFCTLPRTRRHLKKRKQFQTVEMKMRIDCEGCERKVSKALEGMEGVSSVEVAPRQHKVTVAGYVDAGKVMRRLARRTGKRVEPWPYVPYDVVAHPYAPGAYDKKAPPGYVRNVVADPAAAPLARASSTEVRYTAAFSDENPNAACAVM

SEQ ID NO: 19263 - DNA, 1046 bp, Panicum virgatum
  misc_feature: Ceres CLONE 1804791
  misc_feature: Encodes the peptide sequence at SEQ ID NO. 19264
aacccttttcctcgaggcagcaacaccgcaacggcagcaaggattccccaattccccatctcccgtctagcacgcgcttcccatcggaatccatcgccatggcctcggcaccgacgccgccgcccctcctcccggtgaccaactccgcccccggatcgtcccctgccaccgccggcggctccgacgcgccgatcgcgcagccggccttccgtctcttcctgagccgggtctccgactcggctcggcgttcgctgtccgaccgccggccgtggggggagctcctcgaccgctcggcgttctccaagccggactccgtctccgacgccacctcccgcctgcgccgcaacctcgcctacttccgcgtcaactacgcctccgtggtcgccttcgcgctgggggcctcgctcctggcgcaccccttctcgctcctcatcctcctgggcctcctcgccgcctggtgcttcctctacctcttccgcgcctccgaccagcccgtcgtcctcttcggccgcaccttctccgaccgcgagacgctgatggggctcgtcggcgcgtccttcgtcctgctcttcttcacctccgtcgcgtcgctcatcatctccgggctgctcgtcggcggggccctcgtcgcggcgcacggcgcgttccgcgtgcccgaggacctcttcctcgacgagcccaacgcggctgcagggaacagcgctgcccaaggtctgctgtccttcctcggggcacccggatctggcgtttgaggcggcggacggcaagatctggtaggattttgcgctcgagaagttcatctaagctggaaattgtgtggatctagtcctgtagctgtagcttattgtttacccctattagtattgtgtacctacagatctacgggcttagtgttggtttcaatcgatgcatcggcttttgcaaagacttgcaaatctatcctgagattttactactcgattcgatttagtgctaagtatttgagtaatgtgagttcatgatgtcgagttatcaatacaaatggtgttatgaactgatgatatagt

SEQ ID NO: 19264 - protein, 217 aa, Panicum virgatum
  misc_feature: Ceres CLONE 1804791
  misc_feature (47)..(200): Pfam Name: PRA1 Pfam Description: PRA1 family protein
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
MASAPTPPPLLPVTNSAPGSSPATAGGSDAPIAQPAFRLFLSRVSDSARRSLSDRRPWGELLDRSAFSKPDSVSDATSRLRRNLAYFRVNYASVVAFALGASLLAHPFSLLILLGLLAAWCFLYLFRASDQPVVLFGRTFSDRETLMGLVGASFVLLFFTSVASLIISGLLVGGALVAAHGAFRVPEDLFLDEPNAAAGNSAAQGLLSFLGAPGSGV

SEQ ID NO: 19265 - DNA, 1099 bp, Panicum virgatum
  misc_feature: Ceres CLONE 1804803
  misc_feature: Encodes the peptide sequence at SEQ ID NO. 19266
ccgccgctctcccctcccaaaccccgcgcgcccatatcctagggtttcccgatctcctccccctccccttccccttccccctccgccgcgggtcgccggcgaggagagcatcgccgcgatgttggagctacggttggtgcaggggagcctcctcaagaaggtcctggaggcgatccgcgacctggtcaccgaggccaacttcgactgctccgggaccggcttctcgctgcaggccatggactccagccatgtcgcgctcgtcgccctgctcctccgcgccgaggggttcgagcactaccgctgcgaccgcaacctctccatgggcatgaacctcaacaacatggccaagatgctccgctgcgccggcaacgaagacatcatcaccatcaaggccgacgatggatccgacaccgtcaccttcatgttcgagtcgcccaagcaagataagatcgcggacttcgagatgaagctcatggacatcgatagcgagcaccttggcatcccggattccgagtaccaggccatcgtccgcatgccgtctgctgagtttatgaggatctgcaaggacctcagcagcatcggggacacagttgtcatctcggtgactaaagagggcgtcaagttctcaacgtcgggagatattgggagtgcaaacattgtctgcagacagaaccaaactgttgacaagccagaagaagctaccattatagagatgcaagaaccagtttccttgacgtttgccctgaggtacatgaactccttcaccaaagcatctacactgtctgatcaagtgactatcagcctttcatccgagctaccggtggtggttgagtacaagatcgcggagatgggctacattagattctacctggcgccaaagattgaggaagatgaggaaatgaagccttgatgacaacaatatgaagcctatgtttccctgtcttccaaccatcgtttgcttagctattgtttgcaagcaaaaaaggatgttatgtgttactatttcttaggccagactgcttagctacttgcatttgtgattgccctgtgaatccatggatttacagtgaatctagattagtgggcttgtgttttgcgc

SEQ ID NO: 19266 - protein, 263 aa, Panicum virgatum
  misc_feature: Ceres CLONE 1804803
  misc_feature (127)..(254): Pfam Name: PCNA_C Pfam Description: Proliferating cell nuclear antigen, C-terminal domain
  misc_feature (1)..(125): Pfam Name: PCNA_N Pfam Description: Proliferating cell nuclear antigen, N-terminal domain
MLELRLVQGSLLKKVLEAIRDLVTEANFDCSGTGFSLQAMDSSHVALVALLLRAEGFEHYRCDRNLSMGMNLNNMAKMLRCAGNEDIITIKADDGSDTVTFMFESPKQDKIADFEMKLMDIDSEHLGIPDSEYQAIVRMPSAEFMRICKDLSSIGDTVVISVTKEGVKFSTSGDIGSANIVCRQNQTVDKPEEATIIEMQEPVSLTFALRYMNSFTKASTLSDQVTISLSSELPVVVEYKIAEMGYIRFYLAPKIEEDEEMKP

SEQ ID NO: 19267 - DNA, 465 bp, Panicum virgatum
  misc_feature: Ceres CLONE 1804807
  misc_feature: Encodes the peptide sequence at SEQ ID NO. 19268
cgccccaaaccctagccttcctcccgctgcgccgccgacggtaagacccaagagaacccttcctcctcttcctcctgcgtgattaggagccggagccagaagagggatctgcgatggcccagtccaagaaccccccggcgcccaacccgtcctaccaggcgcacaagaacggcatcaagaagcccaagcgccaccgtcagacctcccctaacgggatggaccccaagttcctgaggaacctgaggtactcgaggaagaacaacaagaagagtggtgaggctgaggctgagtaaactggtggaatttcagatgatgaattcctgtcttgtatcgctaggatcttgaacttaatgctctgttctgtatgaccaaaggagattcctcagttggtaccattttttttttgtcttgctgtctggctggatttgaattaaaaccgtcatttgcagccttatgagaattcgg

SEQ ID NO: 19268 - protein, 59 aa, Panicum virgatum
  misc_feature: Ceres CLONE 1804807
  misc_feature (3)..(42): Pfam Name: Ribosomal_L29e Pfam Description: Ribosomal L29e protein family
MAQSKNPPAPNPSYQAHKNGIKKPKRHRQTSPNGMDPKFLRNLRYSRKNNKKSGEAEAE

SEQ ID NO: 19269 - DNA, 1015 bp, Panicum virgatum
  misc_feature: Ceres CLONE 1804808
  misc_feature: Encodes the peptide sequence at SEQ ID NO. 19270
cccaccacagtccgcagcagcagctagcgaccggtctcagcaaccctccttcgcctcacgcaatggccgcctccaccatggcgatctcctccccggcgatggccggcacccccgtcaaggtgggctccttcggcgagggccgcatcaccatgcgcaagaccgcggccaagcccaaggtggcggcgtccggcagcccgtggtacggccccgaccgcgtcaagtacctcggccccttctccggcgagcccccgagctacctgaccggcgagttccccggcgactacggctgggacaccgcggggctgtccgccgaccccgagaccttcgccaagaaccgcgagctggaggtcatccactcccggtgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctgatccacgcccagagcatcctcgccatctgggcctgccaggtcgtgctcatgggcgccgtcgagggctaccgcattgccggcggcccgctcggcgaggtcgtcgacccgctctaccccggcggcagcttcgaccccctcggcctggctgacgaccccgaggccttcgccgagctcaaggtcaaggagctcaagaacggccgcctcgccatgttctccatgttcggattcttcgtccaggccatcgtcaccggcaagggcccgctcgagaacctcgccgaccacctcaccaacttcgtccccggcaaataagctccgatccattggctctgcaacttcattgtcttccggagggggcgtacgtggatccattgatgctgcaagctgctgcatgtgtgtctcttgtttcacgttattgcatttcaggggcaagtcgagatgatgagttggcgttgtacactaagatgaaagatgatgtttgtgcaatagtagtgattttgttccctggggtt

SEQ ID NO: 19270 - protein, 250 aa, Panicum virgatum
  misc_feature: Ceres CLONE 1804808
  misc_feature (61)..(229): Pfam Name: Chloroa_b-bind Pfam Description: Chlorophyll A-B binding protein
MAASTMAISSPAMAGTPVKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLTNFVPGK

SEQ ID NO: 19271 - DNA, 1191 bp, Panicum virgatum
  misc_feature: Ceres CLONE 1804814
  misc_feature: Encodes the peptide sequence at SEQ ID NO. 19272
ctcggagatgctctaactccctgctctctagaaatttctcttctgctcctccttcccctcgcgagcgctctctcctctgcttcccctttcctccccacgactctgcccgcctctagggttttgctcccgatcgaaatggtggaggtggaggaggtcgggaacaagatgcggtctcagatgcgcctccatccggagccggaggacgacgccgacctcccgctccccgccctcttcgaccgggcgtcccggctccacggcctcgcctccaactccgcactcgaccaggaagggatccggaagggggtcgagctgctgcggcgctgcgacgagatggtcagcaagctcggcctcttctccaccaacgagaccaaggaagacgtctccaccgccaacctcaaatacctgctcgtcccatactacctaggggaaatgactgagaagatcgcacaggaggacaggatcccaattcttaaggcgtcacagaaccatttgaaggaattcattgctctatgtgaagtactggagcttattccagaggatgagcttgaattatctagacagaagcaacctgatactatggcaaacagaagagcacagaagattgcccggttcaaacgtcaaaaagatgcagaaatgaagctccaagagattaaagagagaaaagaaaggcgtgggcgctcattgagggcttctgctttatctgctcctgttgaagctggggaggaagatgccttggaggatgatggggaggaggaaagagaggcttggttagctactatctcactggctctctgcaaggcctttgatcttctcgacatgctaaagaaggaagaagaaatgcttctagatgtaaaggaaagacaggaaaaggatgggaatgcatttgctcgtgaaatgcttgatgagcgtacacaaaaagctgaagcatggcaccagaatgctgcaaaccgtgcaccatattccaaaccagctgatccaatcacttgcgcaacatttgctcaagatgtccttgaaggtagagcaagtgtttcacaagctcatgagcacaaacaccaacccctgatatttggacctgcaagtcttgttggtggaggactaaccactgaaagggaaagaacggcagcaaaagttttccagcctggttacaggctgccaacaatgagcatagaagaagccggtttacgcgaaatg

SEQ ID NO: 19272 - protein, 351 aa, Panicum virgatum
  misc_feature: Ceres CLONE 1804814
  misc_feature (27)..(351): Pfam Name: TAP42 Pfam Description: TAP42-like family
  misc_feature: Functional homolog of the protein sequence given in SEQ ID NO 50847
  misc_feature: Useful for making plants with modulated biomass
MVEVEEVGNKMRSQMRLHPEPEDDADLPLPALFDRASRLHGLASNSALDQEGIRKGVELLRRCDEMVSKLGLFSTNETKEDVSTANLKYLLVPYYLGEMTEKIAQEDRIPILKASQNHLKEFIALCEVLELIPEDELELSRQKQPDTMANRRAQKIARFKRQKDAEMKLQEIKERKERRGRSLRASALSAPVEAGEEDALEDDGEEEREAWLATISLALCKAFDLLDMLKKEEEMLLDVKERQEKDGNAFAREMLDERTQKAEAWHQNAANRAPYSKPADPITCATFAQDVLEGRASVSQAHEHKHQPLIFGPASLVGGGLTTERERTAAKVFQPGYRLPTMSIEEAGLRE

SEQ ID NO: 19273 - DNA, 506 bp, Panicum virgatum
  misc_feature: Ceres CLONE 1804819
  misc_feature: Encodes the peptide sequence at SEQ ID NO. 19274
ggcgggcgggctgcggcgccccctggcgacggcggcgacggcgggggccgcggaggcgcgggcggccatcttcggccacgcgctgaacccgacggggaagcgcgcgkccmcraagctgctgcggaagaagatgatcggcgaccrggtcgcscagtggtacccctacsacytcaagcgcgacsacccgctcgtcatggcgcgcgaggagaaggagcgtctttcywwgctggaaatgttgaaacgtcgcggcctagggtccgcccaagaagggccwgggcaggcgtgctgtcaagagaagcaaataatcgmcaawctgatgcccagttctatttcgggcgtttgccttgtttcatcratgctgtaacgtttcttgggtgacccatatatgaagaaaccctattgttaattgtttgcataatctastctacgactgcttttswatgaaattttcttccatgttttgaagacmatccgcggcccccaaaataacaaaaagaagcaaaaaa

SEQ ID NO: 19274 - protein, 120 aa, Panicum virgatum
  misc_feature: Ceres CLONE 1804819
  misc_feature (10)..(89): Pfam Name: Mit_rib_S27 Pfam Description: Mitochondrial ribosomal subunit S27
  misc_feature (36)..(36): Xaa is any aa, unknown, or other
  misc_feature (37)..(37): Xaa is any aa, unknown, or other
  misc_feature (48)..(48): Xaa is any aa, unknown, or other
  misc_feature (56)..(56): Xaa is any aa, unknown, or other
  misc_feature (57)..(57): Xaa is any aa, unknown, or other
  misc_feature (61)..(61): Xaa is any aa, unknown, or other
  misc_feature (75)..(75): Xaa is any aa, unknown, or other
  misc_feature (103)..(103): Xaa is any aa, unknown, or other
  misc_feature (104)..(104): Xaa is any aa, unknown, or other
AGGLRRPLATAATAGAAEARAAIFGHALNPTGKRAXXKLLRKKMIGDXVAQWYPYXXKRDXPLVMAREEKERLSXLEMLKRRGLGSAQEGPGQACCQEKQIIXXLMPSSISGVCLVSSML

SEQ ID NO: 19275 - DNA, 1084 bp, Panicum virgatum
  misc_feature: Ceres CLONE 1804847
  misc_feature: Encodes the peptide sequence at SEQ ID NO. 19276
actgatttttctccgacaatctcgccgatggaccagttccggccgctcaggcggatccaggtggagcccgagcccgcgcagccggcgccgccggctgcgggagctggcggggacgcggagcgggatgagtctccggcgcccgcggcggggctgctcatgggggccaaggtgaggcgccgcgcggcggtgtaccgcgactgcaagggcgactacatcggcgtccccaacgatccctgcctcaccaagatcctctccaagcaaggggacaacaaagttctgtttgcagacaaggtattgaagttcactcaatcaggaaagatgaaaaggcgcatcctggtgatcacagactttgctctataccttgttgatcctgatgctgatatattgaagaggagaatagcacttgcagccgtggataagctatgcattagcaacctcagcgataacctctttgcgatcattgtgccgactgagtatgattgtttaatggccagcactagaaagaaggaaattgttaatgtcatagttaaggctatcaagagcacttctgagtatgaacctgaggtgacttcctctaacagatttgagtatcatgcagctgcggaagtgattaaggtggtcgaatttgaggatgttgacggaggcattaaaaccaggatcacaaacaaggagaagtcatgaaccagaactcatggatagtggttccctgtaaactgtatagctctttcagtttcaaacgggtgttatcttcacatttgcatatgtatacgcaaagagaattcttttgttgtgctttgtatttttactagatatacgtgtgtcagcgcctcactctgtggagccctgggcttggatgagttcaggcaagtattgctactgctaaaccccgagtgccatggactacaggaaaatcctactgaactagagtgacgtatttcatgggccttggctccgccttaggctcggggcactggccgcttcacaaagcaaatacgtatcagcaagggcaactatgcatttaagctatggctgtaccactgtaccttttttgaccatatcaagggagaagttcactttgaacatc

SEQ ID NO: 19276 - protein, 217 aa, Panicum virgatum
  misc_feature: Ceres CLONE 1804847
  misc_feature (31)..(214): Pfam Name: Myosin_TH1 Pfam Description: Myosin tail
MDQFRPLRRIQVEPEPAQPAPPAAGAGGDAERDESPAPAAGLLMGAKVRRRAAVYRDCKGDYIGVPNDPCLTKILSKQGDNKVLFADKVLKFTQSGKMKRRILVITDFALYLVDPDADILKRRIALAAVDKLCISNLSDNLFAIIVPTEYDCLMASTRKKEIVNVIVKAIKSTSEYEPEVTSSNRFEYHAAAEVIKVVEFEDVDGGIKTRITNKEKS

SEQ ID NO: 19277 - DNA, 1201 bp, Panicum virgatum
  misc_feature: Ceres CLONE 1804857
  misc_feature: Encodes the peptide sequence at SEQ ID NO. 19278
atcgctcaagctccaagcaagaagagccagcagaaatcactcggttaagaacacacccacaccaatctccattagaaattttagtattggattggagccaccaccaccaccaccaatggcttgttccaccgcatctctagcggcgacgctgctggcgttcgcgctgctgttccaggcctgcctcgccgggaggcggctcaccgcgctcgtgcaggagccggccatcaccatgaagtaccacaagggcgcgctcctgtcgggccgcatcgccgtcaacttcatctggtacggcaacttctccgcgccgcagcgcgcggtcatcaccgacttcgtctcgtcgctgtccgcggccccggcggcggggcagccggagccgtccgtcgccacctggttcgggacggcgcgcaagtactacgccagctccaaggcgcggttcccggcgctgcgcgtcggctcccacgtcctcgacgcgtcctactccctcggcaagcggctcacggacggcgacctcctcaagctcgccgccaggggtgccccgagccgcgccatcaacgtggtgctcaccgccgacgacgtcgccgtggacgggttctgcatgtcccggtgcggcacgcacggcgcgtccccgcggtcgcgctccggccggttcgcgtacgtgtgggtgggcaacccggcgacgcagtgccccggccagtgcgcgtggccgttccaccagcccgtgtacggcccgcaggcggcgccgctcacgccccccaacggcgacgtcggggccgacgggatggtgatctcgctggcgtccatgatcgtcggcacggtgaccaacccgttcgggaacggcttctaccaggagggctccgccgacgctccgctggaggccgccacggcgtgcgccggcgtgtacggcaagggcgcgtaccccgggtacacggggtcgctgctggtggaccaggccagcggggccagcttcaatgccaacggggcccacgggaggaggtacctggtccccgcgctcgtggacccggacacgtcgtcgtgtgccaccttggggtaggttttggtggcgtgactagtgtttttgtgaaggcctgaagggtggtgttacggtggagagtgttccacacggccgtgtctgtagtttgtagtagtgatgacggtggattctttcatttgttcaatgaaaaaaaagaaaatattttcgcgc

SEQ ID NO: 19278 - protein, 311 aa, Panicum virgatum; identical to SEQ ID NO: 19110
  misc_feature: Ceres CLONE 1804857
  misc_feature (39)..(311): Pfam Name: Phi_1 Pfam Description: Phosphate-induced protein 1 conserved region

SEQ ID NO: 19279 - DNA, 1378 bp, Panicum virgatum
  misc_feature: Ceres CLONE 1804861
  misc_feature: Encodes the peptide sequence at SEQ ID NO. 19280
ccgctccgcctctgctcctagcttccggcccccacgcaacgctccccggcgatgtcgtcgccggcgccgcccgacgactgcgagggggaggggagcggggggaggtcgttgagctacggggaggcggagtactgggacgcgcggtacgtcgaggagggcggcgcgccgtacgactggtaccagcgctacgacgcgctccgccccttcgtccgccgcttcgcgccgccggcgtcccggctcctcatgattggatgcggctccgctcttatgtccgaggacatggtcaccgatggttatgtggagattgtgaacattgacatttcttcggttgtgattgagatgatgagaaagaaatatttcaacattccgcagctgcaatacctgcgcatggatgtcagagatatgagtatgtttcctgatgaatcgtttgattgtgcaatcgataaaggtactctggactcattgatgtgtggtgtggatgctcctctcagtgcagctcagatggttttggaagtggccaggttttttagtgtcttgctgcccctctgaagtatcactctgcagtctcatctgcaccaagatatcagtttaatttcaacattcctgtagccttatcagttttacttttgtttgcaggcttcttaaaccaggcggtgtctttattttggtaacccctgtacattttctctgattagtgttgttgaggatgatttgaggactgaattctagattattttccattcgtgttcttattatacgtgtatacatagtccagcctcaaaccctggtatatattctgatcaactttcatgcctgaatttatagataacatatggtgatccatcagtgcgtgttcctcatttgaatcaaccaggatgcaaatggaagattgtactttacattctaccaagacctgggttcactggaaagataaggaggcatgtattggatcctgttccactgacagagaggggtagactccctgatggatttgttccagaggatcctgactcccattatgtctatgcctgcgaaaagatgcaaggattgacatgttcagcttgcccaaccgtagagaggcaaggggaagaatagatgatttcatcccacaagatttgtggattatgtgatttatacatgatcagatgacgcgatgttgccaccattgttatggccatccagatagagcaagcatgccattgcatgcatttatatttaacaaatcttgcaagaatcagggtgtcgatgtgttgtgcaaccactgtttttctctctcatttttgtatcgtcttggaagcacaaaagaatcatttggtagattcgaggaaggaaatttttcattaggagaaaggaattggcctttttcaaggaatactcg

SEQ ID NO: 19280 - protein, 165 aa, Panicum virgatum
  misc_feature: Ceres CLONE 1804861
  misc_feature: SWISSPROT Homolog: EC 3.4.24.71 Endothelin-converting enzyme 1
MSSPAPPDDCEGEGSGGRSLSYGEAEYWDARYVEEGGAPYDWYQRYDALRPFVRRFAPPASRLLMIGCGSALMSEDMVTDGYVEIVNIDISSVVIEMMRKKYFNIPQLQYLRMDVRDMSMFPDESFDCAIDKGTLDSLMCGVDAPLSAAQMVLEVARFFSVLLPL

SEQ ID NO: 19281 - DNA, 1357 bp, Panicum virgatum
  misc_feature: Ceres CLONE 1804872
  misc_feature: Encodes the peptide sequence at SEQ ID NO. 19282
cccatccgaggccgtcccgcaccgcactaccagccacctcccgcgccgcgccgccgccgccgtctcgcacgcgcggcagaggacgcgcgcgatcccctcccgaccaccaccagatcgcgccatggcctccacggccttcgccgccgccaagttcctcccggcccacctcgactcctccccgcgcatcgcgccacaccgcgccggccccaccgcgaatctctccttcgccccgctttcctcctctccctcctccgcggcgtcgctcctccgcctccgatccccgtcgccgtccggcccgggaggcaggctgcccccgcccccgcgctcgtacggcggcggcggatctggcgacgccgcggactccggcggcggcgacggccgccgcgggggcatcctcggcgtcttcctggccggctgggccgcccgcgtcgccgcggacccgcagttcccgttcaaggtgctcatggaggagctcgtcggcgtcaccgcctgcgtgctcggcgacatggcctcccgccccaacttcggcctcaacgagctcgacttcgtcttctccacccttgtcgtcggatccatcctcaacttcgtcctcatgtacctcctcgcgcccaccgccggcgtcgccgccgccgcctcgtccgccgcctccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgcgatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtcgcgccggcgccagtgttcaaggtgtccgtcgttgctctccgctgcgtgaacaacgtgcttggtggcatgtccttcgtgttgcttgccaggttgactggatcgcaaagatcagataaaccagcgacggctgcagaagagaaggaacggttgatagctgtgggcaatgccgccgcagatgccatcagtgaggcaaaggacgcagagggtaagtaaaggggatgggtagaggagggtgcaagtggatgcatgcatgctctgcgcctgagcttcgtttgcggcttcttggaataggccaagaaacctgtagatgataagtgggttggaataaggagtgaggctcaaaacattttcttcaatctgtttgcagtgatgacatgcttagttgatcttagaataaagtttttcgttcttgtc

SEQ ID NO: 19282 - protein, 344 aa, Panicum virgatum
  misc_feature: Ceres CLONE 1804872
  misc_feature: Functional homolog of the protein sequence given in SEQ ID NO 50526
  misc_feature: Useful for making plants with modulated biomass
MASTAFAAAKFLPAHLDSSPRIAPHRAGPTANLSFAPLSSSPSSAASLLRLRSPSPSGPGGRLPPPPRSYGGGGSGDAADSGGGDGRRGGILGVFLAGWAARVAADPQFPFKVLMEELVGVTACVLGDMASRPNFGLNELDFVFSTLVVGSILNFVLMYLLAPTAGVAAAASSAASALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSVVALRCVNNVLGGMSFVLLARLTGSQRSDKPATAAEEKERLIAVGNAAADAISEAKDAEGK

SEQ ID NO: 19283 - DNA, 1014 bp, Panicum virgatum
  misc_feature: Ceres CLONE 1804886
  misc_feature: Encodes the peptide sequence at SEQ ID NO. 19284
ctggaaggtggcgagatgttaaactccgtgcatttgacaacgcaaagcaccggacatatgttgatcttaaggacaagtggaagacgctggtgcacacggcgagcatctcgccgcagcagcggcgtggcgagccggtgccgcaggagctgctcgaccgggtcctggcggcccaggcctactggtcccagcagcaagccaagctccagcctaagacgcccccgctggctgaggctcgcttgctcacctaataattcgatgatcccggctgatggcctcctcggaggccgttgcagcctttgtataaagtcagtaagtcagtcagtccctttacaggaggtttaaggaagatattagaaaaaaaggatacatatataaggtacaagaagcattgaccgatttgttgtaatatctactcaccaccggttattctttaagccaggattctctctccttgtgaatttaaccaaaggaaagggtatttctttggcaaattgtccatgttcatgatggaagaagaagatgatccatgaactgagatctgcagtgtctactaatagctcacaatttttgcaattgtggttaagaaaatgaaggtgctgcttggtcgtccaagctccggctccagcttctggattctgctttgaagaagtcgttgtctcccactacagaagctgcgaatccaaatttcagtgtattaggcttaagtgcagcctatctttttatagtttgactcactcatagagacggccacagaagccgcagcaggagggtagcttctcctttgttgatttaggcttgggagcttcagctccagcaaagaagcctagcttgagactgagcgaggccaaagccgcaccgaaagcaagcttcagatttttttgttcaattgaattcattcttttgttagtggagagtgatggtaggagaggagggatggatctttgcttcacttttccctttcttttattactgtagttgtactatgttctttcaccaatcttgtagttatcctcg

SEQ ID NO: 19284 - protein, 81 aa, Panicum virgatum
  misc_feature: Ceres CLONE 1804886
  misc_feature: The sequence is a functional homolog of SEQ ID NO 1240 in the 11/479,226 US patent application
  misc_feature: The sequence is a functional homolog of SEQ ID NO 164 in the 10/374,780 US patent application
  misc_feature: The sequence is a functional homolog of SEQ ID NO 566 in the 10/412,699 US patent application
  misc_feature: The sequence is a functional homolog of SEQ ID NO 894 in the 10/225,066 US patent application
  misc_feature: The sequence is a functional homolog of SEQ ID NO 1796 in the 10/412,699 US patent application
  misc_feature: The sequence is a functional homolog of SEQ ID NO 2042 in the 10/374,780 US patent application
  misc_feature: The sequence is a functional homolog of SEQ ID NO 398 in the 10/412,699 US patent application
  misc_feature: The sequence is a functional homolog of SEQ ID NO 945 in the 11/479,226 US patent application
  misc_feature: The sequence is a functional homolog of SEQ ID NO 770 in the 10/412,699 US patent application
  misc_feature: The sequence is a functional homolog of SEQ ID NO 88 in the 10/286,264 US patent application
GRWRDVKLRAFDNAKHRTYVDLKDKWKTLVHTASISPQQRRGEPVPQELLDRVLAAQAYWSQQQAKLQPKTPPLAEARLLT

SEQ ID NO: 19285 - DNA, 452 bp, Panicum virgatum
  misc_feature: Ceres CLONE 1804935
  misc_feature: Encodes the peptide sequence at SEQ ID NO. 19286
catccataacattttccacattgacaacatcggtgcgtctctccaaaagctcatggtgtgcttcatgcagctgacagccaagtttccacttgtgataatcttcctgctgatagccctttatgctgtccccgcgagtgctgctgttctggtgctgtatgtccttgtgacatttttgtttgcgctgccatcgtttttgatcctctacttcgcttatcccagcttggactggcttgtcagagagatcttcgcttaatttcaacagcacagttcataatcatagctccctggtacatgatatatcatatatggtattccatggccacctgccttctgggcactgtatagtcttttctgatttcatgtcctttcttttcttgccttatgtgtccccttattctgatgtaactatctatttattaaaaatgatcggcaacatttttatttgtggttct

SEQ ID NO: 19286 - protein, 83 aa, Panicum virgatum
  misc_feature: Ceres CLONE 1804935
  misc_feature: Functional homolog of the protein sequence given in SEQ ID NO 50848
  misc_feature: Useful for making plants with altered protein content
  misc_feature: Functional homolog of the protein sequence given in SEQ ID NO 50849
  misc_feature: Useful for biocontainment applications
  misc_feature: Useful for making plants with altered alkaloid content
IHNIFHIDNIGASLQKLMVCFMQLTAKFPLVIIFLLIALYAVPASAAVLVLYVLVTFLFALPSFLILYFAYPSLDWLVREIFA

SEQ ID NO: 19287 - DNA, 851 bp, Panicum virgatum
  misc_feature: Ceres CLONE 1804984
  misc_feature: Encodes the peptide sequence at SEQ ID NO. 19288
agccagctcccagctctcctctcacactgcaccactccctcacctagaagagaacacagaaccggatccagagcagagcgtgttgcgccggcctagctcttgggtcgtcaagtctccgttcgttctttctttctccaaccggcagctgatctcctgtgttaatcccgaccggagctgcctgcgatgggcatcgtcgacgtcgtctccgtgttctgcaccctgccgaggactcgccggcacctcaagaagaggaagcagttccagacggtggagatgaagatgcggatcgactgcgaggggtgcgagcgcaaggtgcgcaaggcgctggagggcatggagggcgtgagctccgtggaggtggcgccgcggcagcacaaggtgacggtggccgggtacgtggacgccggcaaggtgatgcggcggttggcgcggcggacgggcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgcctgcgccgtcatgtaggaatagctagtagscggggmrgrgtagtagatagagtaggcaagtggacacgggggtgaggtggtggaggatcattttcttttcagctctggtagtgtttgacacgggagattgggttctggttggaggaagattgggaaatcggtggcgggaggaagcaagagaaaggctggcgagtcgtggtgtgttttgcatcg

SEQ ID NO: 19288 - protein, 156 aa, Panicum virgatum; identical to SEQ ID NO: 10085
  misc_feature: Ceres CLONE 1804984
  misc_feature (29)..(91): Pfam Name: HMA Pfam Description: Heavy-metal-associated domain
  misc_feature: Functional homolog of the protein sequence given in SEQ ID NO 50155
  misc_feature: Useful for biocontainment applications

SEQ ID NO: 19289 - DNA, 1061 bp, Panicum virgatum
  misc_feature: Ceres CLONE 1804987
  misc_feature: Encodes the peptide sequence at SEQ ID NO. 19290
acgcgtgcccaaaccccatcatcccaacccaattcccacacgccagctgccgcggccccaaatctagtagcacggccgccgcggcttctgaggcggcaagcggcgcttccggcgatggcctcctccaaccccagctcggccgccgccacggccgctgacgggggcgacgacctcgatcagctcctcgacagcgcgctcgatgacttcaccagcctcgatctctccgcctccgccgctcccaaaagcagcagcagcgaggcctccgcgtcggcgtcgggatcgggtgccaaggcgccggtgctggggctggggtctggcctgccggaccccaaggccccgaagcggcgcggggcgaagccgccgccgccgcccaggggcgagtgcgcgaaggaggcgctcgagaagctcacgcgcgagacgcgggaggcggtgcgcgggctcgagacggccaccgcgggtgtcccgtcgctggacgacgaggccatgatggaggagttcgtcaagcagttcgaggagttcgcaggggcgcaggatatggactctattgttcaaacaatgatgcagcaacttttgtccaaggaaattcttcatgagcctatgaaagacattgtggaaaaatatccaaaatggctggaggataacaaagacaaaataagcaaaggagaatatgagcgttacaacaatcagctcgaactcatggtgaagcttattgaggtctatgaaaatgatcctgagaacatgactaagatttttgacatcatgcaaaacatgcaagaatgtggtcagccccccagtgatcttgttcaagatattgtacctgatctggacctgagcaagttgggacagctgtctcctgagatgcttgaatcagcaccaaattgttgtgtaatgtgatggatgaagaattccatggagttcttttttttttttacatctacgagcccccttttggcttctgtagcttgaagataattttcatctggataatgtgtaaagcctcacagttgtataatgatttaaatgttcttcatgattcttaagtggaagctatattctttccg

SEQ ID NO: 19290 - protein, 259 aa, Panicum virgatum
  misc_feature: Ceres CLONE 1804987
  misc_feature (28)..(259): Pfam Name: Pex19 Pfam Description: Pex19 protein family
MASSNPSSAAATAADGGDDLDQLLDSALDDFTSLDLSASAAPKSSSSEASASASGSGAKAPVLGLGSGLPDPKAPKRRGAKPPPPPRGECAKEALEKLTRETREAVRGLETATAGVPSLDDEAMMEEFVKQFEEFAGAQDMDSIVQTMMQQLLSKEILHEPMKDIVEKYPKWLEDNKDKISKGEYERYNNQLELMVKLIEVYENDPENMTKIFDIMQNMQECGQPPSDLVQDIVPDLDLSKLGQLSPEMLESAPNCCVM

SEQ ID NO: 19291 - DNA, 1057 bp, Panicum virgatum
  misc_feature: Ceres CLONE 1804999
  misc_feature: Encodes the peptide sequence at SEQ ID NO. 19292
ggcccggcgtcctcttcctccttccagcccacgtcggctcttgctccagcgcccgttccgtcctccccgcctccccgtcctcctcccaaagtccccacctcccgcgcgcgtgccccgggaggcgagatccaggcacagcggccaacagccggcatctcgcgcgggcccggccccgtccggcccctgtgtccgccaagaggagcgctccgccgccatggaggcgtcttcgtgggacgctctccgcaagcaggcaaggaagctagaagctcagttagacgaccaactgaacgcataccggaaattggcttctatgaaatccgatgattcagagaatcacgtcgagtctgatatagaaagatcactgaagcaacttcagcaagtaaattctcagatgcaggcctgggtatcatcaggaggctcagaactcctttctcacaccttgactcgacatatggagattttgcaggatctttcacaggaattcttccgcctccgatcaagtctcagagcaaagcagcaacatgcttccctccttgattttagagattttgacagagcaagctttgatgttgaagaggctgcagattcctccgatcaatctctcctaaaagaacaagcagcaatcacccgaagtactggacagatggataatgtgatatcgcaagctcacacagccctaggtgcccttatgtcacaacgatcgacattcggtggaatcactacaaaaattagcaacgttggcaatcggctccctatgatcaatcagatcctttcatcaatcagaaggaagaaatcgatggacacaattattctttcattagttgcctctgtttgtgcatttcttattttcatctactggttgtcaaaatagtagtactatgagtgttgtgagctcagataagtagtatatacctgctagtgatagatgtttggacaatgttatatcagtgctgttatgattctatttgtgttcaagcaacctcagatgactatagctcagactgagctagttcacccacattttacacacgagttagtaaagaattactcccaggat

SEQ ID NO: 19292 - protein, 218 aa, Panicum virgatum
  misc_feature: Ceres CLONE 1804999
  misc_feature (46)..(196): Pfam Name: V-SNARE Pfam Description: Vesicle transport v-SNARE protein
MEASSWDALRKQARKLEAQLDDQLNAYRKLASMKSDDSENHVESDIERSLKQLQQVNSQMQAWVSSGGSELLSHTLTRHMEILQDLSQEFFRLRSSLRAKQQHASLLDFRDFDRASFDVEEAADSSDQSLLKEQAAITRSTGQMDNVISQAHTALGALMSQRSTFGGITTKISNVGNRLPMINQILSSIRRKKSMDTIILSLVASVCAFLIFIYWLSK

SEQ ID NO: 19293 - DNA, 1027 bp, Panicum virgatum
  misc_feature: Ceres CLONE 1805026
  misc_feature: Encodes the peptide sequence at SEQ ID NO. 19294
agctagctgcaggatcggaaaccaaaggccctcctccatccagatccagctgcatgctcaattgctcatccaatccagcacatcatcttggtccacggtagattggtagatggggcctctgagaggaggaggaggcggcggcggcggcggcggcggcggcatggacgatgaggaggcgaggaatccgcagctggtggatgcggacgaggcatgcgccctcctcagcatggccacgcaccagtatctcgatgtcaggatgtgggaggactttgacaagggccatgtcgccggtgctcggaatgttccctactacctctccgtcactccacatgggaaggagaagaatccccactttgtggagcaggtgtccgcgctctatcccaaggaccaacacctgattgtgggctgccgctccggcattcggtccaagctcgccactgcagacctcctcagcgcgggcttcaagaatgtgaggaacctagaaggcgggtatctctccttgctccgaagcgccaaccagcagcaccaccaccagcaggctgctgcttaacccatccattaattatcctagtattatttaaccattcatgcactacaaaatactactccctccatttcaaattataagtcattttaaaaattttggagagtcaaatcatctcaaaatttgaccaaaattatagagagaaatataaagatttatgacatcaaatagatgcactataaaaatataactaataaagaatctaatgatacttaattggtatcataaatattattatcttgtcatataaagttggtcaaacttgaaattttttgactctctaagattcttgaaatgacttataatttggaacagaaagagtactactttgtatgtataaggcgatgggcatacatacatacatacagcggtatatattttcctctttcatgctatgcctccatcgccatccgtatcgatctgtatgcaataaagaggcctgaacaacaagtaatgcaataagcaagatcattcatttccgct

SEQ ID NO: 19294 - protein, 146 aa, Panicum virgatum
  misc_feature: Ceres CLONE 1805026
  misc_feature (30)..(134): Pfam Name: Rhodanese Pfam Description: Rhodanese-like domain
  misc_feature: SWISSPROT Homolog: EC 2.8.1.1 Thiosulfate sulfurtransferase
MGPLRGGGGGGGGGGGGMDDEEARNPQLVDADEACALLSMATHQYLDVRMWEDFDKGHVAGARNVPYYLSVTPHGKEKNPHFVEQVSALYPKDQHLIVGCRSGIRSKLATADLLSAGFKNVRNLEGGYLSLLRSANQQHHHQQAAA

SEQ ID NO: 19295 - DNA, 423 bp, Panicum virgatum
  misc_feature: Ceres CLONE 1805027
  misc_feature: Encodes the peptide sequence at SEQ ID NO. 19296
ctatgttacctgctccacattggcttttgcatatttgctgccattgctcctccaattatattccgtggaaagtcattaacgggtatactggctgcaattgacaccttctctgatcatgcgatagttgggatcttttactttgtcggatttgccttgttttgcttggagacacttgtgagcatatgggttcttcagaaagtatacatgtacttcagagggcacaagtaggccattgaaggatttactaccaataccatctgattgtgctgcggttctgtgcatacacataagtacatgtccattgttgtatgttatgacaatgtatattttttcaactttgaagttgaggggtataccattatatagtagtgtcgtttctgactgatttatttttttacccatatacaaattgcactttgtgtc

SEQ ID NO: 19296 - protein, 75 aa, Panicum virgatum
  misc_feature: Ceres CLONE 1805027
  misc_feature (1)..(75): Pfam Name: SCAMP Pfam Description: SCAMP family
  misc_feature: Functional homolog of the protein sequence given in SEQ ID NO 50850
  misc_feature: Useful for biocontainment applications
LCYLLHIGFCIFAAIAPPIIFRGKSLTGILAAIDTFSDHAIVGIFYFVGFALFCLETLVSIWVLQKVYMYFRGHK

SEQ ID NO: 19297 - DNA, 1190 bp, Panicum virgatum
  misc_feature: Ceres CLONE 1805030
  misc_feature: Encodes the peptide sequence at SEQ ID NO. 19298
aaccagctccatcagctctgctgcctggaggtgtgctagtatctgttcaacgaagcaagcgtgtggccatggcgatgttcaccagagccttgcaattggctctcagggagaagaggagcaggatcattggggatcgccgtcaggcttcctcgccaattccttctcatcctcggctccgagctcccagagtccacagaggctggccgggaaagtcgccgtcatcaccggtggcgcgagcggcataggcaaggcgaccgccgccgagttcgtcaggaacggcgccaaggtggtgatcgccgacatccaggacgacctgggccacgccgtggccaaggagctcggcggcccgggcgcggcatgctacacccgctgcgacgtggccgacgaggcgcaggtcgcggcggccgtggacctcgcggtcgcccgccacgggcacctcgacgtcatgttcaaccacgccggcatcgggggcgccacggggacgccgccgccgctgggcgccgtggacctcgcggacttcgaccgcgtgatggcggtcaacgcccggggcgtgctggcggggctcaagcacgcggcgcgggtcatggtcccgcgccgccgcggcagcatcatctgcaccgcgagcgtcgccgcgctgctgggcggcgtggccaccccggcgtacggcgcgtccaaggcggcggtgctggggctggtgcgcgccgcggcagcggagctggcgcgctccggcgtgcgcgtgaacgccatctgccccagcgccatcgtgacgcccatgtgcctgcagagcctcgggtcgtggctccccgggatgagcccggaggagatcaagcggatggtggaggtcgacacgaacccgatggccgggacggtgctcgaggcggaggacatcgcgagggcggcgctgtacctggcgtccgacgaggccaagtacgtgaacgggcacaacttcgtcatcgacggcggcttgtcggtttcggtgggcaagacagcctagtaaagatgccggcgccaccatgccgtgaagcaaggatcaatcagctgccgattaatttcgggggctattggccctgtttgattctgcttttgtgaacctctgagaagtaggattcggagattatgctatccggagaatcggctctctaaataagctgattatttgacaattctaattatttcgagtcgattctctg

SEQ ID NO: 19298 - protein, 330 aa, Panicum virgatum
  misc_feature: Ceres CLONE 1805030
  misc_feature (70)..(240): Pfam Name: adh_short Pfam Description: short chain dehydrogenase
  misc_feature: SWISSPROT Homolog: EC 1.1.1.288 Xanthoxin dehydrogenase
TSSISSAAWRCASICSTKQACGHGDVHQSLAIGSQGEEEQDHWGSPSGFLANSFSSSAPSSQSPQRLAGKVAVITGGASGIGKATAAEFVRNGAKVVIADIQDDLGHAVAKELGGPGAACYTRCDVADEAQVAAAVDLAVARHGHLDVMFNHAGIGGATGTPPPLGAVDLADFDRVMAVNARGVLAGLKHAARVMVPRRRGSIICTASVAALLGGVATPAYGASKAAVLGLVRAAAAELARSGVRVNAICPSAIVTPMCLQSLGSWLPGMSPEEIKRMVEVDTNPMAGTVLEAEDIARAALYLASDEAKYVNGHNFVIDGGLSVSVGKTA

SEQ ID NO: 19299 - DNA, 1126 bp, Panicum virgatum
  misc_feature: Ceres CLONE 1805047
  misc_feature: Encodes the peptide sequence at SEQ ID NO. 19300
aaaatttggcctcctgcgctgccgagctccgcctctgcgctacagttttgctccggcttcagggcttgttgtaaaaaggagccgtttccgggaggtgccccagacctggccatggagtccgtccgggggaagcggagatggaggtggagtggcggatccatgctaaagctggcggggctgtgcctcgccgcggccatctgcctgtgcggcgttcggtccctggcttgcggcgacggcagtggctgcaggccgcgtactgtgctgctccgttcagacttttggagacgagctgcaacctcttgcggtgatcaggtgtgctctggcggcggcgggcaatggcttcggcggcggcggctgctggcggaggggccggggtcctacccgccgcggtgcgcgtccaagtgcggcgactgcagcccgtgctacccggtgcacgtggccgtgccgccgggcgtgccggtgaccaccgagtactacccggaggcgtggcggtgcaagtgcggcaaccggctctacatgccgtgaacggcccgtccgccgcagccggagccaaggagagggcgggcgggcagacggcggcccgaccggccggtgagcccgtctggactcgagcgcagcctgctgctctgcgctcgtgcgcagcgccggtcgggcgccgcatcattgcgccgggccggtgtggctcgcctgcgccgcgcatgggcgggatctgcagcgcgcgtggtggcgacctaccacacacacaggccggcccggcggggtcggggatactgagactgtgcgtgtcctttatccatggggcgcgcgcgctggaattcgtcgcacggccctaccacgaggcgcgcaggcagggcgggcgtacggcgcgtcagtgcgtgctggatcgagcggccgagccgaggagggaggcgacgggagcggctctctgctctgctgcggcctgcgggcgggcggcggcccactcctctgcacgtgtccggatgctctgttcaagtgttgatgctccatgtcttcttcaatctcttcttgtgctgctgttttcggatctgagtgttacaaatttttgcggtccgctttgtagctgtaactaaatggctcgtactactatctcgtggtaccaaatttc

SEQ ID NO: 19300 - protein, 137 aa, Panicum virgatum
  misc_feature: Ceres CLONE 1805047
  misc_feature: SWISSPROT Homolog: EC 3.2.1.15 Polygalacturonase
MESVRGKRRWRWSGGSMLKLAGLCLAAAICLCGVRSLACGDGSGCRPRTVLLRSDFWRRAATSCGDQVCSGGGGQWLRRRRLLAEGPGSYPPRCASKCGDCSPCYPVHVAVPPGVPVTTEYYPEAWRCKCGNRLYMP

SEQ ID NO: 19301 - DNA, 517 bp, Panicum virgatum
  misc_feature: Ceres CLONE 1805058
  misc_feature: Encodes the peptide sequence at SEQ ID NO. 19302
caaccggcgatcaacctagctaaagggctcgctgctgatcaatacatccatcgatcggggatgcgggaggctgctggaggcgtgcacggcagccactacgcactcctgctgcaagccgccggatcgggggcgggaggcgactacgtccacgccggccccgcccacctcccgtggctcggcccggccgccgcgccagggttctcctacctggccccacaccatcaaggcccagacttcggggccgaggcggcggccgcggacgctttcgagcttcagcggcgcgtacagccgcggcgacgggggcggcgtgcgccagctcgagatgttcgagctcaagccacctctgctgcccccgacgccgcacgggccgaggatggcgcccgggctgctgggaaccctgctggcggagctggggcggatgaccgccaaggacatcatgaacgccacggcactggcggcctcacgcaccccctgcgaggccgaccgccaccgccgacagcgaatcaccagccacctc

SEQ ID NO: 19302 - protein, 64 aa, Panicum virgatum
  misc_feature: Ceres CLONE 1805058
  misc_feature: The sequence is a functional homolog of SEQ ID NO 1899 in the 10/374,780 US patent application
  misc_feature: The sequence is a functional homolog of SEQ ID NO 1901 in the 10/374,780 US patent application
  misc_feature: Functional homolog of the protein sequence given in SEQ ID NO 50851
  misc_feature: Useful for making plants with modulated biomass
MFELKPPLLPPTPHGPRMAPGLLGTLLAELGRMTAKDIMNATALAASRTPCEADRHRRQRITSH

SEQ ID NO: 19303 - DNA, 663 bp, Panicum virgatum
  misc_feature: Ceres CLONE 1805058-R
  misc_feature: Encodes the peptide sequence at SEQ ID NO. 19304
acgacggaggtgacgccgccgcccccgacgggtgcgcacgcgccagctcccaccaccggaggcacgagctcgtcgcgtcgatccaggaggcgctgcgcggcgtcatggaccgcaagacgccgagcagcgacacgtcctcgtctagcggcggcggcggcggcgggagcatcaagaggcagcgcatgagcggcgcgcacgagcaaggttcgctttagtgcggtaactcgatctagctactagctagctcgatcatgcctccctccatcctagcatgaaatatgaaagcatgcatgcttagtatagttatgaaaatatagtcactccaaacttagatggatcgagatgatggctcttctttttttttttgctgctatgctaatggtgtgggatgagggaaagaaaaaaatttggaaacatgcatggcgagatgtccgaggtagaagagaggaagagagggagagagttttacgtatcatcccttatatatgtttgtgtgtgtgttttttttatttacttcgcgtatgtatcatcagggagagaggggggccggggaattcgagaggttattactgatgataaacctctcataaaactggggtgataagggtgtacatgtataatctctggggtataatggagaatggaattggtgggctgctggtc

SEQ ID NO: 19304 - protein, 70 aa, Panicum virgatum
  misc_feature: Ceres CLONE 1805058-R
  misc_feature: The sequence is a functional homolog of SEQ ID NO 1899 in the 10/374,780 US patent application
DGGDAAAPDGCARASSHHRRHELVASIQEALRGVMDRKTPSSDTSSSSGGGGGGSIKRQRMSGAHEQGSL

SEQ ID NO: 19305 - DNA, 1239 bp, Panicum virgatum
  misc_feature: Ceres CLONE 1805063
  misc_feature: Encodes the peptide sequence at SEQ ID NO. 19306
aagcatagtagtgtgcgactgcaacaagagctcactcactcttctgtgatctgtactgaaagtcctgaacgtgacaagctaagcagcgagaacgatggcggaagagtacggccgcagcggctacggcaggtcaggcgccggcgacgactacgagagcggctacaacaagtccggcaccgacgactacggccggggcgaaggcgggtacaacaagtcgggcaccgacggtggctacggcggcgggtacaacaagtccggcggtgacgagtacggccgcagcggcggggacgggtacaacaggcccggaaccgatgagtacggccgcggcggcggcgacaggtccggcacggacgactacggcagcggctacaagaagtccggcaccgacgactacgatcgcagcggcgggtacaacaaatcggccaccgacgactacaacagcggcggcggcggcgcgtacaacaagtcctccggcggtgacgaccagtacaccaccggtggcggcaggtacaagaagacctctggcgacgacgagtacaccggcggtggcgggtacgacagcaagtccggtggcggcgtccacgagtacggctcctcccggaacgactcggagaagtacaggaaggaggagaaggagcacaagcacaaggagcacctcggcgagatgggcgccctcgccgccggcgccttcgccatgtacgagaggcacgaggcgaagaaggacccggagcacgcgcagcgtcacaagatcgaggagggcgtggcggcggtggcggcggtgggcagcggcgggttcgcgttccacgagcaccacggcaagaaggaggccaaggacgcggcggaggacgccgaggaggaggaggaggaggccgcccgcggcgagggcaagaagaagcaccacttcttcggctagctagctgttgcgtgactggcctcctgcgtgctcctccagcagcgggtgaataaaagccggggacgtttcgtgcgtacggctctgcgtatccgtgtaccacgtatccgtatgtgctacgtacgtcactgtggttactgatgatgtggctgcagctgtgtggagtggagtctgttggtgtacgtgtctgcatgtgcatttgtctacgtcgttttgtttctacgtggtatatatgtatgtacgtggtttgcacttgatgactttgtaaccggcactctcgcgtagaatccgtgtatattttaataaaaaagtgacaccggtgcctgatc

SEQ ID NO: 19306 - protein, 272 aa, Panicum virgatum
  misc_feature: Ceres CLONE 1805063
  misc_feature (173)..(252): Pfam Name: ABA_WDS Pfam Description: ABA/WDS induced protein
MAEEYGRSGYGRSGAGDDYESGYNKSGTDDYGRGEGGYNKSGTDGGYGGGYNKSGGDEYGRSGGDGYNRPGTDEYGRGGGDRSGTDDYGSGYKKSGTDDYDRSGGYNKSATDDYNSGGGGAYNKSSGGDDQYTTGGGRYKKTSGDDEYTGGGGYDSKSGGGVHEYGSSRNDSEKYRKEEKEHKHKEHLGEMGALAAGAFAMYERHEAKKDPEHAQRHKIEEGVAAVAAVGSGGFAFHEHHGKKEAKDAAEDAEEEEEEAARGEGKKKHHFFG

SEQ ID NO: 19307 - DNA, 1196 bp, Panicum virgatum
  misc_feature: Ceres CLONE 1805101
  misc_feature: Encodes the peptide sequence at SEQ ID NO. 19308
cccctcccttcctctccccgcctcgccacagccgcatccactcttccccaccaccgcgacccccatcctcttcccgctccgccgtagcctcctcccctcgtccccacacctcctccctccacggtggcactgcttgcaacaggccctcctctcccctcctcgaccgcgtccatgtgttgggcggcgcacctgcccctggaggtgggcacgcgcgtgatgtgctggtggcgcgactagaagctccacccgtcaaggtcatggagagccgcaagggctcctcgtcctcttcccccgccgactacgagtactacatccactacacggattggaaggaccctccctgcctcgcatcccaatcccatcaggaggttttgtgtctaggtcaatagcgcaaagaacagtttgagaggcacatggtgctagacgggtagtcactgtgagaacaggaattgggctgtcaagacagcaactaggtggtctgcataagcttatccaacctatcaaggacaaatacccaggtatcacttacgtggatttgttccaattggcgagtgctactgcaattgaggaagctggtggcccaaaaattccaatgaaatacggacggatggatgtcacagcacctgagcaatgtccacctgaggggaggcttcctgatgctggcccacgtgatcctgctgaacaccttagggaggtattctatagaatgggcctcgatgacaaggaaatcgttgcattgtctggagcacatacacttggaagagcaaggcctgaccggattggctggggaaagccagaaacaaaatatactaataatcaggctggtgaagcggatcactttggaggatgctcaagcggagtggcgatgagtctcctgaagatgcacaagccacaaggcaatgcttatacttctttttgtcggtagttgaatcagtagataagattcaattgttttccactacttgtctttacaatatttgattcagtgcatgtccagctagatttgtatggtgcctactaaggtggtactgattttagtgttttaagccgactatggtgattattttaatgcacagacattactggatgtgtgcgcccaataagattttaactttgtatgaggactgcatttgtaatatatacagtggataaaacatgtgaatttgtgatgtaaagaatggataaaacatgtgtag

SEQ ID NO: 19308 - protein, 110 aa, Panicum virgatum
  misc_feature: Ceres CLONE 1805101
  misc_feature: SWISSPROT Homolog: EC 1.11.1.11 L-ascorbate peroxidase
  misc_feature: Functional homolog of the protein sequence given in SEQ ID NO 50852
  misc_feature: Useful for making plants with altered carbohydrate content
MKYGRMDVTAPEQCPPEGRLPDAGPRDPAEHLREVFYRMGLDDKEIVALSGAHTLGRARPDRIGWGKPETKYTNNQAGEADHFGGCSSGVAMSLLKMHKPQGNAYTSFCR

SEQ ID NO: 19309 - DNA, 1077 bp, Panicum virgatum
  misc_feature: Ceres CLONE 1805117
  misc_feature: Encodes the peptide sequence at SEQ ID NO. 19310
gtgtgatctgaccgtggctttgcgttcgcgtcgtcgcctcgatctcggcctcgggcgggggccatggcggaggacgccaccagcagccacccctcccgctacgtcaagctcaccaaggaccaggacgcccccgccgaggacatcctccccggcgagctcaaccagccagtccacgtcccgcagctcgaaggccggaggtgcagcgagtgcggccaggtcctgcccgagagctacgagccgcccgccgacgagccctggactaccggaatcttcggatgcaccgacgaccccgaaacctgccgaactggactgttttgtccttgcgtgctgtttggacgcaacgtcgaggaacttagagaggacatcccctggacaactccttgcgtctgccatgctgtgtttgttgaaggagggatcacgctggcaattctgacggcaatatttcatggtgtggatccaaggacatcgtttctgatcggagaaggtttggtgtttagttggtggttatgtgctacctatactggcattttccgtcaagaacttcagaggaaataccatcttaagaactctccgtgtgacccgtgcatggtccactgctgcttgcactggtgtgcaaactgccaggagcatcgcgagagaaggggtcggcttgcagagaacagcgcggtgcccatgacagttgtgaacccacctccagtgccagagaagagcaggccagagaaccggggtcggggggctccggagaaaggagcagccaacaccgagcatggagctgcaaagagcgagccagatgaggttgaggtcattcgtggttagaaatgctaggatgggtagcgggaaactgatcctagtgagcatatggtaaatccattgttaatttgttatgaatgcgaggagtgaaggatgttgatgataacagaggagtggatagagttgtatttatctttgatgtgttgaggtcgtgggtagtgtttcacaggtctttactttgagaaccggatcgggagggcatgtattaggtgaattcaagagccagggccccgtgctgcgtgctcgggcgcaagttttactagtcag

SEQ ID NO: 19310 - protein, 250 aa, Panicum virgatum
  misc_feature: Ceres CLONE 1805117
  misc_feature (65)..(192): Pfam Name: PLAC8 Pfam Description: PLAC8 family
MAEDATSSHPSRYVKLTKDQDAPAEDILPGELNQPVHVPQLEGRRCSECGQVLPESYEPPADEPWTTGIFGCTDDPETCRTGLFCPCVLFGRNVEELREDIPWTTPCVCHAVFVEGGITLAILTAIFHGVDPRTSFLIGEGLVFSWWLCATYTGIFRQELQRKYHLKNSPCDPCMVHCCLHWCANCQEHRERRGRLAENSAVPMTVVNPPPVPEKSRPENRGRGAPEKGAANTEHGAAKSEPDEVEVIRG

SEQ ID NO: 19311 - DNA, 973 bp, Panicum virgatum
  misc_feature: Ceres CLONE 1805153
  misc_feature: Encodes the peptide sequence at SEQ ID NO. 19312
gtccatcccttctcttctctctcgagggagctgctgcctgctagtaggtaggtaggtagtgtacgtgcagcgtccggccacttctcttcccaaaagaaaattaagaagaagaagaagcagcagcagcagctgatcatcatcttcatcatcaacaacaagcaaataagcagtcatgtcgatcaagtactgcgaccagcacaaggactgcgagcggcagcggctgtaccggcgcttctgcgccggcctcgccgccctcatcctgctggccctcctgatcgtgctcatcgtctggctggtgctccgccccagcaagccccgcttctacctcaacaacgtcgacatcgtctgcatcaacgtcagcgcctcctccgccctcaccgtcaccatgcaggccacgctggcggcgcgcaaccccaacggccgcgtcggcatcttctacgaccgcgccgacgtctacgccgagtaccggggcctccaggtcaccgtcgccaccgcgctgccgcccatgtaccagggccacaacgacgtcaccgtctgggcgcccttcctctccggcgccggcgtcccgctctcgccgtacctggccaccgcgctggcgcaggacgagacggcgggctacctgctcctcaccatccgcgtcgacggctggatccgctggaaggccggggccttcatcaccagccactaccacctcagggtccgctgcccggcgctgctcaccgtcaacgacggacaggggagctacggatccaacgccggaggggggctcggctacttcaagttcaaccgggcggcgccatgcatcgtcgaagtctagtagctgcctgcctcattaagtttctttcatctctactattatttcaataatataatataattaccggccgtcaaggctggccggccgggactctgctgctactatcatgtacgatccttaattacttgaatgcaagtaatatatataattgttcat

SEQ ID NO: 19312 - protein, 214 aa, Panicum virgatum
  misc_feature: Ceres CLONE 1805153
  misc_feature (40)..(178): Pfam Name: Hin1 Pfam Description: Harpin-induced protein 1 (Hin1)
MSIKYCDQHKDCERQRLYRRFCAGLAALILLALLIVLIVWLVLRPSKPRFYLNNVDIVCINVSASSALTVTMQATLAARNPNGRVGIFYDRADVYAEYRGLQVTVATALPPMYQGHNDVTVWAPFLSGAGVPLSPYLATALAQDETAGYLLLTIRVDGWIRWKAGAFITSHYHLRVRCPALLTVNDGQGSYGSNAGGGLGYFKFNRAAPCIVEV

SEQ ID NO: 19313 - DNA, 647 bp, Panicum virgatum
  misc_feature: Ceres CLONE 1805155-R
  misc_feature: Encodes the peptide sequence at SEQ ID NO. 19314
ctacagcggcgacggcttcaagctgctgatcccgtccaagtggaaccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcttacgccggcaagacggactccgagggcgggttcgagaccgacgcggtggccacggccaacatcctggagagctcggcgccagtggtggacgggaagcagtactacagcgtgtccgtgctgaccaggacggcggacggcgacgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcataagcagtgcacgcatcatctgtgtgccggaatttgttttttttggttcagggatgcttacgtagatagaggttgggcatgcgtgtgcgctccggcctttgattgtacatgagaacaaagaccaaggagagctccatttcgtccctgc

SEQ ID NO: 19314 - protein, 166 aa, Panicum virgatum
  misc_feature: Ceres CLONE 1805155-R
  misc_feature (1)..(166): Pfam Name: PsbP Pfam Description: PsbP
  misc_feature: Functional homolog of the protein sequence given in SEQ ID NO 50254
  misc_feature: Useful for making plants with altered lignin content
  misc_feature: Useful for making plants with modulated nitrogen use efficiency
YSGDGFKLLIPSKWNPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 19315 - DNA, 1237 bp, Panicum virgatum
  misc_feature: Ceres CLONE 1805163
  misc_feature: Encodes the peptide sequence at SEQ ID NO. 19316
cccaccacatcccccatcgaaaaccgtcaacaaagaaaccccaccgtgcccaagccccccaaaacctcaaaccacccgcccgcccgccatggcgttccggctgagcaacaacctcatcggcgtcctcaacttcgtcaccttcctgctctccgtcccgatcctgggcgccggcatctggctgggccaccgcgccgacggcaccgagtgcgagcgctacctctccgcgcccgtcatcgccttcggggccttcctcctcgccgtctccctcgcgggcctcgtcggcgcttgctgccgcgtcacctggctgctctgggtctacctcctcgccatgttcgccctcatcgtcgccctcttctgcctcaccgtcttcgccttcgccgtcaccaaccgcggcgccggggaggccgtctccggccgcggctacaaggagtaccgcctcggggactactccaactggctgcagaagcgcgtcgagagcaccaagaactggaacaggatcaggagctgcctccaggactccaaggtctgcaagagcttgcaggacagcagggagacgttcgcggacttcatacgctccgacctctcacccatccagtccgggtgctgcaagccccccacgagctgcaacttcacctacgtgagcggcacggagtggaccaagacgacgacccccgccggcgcggcggcggacccggactgcggcacctggagcaaggaggcgctctgctacgactgccagtcctgcaaggccggcgtggtggccaccttcaagcgcgactggaagcgcgtcgccgtcgtcaacatcgtcttcctcgtcttcatcatcatcgtctactccgtcggctgctgcgccttccggaacaaccgcagggacaacgccgcctaccgcggcggctggaagcagggcggctacgcctgatcgcccggccggcctcgccggaggagccggccggagagccactgctagctgctgctccatcgattggttgccgtcgtcgtgcacgatcagcgctctgctctctctctgtcgctgccccccggtcgctgtcgtcctatatatgtgtctaggctcgatctagctctgtacaggcgagattatattactacggattcttgtcgtctgatagttactttattatagtttattatatgatctctgatcagcagtaggttttgtacatgctgttcgttgattcgacacaccgctatatattcgcatatgcatgtcttattctag

SEQ ID NO: 19316 - protein, 276 aa, Panicum virgatum
  misc_feature: Ceres CLONE 1805163
  misc_feature (5)..(245): Pfam Name: Tetraspannin Pfam Description: Tetraspanin family
  misc_feature: Functional homolog of the protein sequence given in SEQ ID NO 50853
  misc_feature: Useful for making plants with modulated nitrogen use efficiency
MAFRLSNNLIGVLNFVTFLLSVPILGAGIWLGHRADGTECERYLSAPVIAFGAFLLAVSLAGLVGACCRVTWLLWVYLLAMFALIVALFCLTVFAFAVTNRGAGEAVSGRGYKEYRLGDYSNWLQKRVESTKNWNRIRSCLQDSKVCKSLQDSRETFADFIRSDLSPIQSGCCKPPTSCNFTYVSGTEWTKTTTPAGAAADPDCGTWSKEALCYDCQSCKAGVVATFKRDWKRVAVVNIVFLVFIIIVYSVGCCAFRNNRRDNAAYRGGWKQGGYA

SEQ ID NO: 19317 - DNA, 480 bp, Panicum virgatum
  misc_feature: Ceres CLONE 1805196
  misc_feature: Encodes the peptide sequence at SEQ ID NO. 19318
atcttctgttagaaagctgtttgaggactttgtgcacattagtctcctgctctgttctcccggaaccatggctgttgtggagctcaaggttggaatgcactgcgaaaggtgcatcaaggcgattaagaaggctataaaaacgatcgatgatatggagagctatcaactagagacggagatgaacaaggtcaccgtgacagggaacgtgaccccggaggaagtcgtcaaggctctccacaagattgggaagacggcaacctgctggacggaagattgagaactgatggttttctcagccccactctgacagtcagttagctatcaagttactacctgcagatgctactcactaccggtaacttgagcttatagtctagctaattactcgcgagtagtattagttaatctgctttcctagcttgtgtaccaggatctttgcacactgcagctattctagaaataaacagggacacatgctgt

SEQ ID NO: 19318 - protein, 69 aa, Panicum virgatum
  misc_feature: Ceres CLONE 1805196
  misc_feature (5)..(65): Pfam Name: HMA Pfam Description: Heavy-metal-associated domain
MAVVELKVGMHCERCIKAIKKAIKTIDDMESYQLETEMNKVTVTGNVTPEEVVKALHKIGKTATCWTED

SEQ ID NO: 19319 - DNA, 648 bp, Panicum virgatum
  misc_feature: Ceres CLONE 1805217-R
  misc_feature: Encodes the peptide sequence at SEQ ID NO. 19320
gctgatccccaagggcgggtgggagctggacgagtccatggacgaggcggcccggcgcgaggccgcggaggaggccggcgtggtcggcgagacgggccccgcgctggggcggtggtgctaccgcagccgcagctacgacgcgacctacgagggcttcgtgctcccgctgcgcgtcacggcggagctggagcggtggcccgagatgggcgcccgccgccgggagtgggtcacccccgccgaggccgtcgcgcggtgcccgcacgcgtggatgcgcgaggcgctgcagcgcttcgccggcaccgtcgtcgccggggccggggccacggcggcgctcctcggctccgccctgtagccgggcgcgcgggctcggctccggcctcgcgcgtttttcggccggccaaacccggacgcgcgcgcgcggcgggaggctccggctgcacggagacatgggtaacggcagtagatcgacggtgtggctcggccatcgtactgtggccaaatcgatgtcacaaggacacggctctgtacagtcctggctggttggggattttctttcggaagaaacatgtaaatctgacgtactagtagttgacacaattcttcattgtgacacgagcaaggaatttaaaacggcagcaaagattcacc

SEQ ID NO: 19320 - protein, 116 aa, Panicum virgatum
  misc_feature: Ceres CLONE 1805217-R
  misc_feature: SWISSPROT Homolog: EC 3.6.1.52 Diphosphoinositol-polyphosphate diphosphatase
LIPKGGWELDESMDEAARREAAEEAGVVGETGPALGRWCYRSRSYDATYEGFVLPLRVTAELERWPEMGARRREWVTPAEAVARCPHAWMREALQRFAGTVVAGAGATAALLGSAL

SEQ ID NO: 19321 - DNA, 1523 bp, Panicum virgatum
  misc_feature: Ceres CLONE 1805226
  misc_feature: Encodes the peptide sequence at SEQ ID NO. 19322
atcagttgagaccacctccactccactcgttccgcttctcccccgcgagagccaccagctccaccaccgccggcggccgccaccgccacccacgcccacacaatgctggcggcgtccctcaagcccgcgcccttcctcgcggccttctccccttccgcccggaggagccccgcgccgtcagtcgccttccccttccctgcccgcctcaaccagcgtccgctcctctcggccgccgcaaccgccgagggcaccggcgcctccgccaggcagggagaagactcctcctcctctttctccgccgccgctcccccgattgatgaggcccgcctggcccagtttgctgcggactgggaagccgcgcgcgcggacaaggagcaggggaagatcctcacgctacctgtgctcagggcgaacagcggcgggctcatcgtcaagttcaactccctgcaggggttcgtgcccaaccctctcctcagccccgcgcactggtgcagagacccaaaaaggcccatccaagatgttaccaaggacctagtaggaacgtccatttctgtcaaggtgtccgaagtaaatgaggaggaaaggaagcttgtcttcaccgagaaagatgctagttggtcaaaatactcttcccaaatcaagattggtgacatctatgatggaatcgtgggctcagtgttccattatggtgcatttgttcacctgcgatttcctgatggattataccatcttactggtcttgtacatatctctgaggtgtcttgggatcttgttcaggatgtccaggattttctaaatgaaggggatgctgtcaaggttatagtggtcaatattgatacggagaagtcaaggatagctttatcaatcagacaactggaggaagatcctttattggagacattggacaaagttattcctttggaagctgatcaatctcctgaccgtatcatgtctccttcagaagttgaacttctgccaggacttgatggtatatgtaatgaactattgcaagaggatggtataactgatgtacagtttgggcgccaagtgttggagaaacgtgttgtttcacaagatttggagctttggctttccaatgtgccagctaaggataacaagttcacgcttcttgcgcgagctgggaggcaggtccaggaagtgtatttgacatcttccctagaccaagagggtataaagaaggctgtgcaaagagtgctagggcgtgttccttgagtctgacacacagcaagtagaaacaaaggtgtgcctgtcctccccaattttctaactatatatgaagcattatagcaaatcaacagtactagcaaacagcctgaaatatccgtcactgtcactacactctgctaaacttttattatctctgttggatactacaccaaccaaaatctgtaaatatttgtagcacagcaatgagtagtttagccatcctttgtgcatcctctacacaagcatgtcgttaagcggtggttctatgtatttgctgggtctgccttttgatgtcg

SEQ ID NO: 19322 - protein, 376 aa, Panicum virgatum
  misc_feature: Ceres CLONE 1805226
  misc_feature (178)..(256): Pfam Name: S1 Pfam Description: S1 RNA binding domain
  misc_feature: SWISSPROT Homolog: EC 1.17.1.2 4-hydroxy-3-methylbut-2-enyl diphosphate reductase
MLAASLKPAPFLAAFSPSARRSPAPSVAFPFPARLNQRPLLSAAATAEGTGASARQGEDSSSSFSAAAPPIDEARLAQFAADWEAARADKEQGKILTLPVLRANSGGLIVKFNSLQGFVPNPLLSPAHWCRDPKRPIQDVTKDLVGTSISVKVSEVNEEERKLVFTEKDASWSKYSSQIKIGDIYDGIVGSVFHYGAFVHLRFPDGLYHLTGLVHISEVSWDLVQDVQDFLNEGDAVKVIVVNIDTEKSRIALSIRQLEEDPLLETLDKVIPLEADQSPDRIMSPSEVELLPGLDGICNELLQEDGITDVQFGRQVLEKRVVSQDLELWLSNVPAKDNKFTLLARAGRQVQEVYLTSSLDQEGIKKAVQRVLGRVP

SEQ ID NO: 19323 - DNA, 531 bp, Panicum virgatum
  misc_feature: Ceres CLONE 1805228-R
  misc_feature: Encodes the peptide sequence at SEQ ID NO. 19324
gccgctcaagctctacctccacaagttccgcgagctcgagggcgagaaggtggcctccggcgccgcgggctcctccggctccggctcgcagccgcagagggagacgacgccgtccgcgcacaatggcgccgggggggccgtgggctacggcatttacggcgccggcgccggggcaggcggaggcagcggcatgatcatgatgatggggcagccgatgtacaactccccaccgggcgcgtcagggtacccgcagcccccgcaccaccagatggtgatggccgcgaaaggtggcgcctacggccacggcggcggctcgtcgccgtcgccgccggggctcggcaggcaggacaggctttgaggcatgaccctcctgtcgctgcatggatgaagatcgaggccggccggccggcttcttggttggtgtcggcacgctggttaagttaaccatcgtttttctttttgtggtttataatgttgtgctaaatggagccagtgatatggttaatactagtagtcgcttaacctcttggc

SEQ ID NO: 19324 - protein, 118 aa, Panicum virgatum
  misc_feature: Ceres CLONE 1805228-R
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
PLKLYLHKFRELEGEKVASGAAGSSGSGSQPQRETTPSAHNGAGGAVGYGIYGAGAGAGGGSGMIMMMGQPMYNSPPGASGYPQPPHHQMVMAAKGGAYGHGGGSSPSPPGLGRQDRL

SEQ ID NO: 19325 - DNA, 337 bp, Panicum virgatum
  misc_feature: Ceres CLONE 1805228
attctccactccgcagctccgctctcaaacccccccccccccccccccccgctctccctcgtccctcccaccacgctctccctcctcctaccttgctcgctcctctcctcttcgtcgtcctccagacgaatccgcgtgtcgtccacttccacccgtgcttcgtgcgcttctgatccgctgattcgttgtgcggggagttttgctcgggctggatggaactggatcgtctgttggttagtagccttggagttgtttgagttgaccgggagcgagggagaagggaggagcttgctgtgttcgttggccgggcggatcggtggcgatgccggactccgac

SEQ ID NO: 19326 - DNA, 518 bp, Panicum virgatum
  misc_feature: Ceres CLONE 1805230
  misc_feature: Encodes the peptide sequence at SEQ ID NO. 19327
atttttcaatttggtcccgctaaagaaaacatttttcaatttggtcggattaactcccccatccctcaattccccacccaaaccctcgcgccatggcgtcgccgcgctcgccgccgcagctgatggccgacctcgtcagcgagatcctcctccgcctcccgccggaagatcccgcgtgcctcatccgcgcctccctcgtctgcaagacctggctccgcctcatctacgacggggccttcctccgccgttaccgcgccttccaccgagcgcctccgctgctcgccttcctcgcctgcagctacggcaacagcgaaccccgtttcatccccttcacttcacccaccccgttcaagccgccggcgttcgtctgctccagccgctcgcgggtcatggactgccgccgcggccgcgcccttctcttcgacatgtggggcgacagcgagggtgccctctccgtctgggaccccatcacgggcgaccggcaggtcctgcccaagcccgactgcttctacatctcc

SEQ ID NO: 19327 - protein, 141 aa, Panicum virgatum
  misc_feature: Ceres CLONE 1805230
  misc_feature (5)..(55): Pfam Name: F-box Pfam Description: F-box domain
MASPRSPPQLMADLVSEILLRLPPEDPACLIRASLVCKTWLRLIYDGAFLRRYRAFHRAPPLLAFLACSYGNSEPRFIPFTSPTPFKPPAFVCSSRSRVMDCRRGRALLFDMWGDSEGALSVWDPITGDRQVLPKPDCFYI

SEQ ID NO: 19328 - DNA, 471 bp, Panicum virgatum
  misc_feature: Ceres CLONE 1805236
  misc_feature: Encodes the peptide sequence at SEQ ID NO. 19329
gaaccagcagtacaagaagcacaagaaaaaacacttgtagccatcaacttcttcttcttcttcttcaccgtcatcaactcatcatcagctcagaccctagctagcgaccgaagaagaagaagatgagctcctccgcggaagcagctgatcagtgcggcggcggcaagacgtcgtggccggaggtggtggggatgagcatagaggaggccaagaaggtgatcctcaaagacaagcccgacgccgacatccacgtgctgccggtcggcacgccggtgaccagggatttccgccccaaccgtgtccgcatcttcgtcggcaccgtcgcccagacgccccatgtgggctagcagctctgcccatagctttcttgctcacaacatcatgcgcgttccaaataaagccatcctatgtatgtatggatgtgtgttgttaccctatggatccaataaataagggatgtaaattaaaggt

SEQ ID NO: 19329 - protein, 74 aa, Panicum virgatum; identical to SEQ ID NO: 18697
  misc_feature: Ceres CLONE 1805236
  misc_feature (15)..(74): Pfam Name: potato_inhibit Pfam Description: Potato inhibitor I family

SEQ ID NO: 19330 - DNA, 1555 bp, Panicum virgatum
  misc_feature: Ceres CLONE 1805303
  misc_feature: Encodes the peptide sequence at SEQ ID NO. 19331
ctcgctttctctctgcaaatctgaaactccaaggcatagccagagcccagaggcaaccatggagcagcagcagcaaggggccgcggccaggcggatggccacgctcgcctcccacctgcgcccgcaacccgcatcctctcaccctcagggagtgattgcgctttgcttggattcgctcttgccgctacctgccctctccgtcacctcacctgctagttccccagctttcgctatcaattcgggttcttggagaaccaagctccgacccgccccaaaggtcaaggggctcattagccgcggcgaaggcggccgccgctcccgaaagctgggaccttggcgtcaaaggaggctccttttgatggaggaggtacccctcctaatgggatccaattgccgtgcaaaaggggcggcgccaggcttcaaggtcgcgatcttgggtgcagctggtggaatcgggcagccacttgcgctactgatgaagatgaaccctctcgtttcggtgctccatctatacgatgttgtcaacgcacctggtgtcacagctgacattagccacatgaatactggtgctgtggtgcgtggattcttgggccagccacagttggaaaatgctctaactgggatggatcttgtgataattcctgctggtgtccctcggaaacctgggatgacaagggatgatctatttaacatcaatgctggaatcgtacgtactctttgcgagggaattgcgaaatgctgccccaaggcgattgtgaatgtgattagtaatcctgtcaattctaccgttccaattgctgctgaagttttcaagaaagctgggacatatgatcccaagcgccttttgggggttactacacttgatgtagtgagagccaacacttttgtgggagaggttcttggacttgatcccagagaagtcaatgttcctgtcattggtgggcatgctggagttacgatattaccactcctttcacaggtgaatcctgcctgctcattcacttcagaagaggttaattacctcacttctcgcatacagaatggtgggacagaagtagttgaggctaaagctggagcaggatcagcaactctttcaatggcgtatgcagctgctaaatttgcagatgcttgcctaagaggattgcgtggtgatgctggaatagtggagtgctcttatgtagcttctcaggtgacggagctacctttctttgcatccaaagttcggttagggcgctctggcgttgaggaaattttgccgcttgggccgttgaatgagtttgaaagagctggtctggagaaggcaaagaaagagctggcccagagtatccagaagggcgtctctttcatcaacaagtgaggcggccatctagcaaatgtccaaccccaacatagagaaagatgtgctctgttttggcttcctgctggaaaccattgtattgtaatctctctgtaaaactgtgtacatggcgtgaatgaataatctacacggctgtactaaaaaggataaatctttggtcacaaaaaaagaaaaatctggtaataaaagttgcttctg

SEQ ID NO: 19331 - protein, 432 aa, Panicum virgatum
  misc_feature: Ceres CLONE 1805303
  misc_feature (266)..(430): Pfam Name: Ldh_1_C Pfam Description: lactate/malate dehydrogenase, alpha/beta C-terminal domain
  misc_feature (121)..(264): Pfam Name: Ldh_1_N Pfam Description: lactate/malate dehydrogenase, NAD binding domain
  misc_feature: SWISSPROT Homolog: EC 1.1.1.37 Malate dehydrogenase
MEQQQQGAAARRMATLASHLRPQPASSHPQGVIALCLDSLLPLPALSVTSPASSPAFAINSGSWRTKLRPAPKVKGLISRGEGGRRSRKLGPWRQRRLLLMEEVPLLMGSNCRAKGAAPGFKVAILGAAGGIGQPLALLMKMNPLVSVLHLYDVVNAPGVTADISHMNTGAVVRGFLGQPQLENALTGMDLVIIPAGVPRKPGMTRDDLFNINAGIVRTLCEGIAKCCPKAIVNVISNPVNSTVPIAAEVFKKAGTYDPKRLLGVTTLDVVRANTFVGEVLGLDPREVNVPVIGGHAGVTILPLLSQVNPACSFTSEEVNYLTSRIQNGGTEVVEAKAGAGSATLSMAYAAAKFADACLRGLRGDAGIVECSYVASQVTELPFFASKVRLGRSGVEEILPLGPLNEFERAGLEKAKKELAQSIQKGVSFINK

SEQ ID NO: 19332 - DNA, 1154 bp, Panicum virgatum
  misc_feature: Ceres CLONE 1805381
  misc_feature: Encodes the peptide sequence at SEQ ID NO. 19333
atctcttcccttccttccccgacaaaacaaatctagggttccaagcgagcgaagcctacctccgccggccgatcccctggaccctcccggacttggagccgagtcgaggcacgagcgaagatgccgcagcggcactcgaagaacaacaacgacctcgccttcttcacgtacgaggagaagcggaagctcggctatggcacgcagcgggagcgcctggggaaggactccatcaagccctttgacgcctgctgcctctgcctcaagcctctcatcgacccgctctgctgccccaagggacacgccttctgcaaggagtgcatcctcgagtgtctcctcgcccagaagaaggacatcaagcgcaagctagcagctcatgaggcccagaaaaagcaagagaaggaagaggaggaggagaagctgatgctgcagaaggctaaggagttggacgcctttgatcaacagaatcatggagctgttccccagtaccatgatcgcagtggctcccaagacaagaatgggtttcatggagcaaacagtgtgaaggttacttccttcgaagaggaagctctccgcaatatgaaggcattctggctcccttcagctacccctgaagctacggtcaagctagatgccccctccaccgatactgtctgccctgaggggcaggagaagctcaagttgaaatcgctcttcccaatctcgttcactgaagaaaacgctgaccagaagagcaagaagtcagtggaaaagagctacatgtgccctagttgccagtccaccctcacaaacaccatgtccttggtggcgatcagcacctgtggccatgtcttctgcaagaagtgctctgacaagtttctagtgaaggataaagtttgcttggagtgtagcaaaccatttaaggagaggaatctggttcctttggagaaaggaggtactgggtttgctgcgcatgatgaacgcttggaggcaagggatttcaagtatttggggagtggttctgggttagggttagtgaaaccagctccaaagacttactagccttcaatagttgtagcagctgttgtatattgcttatcatggtttcatcaaactatgtaacctgaaaattttgtttcatggtatccatatgtttgtatttgcaacagttgatgttc

SEQ ID NO: 19333 - protein, 305 aa, Panicum virgatum
  misc_feature: Ceres CLONE 1805381
  misc_feature: SWISSPROT Homolog: EC 5.2.1.8 Peptidylprolyl isomerase
MPQRHSKNNNDLAFFTYEEKRKLGYGTQRERLGKDSIKPFDACCLCLKPLIDPLCCPKGHAFCKECILECLLAQKKDIKRKLAAHEAQKKQEKEEEEEKLMLQKAKELDAFDQQNHGAVPQYHDRSGSQDKNGFHGANSVKVTSFEEEALRNMKAFWLPSATPEATVKLDAPSTDTVCPEGQEKLKLKSLFPISFTEENADQKSKKSVEKSYMCPSCQSTLTNTMSLVAISTCGHVFCKKCSDKFLVKDKVCLECSKPFKERNLVPLEKGGTGFAAHDERLEARDFKYLGSGSGLGLVKPAPKTY

SEQ ID NO: 19334 - DNA, 1392 bp, Panicum virgatum
  misc_feature: Ceres CLONE 1805401
  misc_feature: Encodes the peptide sequence at SEQ ID NO. 19335
ctggttggtgttggtgccttcctctccacagctgccgcaccttatcgtcttcctcctcggctgcttcatcctcaacggcagcgccagcgcctccttcctcttccccgtcgatcaacatggctgctcaagtgttgtttgtgcagaggagaagactgctcctgccaagacagaggaggcggagcagcagccacggcctcaaccggcagcaggggcggcgcgcagggctgggccatcggcgccggccaaccccttcgacttctccaccatgatgaacctgctcaatgaccccagcatcaaggagatggcggagcagatcgccaaggacccggccttcacggagatggcggagcagctgcagaagatgacggtggtgtcgccgcggcaggcgccggcgcccgaggcggcggtggcgctggacccgcacaagtacgtggcgacgatgcagcagctgatgcagaacccgcagttcgtggccatggcggagcggctgggcagcgcgctgatgcaggaccccgccatggccaccatgctgggcggcctcaccaaccccgcgcacaaggagcagctcgaggcccgcatcgcgcgcatgaaggacgaccccacgctcaagcccatcctcgacgagatcgaggccggtggccccgccgccatgatgaagtactggaacgaccccgaggctctgcacaagttcgggcgggccatgggcgtcggcccgtcgagcgaggccgccgccggcgcggaggaggaagaggccgccggcgaggaaggcgatggcgagtacgaggaggaggaggaggagtccgtcatccaccacacagccagcgtcggcgacgtggagggcctgaagaaggcgctggaggagggagtggacaaggacgaggaggactcggaagggcggcgaggcctgcacttcgcgtgcggatacggcgaggtcaagtgcgcgcaggtgctcctggaggccggcgcggcggtggacgccgtggacaagaacaagaacacggcgctgcactacgcggccggctacgggcgcaaggaatgcgtggcgctgctggtcgagaacggcgccggcgtgacgctgcagaacctggacgggaagacgcccatcgacgtcgccaggctcaacaaccaggaggacgtcctcaagctgctcgagaagcacgccttcgtatagacgctgcttgcttgcttcatgccctccttccttaatttgctctgctgcaccctgctttgctttgctttctcggcccaaacaagtcccttcttttctttattattatatatatacatagctcggtcgtcagtgtatgtatgtatgtactgagattatccatgccatgcatgccagatttagcttgcgtgattaaggttgaataaggaagagattttcatttc

SEQ ID NO: 19335 - protein, 389 aa, Panicum virgatum
  misc_feature: Ceres CLONE 1805401
  misc_feature (330)..(362): Pfam Name: Ank Pfam Description: Ankyrin repeat
  misc_feature (297)..(329): Pfam Name: Ank Pfam Description: Ankyrin repeat
  misc_feature: SWISSPROT Homolog: EC 2.4.2.30 NAD(+) ADP-ribosyltransferase
  misc_feature: The sequence is a functional homolog of SEQ ID NO 1839 in the 10/374,780 US patent application
WLVLVPSSPQLPHLIVFLLGCFILNGSASASFLFPVDQHGCSSVVCAEEKTAPAKTEEAEQQPRPQPAAGAARRAGPSAPANPFDFSTMMNLLNDPSIKEMAEQIAKDPAFTEMAEQLQKMTVVSPRQAPAPEAAVALDPHKYVATMQQLMQNPQFVAMAERLGSALMQDPAMATMLGGLTNPAHKEQLEARIARMKDDPTLKPILDEIEAGGPAAMMKYWNDPEALHKFGRAMGVGPSSEAAAGAEEEEAAGEEGDGEYEEEEEESVIHHTASVGDVEGLKKALEEGVDKDEEDSEGRRGLHFACGYGEVKCAQVLLEAGAAVDAVDKNKNTALHYAAGYGRKECVALLVENGAGVTLQNLDGKTPIDVARLNNQEDVLKLLEKHAFV

SEQ ID NO: 19336 - DNA, 572 bp, Panicum virgatum
  misc_feature: Ceres CLONE 1805405-R
  misc_feature: Encodes the peptide sequence at SEQ ID NO. 19337
atttgtgatgctacccaggaaagacaagatgctatgtatcagctggtgaaggaaaaagttgaccttattctggttgttggaggatggaactccagtaacacctctcatttgcaagaaatcggagaacttagtggaattccatcctactggattgacagtgagcaaaggattggcccaggaaacaggatcagctacaagctaaatcatggtgaacttgttgagaaagagaactggttacccgaggggcctattacaattggtgttacttctggtgcctcaactccggacaaggttgttgaggatgcgcttcagaagatattcgagatcaagcgtcaggaaattttgcaggctgcctgaattctaagcaggaagagtgtaatagtgatggcttggcgaaggttagtagaactgttgcacaggcaatgcttgtacagtagataagaatgttacgatttaggcatgtattaccacgaggcactgtgcttgtgctcggatttatcatctggtgggaagaaattgttggaatcattcgtatggataacagttacatcagttgtaactttttggccctt

SEQ ID NO: 19337 - protein, 118 aa, Panicum virgatum
  misc_feature: Ceres CLONE 1805405-R
  misc_feature (1)..(109): Pfam Name: LYTB Pfam Description: LytB protein
  misc_feature: SWISSPROT Homolog: EC 1.17.1.2 4-hydroxy-3-methylbut-2-enyl diphosphate reductase
  misc_feature: Functional homolog of the protein sequence given in SEQ ID NO 50777
  misc_feature: Useful for making plants with modulated nitrogen use efficiency
ICDATQERQDAMYQLVKEKVDLILVVGGWNSSNTSHLQEIGELSGIPSYWIDSEQRIGPGNRISYKLNHGELVEKENWLPEGPITIGVTSGASTPDKVVEDALQKIFEIKRQEILQAA

SEQ ID NO: 19338 - DNA, 486 bp, Panicum virgatum
  misc_feature: Ceres CLONE 1805405
attcgccgtccgcttgctgcctgctcccgctcccccgcggcacctctccgccacgaggtccacgcgcgcgatggcgaccctcaccacgcacctccgctccgcgctcctcgccccgggcggggggcgccgcggccgccgccgcgcgccctcctccgtgcgctcgcacgcctcccccccctcgccctcagccgcgaagtccgcgaagatcggccgggacttccacaagaaggccttcccccagaaccggcacccgcggcgactgctaccacttcacgggggtcgggctcgtgacggacacggaggagctcaggaacctcgagcacaccagtgatgagcgcatgaacgactaggagaacgagaacggatcgccccgagccgccgtgaccgctcatctcgcgtagacataaggaatctcctcgggcatatagtgagctgtgctgatcccatgagaagagcgcgggcaaatacgtgaggaacgcatctggc

SEQ ID NO: 19339 - DNA, 1186 bp, Panicum virgatum
  misc_feature: Ceres CLONE 1805421
  misc_feature: Encodes the peptide sequence at SEQ ID NO. 19340
agagcagtactgcggagcaagtagaataggcgtaatcttccctcctccgtcgaaggaaggggaggaggctggagataccggtgggcggcggctgggggcgccatggattgggctgttccggcattgatgaactccgtagccgacgggccgtcctaccgggacctctgctgctacggggccggaatcgcagggaacgtcttcgccttcgtcctcttcatctcccccctgccgacattcaggcggatcgttcggaatggatccacggagcagttctcggccatgccgtacatctactcgctcctcaactgcctcatctgcatgtggtacggcctgcccttcgtctcgtacggtgtcatcctcgtcaccaccgtcaactccatcggcgccgccttccagctcgcctacaccgccgtattcatcgcctttgctgacgccaaggagaggttgaaggtctctggtctcctggcaaccgtatttgtggtgttcggcctgattgtgtatgttagtttggcgttgcttcatcacagtacacgacagacattcgtcggatatctcagtgtcgcgtccctcatattcatgttcgcgtcccccttgtccatcattaatctggtcatcaggacaaagagtgtggagtacatgcccttctatttgtcattatctatgttcctgatgagtgtatcgttcttcgtatatggggtgctgctgcatgatttcttcatatatattccaaacgggattggaaccatattgggtgtcatacagctgttgctgtatgcctacttcagaaaaggatcaagaggggaagacaggcggccattgctagtcacacatacatgagcatgccaaagaacaaggcagcctatcacattgatgggagtcaaggccgaggttatctgaagacagaagacaccaattgccgtggttgtccaaatcgtttcgtttcagttaaaagtacgctgtctatcggttatgagtacacgcaacaagtgtcatagcttcgctgtatattccacggtagatgctgcgaattgttggaatcatttgtttaaatatatatgtatatataaattgaataaagttttgtatagcattgttgttgcgtggacttcatcaatggatggggcctcctgcatgtacactaaaaacaaggagatttggtaataaaagaggattgtttcatcatctc

SEQ ID NO: 19340 - protein, 244 aa, Panicum virgatum
  misc_feature: Ceres CLONE 1805421
  misc_feature (146)..(232): Pfam Name: MtN3_slv Pfam Description: MtN3/saliva family
  misc_feature (27)..(113): Pfam Name: MtN3_slv Pfam Description: MtN3/saliva family
MDWAVPALMNSVADGPSYRDLCCYGAGIAGNVFAFVLFISPLPTFRRIVRNGSTEQFSAMPYIYSLLNCLICMWYGLPFVSYGVILVTTVNSIGAAFQLAYTAVFIAFADAKERLKVSGLLATVFVVFGLIVYVSLALLHHSTRQTFVGYLSVASLIFMFASPLSIINLVIRTKSVEYMPFYLSLSMFLMSVSFFVYGVLLHDFFIYIPNGIGTILGVIQLLLYAYFRKGSRGEDRRPLLVTHT

SEQ ID NO: 19341 - DNA, 1444 bp, Panicum virgatum
  misc_feature: Ceres CLONE 1805425
  misc_feature: Encodes the peptide sequence at SEQ ID NO. 19342
gcttcagctcacccaagaacaatcgagctagttgagagcatatcctatccagttagctagctagcctctctgaactccgagtggtaagcttagaacaagaagcagcagcgcagcagcagcaatggcgaagctttgcacagtgctgttggcagcagtggtcgcgctcgcgcttctggcgagccccattgatggcacccgcaagctcagcaagcccaggccaaagcccaagccgaagccaggcagccacaggccggcgccggcagccaaggtcagccacagccacaagccggcggctcctgccgtcaaggtcagccgcaagccggcgcctgcggccaaggcccaccgcaactacaccgccaccccctcgtctccgtccaccgtgtatggctccggcggctggttgtccggcgccggcgcgacgtactacggcgcccccaacggcgacggcggcgaaggcggcgcgtgcgggtaccagaccgccgtcgggaagcagccgttcgactcgatgatcgccgccgggagcacgccgctgtacaggggcggcgagggctgcggcgcctgctatgaggtcaaatgcacgaccaatgcggcctgctccggccagccggtgaccatcgtgatcaccgacgagtcccccggcgggctgttcccgggcgaggtcgcccacttcgacatgagcggcacggcgctgggcgccatggcgaggcccggcatggccgacaagctccgcgccggcggcgtcctgaggatccagtacaggcgggtgcagtgcaggtaccccggcgtgaacgttgccttcaaggtggaccagggcgccaaccccttctacttcgacgtgctggtcgagttcgaggacgacgacggcgacctcagcgccgtggagctcatggaggccggcagccgggcctggacgcccatggcgcacaactggggcgccacgtggcggctcaacaacggcaggaggctcaacgcgcccttcgggctccgtctcacctccgactccggcagggtgctcgtggtcaacaacgccatccccgccgggtggaagcccgggaggacctaccggtcgctggtcaactacccctgaatcgttcttgcattgcgttgccaccaatgggggagcagcgcgtggtgggtgaggaaaaaaatgtgcgtccgggtttggcgagaggcggtgtcaaaggaggaggaggttgaagaagggaatggtgttcttccctccctccacgcggtctctgcattcccctagtgatgtgtgtgaatggtgcctgtagtttcgttgcttccttggcctccgttgtgctgtggtgcaaaagggagaagcttgagctgcgacaaatgttgcatgccaaatcgtcaagttgtgtgtttttgaattctgtacttagtgcgtgtacgtcgcaagtcctttgatcaaaatttagagaaatgaattactgtttgg

SEQ ID NO: 19342 - protein, 321 aa, Panicum virgatum
  misc_feature: Ceres CLONE 1805425
  misc_feature (130)..(212): Pfam Name: DPBB_1 Pfam Description: Rare lipoprotein A (RlpA)-like double-psi beta-barrel
  misc_feature (224)..(305): Pfam Name: Pollen_allerg_1 Pfam Description: Pollen allergen
  misc_feature: Functional homolog of the protein sequence given in SEQ ID NO 50374
  misc_feature: Useful for making plants with altered carbohydrate content
  misc_feature: Functional homolog of the protein sequence given in SEQ ID NO 50375
  misc_feature: Useful for making plants with altered cell wall content and/or composition
MAKLCTVLLAAVVALALLASPIDGTRKLSKPRPKPKPKPGSHRPAPAAKVSHSHKPAAPAVKVSRKPAPAAKAHRNYTATPSSPSTVYGSGGWLSGAGATYYGAPNGDGGEGGACGYQTAVGKQPFDSMIAAGSTPLYRGGEGCGACYEVKCTTNAACSGQPVTIVITDESPGGLFPGEVAHFDMSGTALGAMARPGMADKLRAGGVLRIQYRRVQCRYPGVNVAFKVDQGANPFYFDVLVEFEDDDGDLSAVELMEAGSRAWTPMAHNWGATWRLNNGRRLNAPFGLRLTSDSGRVLVVNNAIPAGWKPGRTYRSLVNYP

SEQ ID NO: 19343 - DNA, 645 bp, Panicum virgatum
  misc_feature: Ceres CLONE 1805435
  misc_feature: Encodes the peptide sequence at SEQ ID NO. 19344
acttcgccctctctctcccgcaacaatccacgcatccaccaccccgccgcacccaatccccagcaaccgccgccggtgtgggcgccatgggcctccgcgccctgttcctcctctcgctcgccgcggcggcactggcggcggagcagcagcagcagccgcagccgcagcggccgcccgcattgccgcccgcgggcgcgccgggggtgagctccaactcggtgctggtggcgctgctggactcgcgctacacggagctggcggagctggtggagaaggcgctcctgctgcaggcgctcgaggacgccgtcggccggggcagcgtcaccatcctcgccccgcgcaacgaggcgctcgaccgggacctcgaccccgacttccgccgcttcctgctcgagccccgcaacctgcgggcgctccagtccctgctcctcttccacgtcctccccgcccgcgtccgcctccccgtctcctcctcctcctccctcctcacccacccgacgctcgccggcgagccgctcgagctcgccgccgcggccgtcacgcgccccgacgccgtggtccgccccgacggcgtcatccacggcatcgagtgcctcctcgtcccgcgctccgtgcaggaggccttcaaccgccgccgcagcctgg

SEQ ID NO: 19344 - protein, 186 aa, Panicum virgatum
  misc_feature: Ceres CLONE 1805435
  misc_feature (53)..(173): Pfam Name: Fasciclin Pfam Description: Fasciclin domain
  misc_feature: Functional homolog of the protein sequence given in SEQ ID NO 50622
  misc_feature: Useful for making plants with altered carbohydrate content
  misc_feature: Functional homolog of the protein sequence given in SEQ ID NO 50623
  misc_feature: Useful for making plants with altered cell wall content and/or composition
MGLRALFLLSLAAAALAAEQQQQPQPQRPPALPPAGAPGVSSNSVLVALLDSRYTELAELVEKALLLQALEDAVGRGSVTILAPRNEALDRDLDPDFRRFLLEPRNLRALQSLLLFHVLPARVRLPVSSSSSLLTHPTLAGEPLELAAAAVTRPDAVVRPDGVIHGIECLLVPRSVQEAFNRRRSL

SEQ ID NO: 19345 - DNA, 692 bp, Panicum virgatum
  misc_feature: Ceres CLONE 1805435-R
  misc_feature: Encodes the peptide sequence at SEQ ID NO. 19346
gagcatgtacaacgcggtgcgccggttcggcaaggtgcgctacgacacgctgcggctgccgcacaaggtcaccgcgcgcgaggccgacggctccgtcaagttcggcgctggcgagggcagcgcctacctcttcgacccggacatctacaccgacggcaggatctccgtgcagggcatcgacgccgtgctgctcccgccggcggaggacggcgggaagtcacccgccgcctcgcccgccaggagggcgcccgccgtcaccggcgccaccgcccagcccaagctccggcgaggcaagttgctcgaaggggcttgccggttcatgggcgtcttcgtccggcggtcgcggttcgcgagctgccaataggccacggacggatcacggatggtcggatgggcatgcgcgcgcatctgtctgcctcgccacggatggagggagaaattttggcctctcagtttctaggaggcagcagtcacgagccgtgaggactgaggaggaacaagcagatgcaggaggacaacggggtgcgtctgctcgggaagaggagaaatgggtgggaatgcgaaactgtttatactggagagcgacatgatgtatagcattagagagctctttttttcctttccttttgatttcttttattttttaattatgttaattacctttgttttcttatataaaacaggaattctgg

SEQ ID NO: 19346 - protein, 120 aa, Panicum virgatum
  misc_feature: Ceres CLONE 1805435-R
  misc_feature: Functional homolog of the protein sequence given in SEQ ID NO 50622
  misc_feature: Useful for making plants with altered carbohydrate content
  misc_feature: Functional homolog of the protein sequence given in SEQ ID NO 50623
  misc_feature: Useful for making plants with altered cell wall content and/or composition
SMYNAVRRFGKVRYDTLRLPHKVTAREADGSVKFGAGEGSAYLFDPDIYTDGRISVQGIDAVLLPPAEDGGKSPAASPARRAPAVTGATAQPKLRRGKLLEGACRFMGVFVRRSRFASCQ

SEQ ID NO: 19347 - DNA, 1333 bp, Panicum virgatum
  misc_feature: Ceres CLONE 1805436
  misc_feature: Encodes the peptide sequence at SEQ ID NO. 19348
atctcccaagaactctgccaaaacccttgcccactgtcccctctcccgacctccccggcggctgacccgaatccgcgttctcaggctcgggatccgggcgctcgcggcgatggacggcggcggcgggggcggcgcggagggggagctcacggcgcaggagacggcgctctacgaccgccagatccgcgtctggggcgtcgatgcccagaagaggctaagtaaggcgcacgtgcttgtgtgcggcatgaacggaaccaccattgagttctgcaagaatattgttctagcaggagttggtagtttatccttgatggatgatcacatggtcacagtggatgatctgaatgcaaatttcctgattcctcctgatgagagcatatatggtggtagatctcgagcggaagtttgctgtgagtctttgaaagatttcaatcctatggttcgagtttctgttgagaagggtgatccatcattggttgatggagaattccttgacaaatttgacatcgttgtagttagtggtgcatctcttaaaacaaagctgtttattaatgacaactgccggaagagaagcaagcatattgcattttacgctatagactgcaaggactcctgcggtgaaatatttgttgacttacagaagcatagttatgttcagaaaaagcctggaggagaaactgaacagcaggagttgacatatcctagtcttcaggaagctatctcggtacattggagtactctaccaaagaagacagcaaaattatactttgccatgagagtcctggagaattatgaattatctaaagggtatagtcctggtgaaacaacactttctgatatacctgcagttttgtctcagaggaaggatatgtgtgataaaatgtctttgagtgagtctcaaattcctactgctctcatggaacgactgctagcagctggaaagaaggaacatcctcctgtatgtgccatactaggtggtattcttggtcaggaggtgattaaatcaatatcctgcaagggtgatccaatcaagaatttcttcttttttgatgcggctgacggtaaaggtgtcatcgaggatatcccaccaccacctactgcaaactaacgtgctcagctaccaaactaccaattctacctggttcactaatccttgtacccactcattagcatcgaacatgtagcaacttagattcatagccaagtgagaaggcaagttgacttcactccaatgtggtgtcttaggaattgtatcaggcagaaaacgtggcagtatgcactttcaagctgaagtctggatggtttccatgctttagggcgtgatggatccctt

SEQ ID NO: 19348 - protein, 332 aa, Panicum virgatum
  misc_feature: Ceres CLONE 1805436
  misc_feature (37)..(174): Pfam Name: ThiF Pfam Description: ThiF family
MDGGGGGGAEGELTAQETALYDRQIRVWGVDAQKRLSKAHVLVCGMNGTTIEFCKNIVLAGVGSLSLMDDHMVTVDDLNANFLIPPDESIYGGRSRAEVCCESLKDFNPMVRVSVEKGDPSLVDGEFLDKFDIVVVSGASLKTKLFINDNCRKRSKHIAFYAIDCKDSCGEIFVDLQKHSYVQKKPGGETEQQELTYPSLQEAISVHWSTLPKKTAKLYFAMRVLENYELSKGYSPGETTLSDIPAVLSQRKDMCDKMSLSESQIPTALMERLLAAGKKEHPPVCAILGGILGQEVIKSISCKGDPIKNFFFFDAADGKGVIEDIPPPPTAN

SEQ ID NO: 19349 - DNA, 1476 bp, Panicum virgatum
  misc_feature: Ceres CLONE 1805442
  misc_feature: Encodes the peptide sequence at SEQ ID NO. 19350
aggagatcgctagctgcgtcgagtccctcctccgcggctccgccggcgggtccggggaggcctcgcttgccgccgtgctgcagcaggcagaggccaagttcggaacggacctctcccacaaggcgcagttcatccgcgaccagatggacctcttcttcggcccgcgcctccagccgcagccgccgcccaaaccccaggcggcccctccgccgcaggctattacaaccgcggcctccgtgccgcagccccaggctcaggtcctgcagcaggcgcaggccccgcctcctgcacagcagattcaggcgcagccgcagcagcaccagcagctcgcggcgctccagccgcagctcatcttccaggccatgcctcagctcccggccccagccaccatccctgcggtgtcctcaccgccggccgtaccagccatggccttctacccgccgccgccgctcgccttccgctacaccaccggcctaggcggggccgccacgggtgggaccgtctccttccaacagccggcccctggagtcgggggcactgctctccccaccgcggcaccgcaggtcgccggcgacaacaaggaaagtgcttctaagcggaaaaggggtggacctggtggtttaaataaagtttgtgcaatttcacctgaacttcagaccattgttggcgagactgctatgtcaagaactcagattgtgaagcagctgtgggcatatatcaggcagaataatcttcaagatcctgatgacaaaagaaagatcatttgcaatgatgaacttcgtgtggtttttggaactgacaccactgacatgtttaagatgaacaaattgttggctaagcacattaccccacttgatccaaaagatcaaattcgcgacgtgaaaagaatgaaggctcccaccgagactcctcaacatggacaactcattaatcaaccctctgtggttatttctgacgcgctagcaaagtttattggaactgatggaacattccctcaagaggatgctctgaaatacctctgggattacataaaggcaaaccaactcgaggatgtcatcaatggatcgatattatgtgattcaaaacttcaagagctatttggctgtgaaagcattcctatgtcaggattatcagaaatgcttggtcaccacttcatcaagaagacatagcaaatcctcattaacagatctaggtttgcagtgtggcagatatcataggcctaacattaccatatggtgttcttgacagaatggacagcatagcttatgtatttcttcaatgttatggattatgaattgtcaggcaaagatcagattattgtggtagcctgtagtttgttattcattcaggccaccgctgtggtactggtgtaacctttactgaattcgtagtgttagttcctaaatgtctaaatgtctaaatgtcatgctgactatgtaaagttaagctttcaattgagtgccaggttgaactctt

SEQ ID NO: 19350 - protein, 388 aa, Panicum virgatum
  misc_feature: Ceres CLONE 1805442
  misc_feature (207)..(282): Pfam Name: SWIB Pfam Description: SWIB/MDM2 domain
  misc_feature (311)..(385): Pfam Name: SWIB Pfam Description: SWIB/MDM2 domain
EIASCVESLLRGSAGGSGEASLAAVLQQAEAKFGTDLSHKAQFIRDQMDLFFGPRLQPQPPPKPQAAPPPQAITTAASVPQPQAQVLQQAQAPPPAQQIQAQPQQHQQLAALQPQLIFQAMPQLPAPATIPAVSSPPAVPAMAFYPPPPLAFRYTTGLGGAATGGTVSFQQPAPGVGGTALPTAAPQVAGDNKESASKRKRGGPGGLNKVCAISPELQTIVGETAMSRTQIVKQLWAYIRQNNLQDPDDKRKIICNDELRVVFGTDTTDMFKMNKLLAKHITPLDPKDQIRDVKRMKAPTETPQHGQLINQPSVVISDALAKFIGTDGTFPQEDALKYLWDYIKANQLEDVINGSILCDSKLQELFGCESIPMSGLSEMLGHHFIKKT

SEQ ID NO: 19351 - DNA, 1156 bp, Panicum virgatum
  misc_feature: Ceres CLONE 1805448
  misc_feature: Encodes the peptide sequence at SEQ ID NO. 19352
atcacaattcacagcagcacacttgcgcaaaaaggtcggtcacctagcattgagctcacatcgcacctcacaactttccgggcgcaatttagcgagtcgttttcagcaatggtttctcgtgtgctggtagtggcggtggtactgatgagcctggcgcagctctccgcggggagcaggaggctgatggagctgtacatccctccggcgagcgaccagctgacgtaccaccacggcaccgtgctcagcggcggcatcccggtgtccgtcctctggtacggcaagttcacgccggcgcagaggtccatcgtctccgacttcctcctgtcgctcaccaccgcgccgggcgcggccacgccgtcggccgggcagtggtggggcaccatcgaccagctctacctgtcgagcgccgccacgaacggcgccgcgccggcgcgcgtgctcctcgacgcgcaggtgtccgacgaggcttgctcgctggggaggtcgctcacgctggcgcaggtcgagcagctcgcggcgcgcgccggcgggaagaagggcggcatctcgctggtcctcaccgacgaggacgtggccgtggaggggttctgcagcagccggtgcggcaagcacgggtccgccgccccgggcaactccgcctacatctgggtgggcaactccgcgaagcagtgccccgggcagtgcgcgtggccgttcgcgcagccgcagtacgggccgcaggccaagcccctggtggcgcccaacggcgacttcgggatggacggcctggtgatggtcctcgccaccatggtggccggcaccgtgaccaacccctacggcgacgcgttctaccagggccccagggaggcgccgctggaggcgtgcaccgcgtgcccgggcgtctacgggagcggcgcctacccgggcttccccgggaagcttctcgtcgacgagaccaccggggccagctacaacgccaacggcgccaacgggaggaagtacctgctcccggccttgtacaacccggagacgtccacctgcagcacgctggtgtagtcgtgtcgagtccgtagtgatgtagcctgtaccagacactgccctgttttctgtacgcctgaccaaatatgtacatatacgagtttgaacttgggaagaaatgaaattactttgttcgttt

SEQ ID NO: 19352 - protein, 308 aa, Panicum virgatum
  misc_feature: Ceres CLONE 1805448
  misc_feature (37)..(308): Pfam Name: Phi_1 Pfam Description: Phosphate-induced protein 1 conserved region
MVSRVLVVAVVLMSLAQLSAGSRRLMELYIPPASDQLTYHHGTVLSGGIPVSVLWYGKFTPAQRSIVSDFLLSLTTAPGAATPSAGQWWGTIDQLYLSSAATNGAAPARVLLDAQVSDEACSLGRSLTLAQVEQLAARAGGKKGGISLVLTDEDVAVEGFCSSRCGKHGSAAPGNSAYIWVGNSAKQCPGQCAWPFAQPQYGPQAKPLVAPNGDFGMDGLVMVLATMVAGTVTNPYGDAFYQGPREAPLEACTACPGVYGSGAYPGFPGKLLVDETTGASYNANGANGRKYLLPALYNPETSTCSTLV

SEQ ID NO: 19353 - DNA, 652 bp, Panicum virgatum
  misc_feature: Ceres CLONE 1805451-R
  misc_feature: Encodes the peptide sequence at SEQ ID NO. 19354
gcgtgcgcctggggctcaaggtcgtgcgcggcgcgtacctgacccgcgagacccggctcgcggcctccctcggcgtgccgtcgccgatccacggcagcatccaggacacccacgactgctacaacggctgcgccgccttcctcctcgaccgcgtccgccgcggctccgcctccgtcatgctcgccacccacaacatcgagtcagggcaactcgcggcggcgcaggcgctggagctggggatccccaagggcgaccgcaacctgcagttcgcgcagctgatgggcatggcggacgggctgtcgctgagcctccgcaacgccgggttccaggtcagcaagtacctgccgtacgggccggtggagcagatcatcccctacctgatcaggcgcgccgaggagaacagaggcctcctctccgcctcctccttcgacaggcagctgctccggacggagctggcgaggagggtcaaggctgcggtggtggggcgtgagtgaggcgagcttgcggagcctgtgaggctgtgaagctggttgctgggacaagggcgagttgaaggctagaagctgtaaatacacccttcggtcttcaggcattgatgtatcctggatttcgttgaataattgaatgaatagaacaatgttcttctaggatc

SEQ ID NO: 19354 - protein, 163 aa, Panicum virgatum
  misc_feature: Ceres CLONE 1805451-R
  misc_feature: SWISSPROT Homolog: EC 1.5.99.8 Proline dehydrogenase
VRLGLKVVRGAYLTRETRLAASLGVPSPIHGSIQDTHDCYNGCAAFLLDRVRRGSASVMLATHNIESGQLAAAQALELGIPKGDRNLQFAQLMGMADGLSLSLRNAGFQVSKYLPYGPVEQIIPYLIRRAEENRGLLSASSFDRQLLRTELARRVKAAVVGRE

SEQ ID NO: 19355 - DNA, 440 bp, Panicum virgatum
  misc_feature: Ceres CLONE 1805451
attgcatcgcgtcctcctccacaccctgccttccgtagcttccacacaagcgcgtcgttctttctcctttctctgtcgccgggaaagcgccgccgccgccgcgcgccctcgcttgcgtcccgttccctcgggggcccgatccggcaaaggcccgaccttccatggccatcgcctcccgcgtctcgaagcgcgcgctgtccaccttcgccgccgccgagctcccggaggcggtcgccgccgcggaaccgctgccgccggccgcgccggcgccgtgcgagagggccgccggccgggtgctggggttcgaggacacaggccggctgttcgccggggagcccacgtcggcgctagtgcggacgctcgccgggctccgtgccctctccgtgtggtcgcttgtcgacgcccgtactgccgtgctgcggttcgccggcggtggcagg

SEQ ID NO: 19356 - DNA, 989 bp, Panicum virgatum
  misc_feature: Ceres CLONE 1805457
  misc_feature: Encodes the peptide sequence at SEQ ID NO. 19357
atcggctaatccccgcctccaccgagtcctcccatagtcccatccatccccctcctgaaaccggattggggcgaaccggaccgcatcagaagaggtctcgtctagcagccgagttcgcacgccggcgcggacggccatggaggacgaggagcacgaggtgtacggccaggagatccccgtcgacggcgaggacgtcgacatgtccggggccggcgacgacgccgccaagctgcaggagctcgacgagatgaagcgccgcctcaaggagatggaagaggaggcagccgcgctccgcgagatgcaggccaaggtcgccaaggagatgcaaggtgtagatcctaatgcaaccacatctgaaaacaaagaggagatggatgctcggtcagtattcgttggaaatgttgactatgcatgcactccagaagaagtacagcagcacttcaattcttgcggaactgtcaacagagtgacaatactgactgacaagtttgggcagcctaaaggttttgcttatgtggaatttgttgaagttgaagctgttcaggaagctattaagctgaacgagtcagagttgcatggccgccaactcaaggtggcaccaaagaggactaatgttcctgggatgaagcagccccgcggccgaggtttcaatccctaccatggccacccctacatgaggccatatggttatagtccttatggctatgggagattccccagattccgccgccctcgcagaccttatttttgattctcaggtctccatagagttgtcagcacatgaagcatagtcggttcagattcaggaggaagctgggccttattcccgctttctgttatttcatagcgtaacaacatcccgggtttatgttcccagacatgttttcgaattgacgatgcttaaggcttgtactgtactgtattgttgtctttcagtgacggttgtgcaaaacaattacgatttggttacacggaaggtactattgtgg

SEQ ID NO: 19357 - protein, 204 aa, Panicum virgatum
  misc_feature: Ceres CLONE 1805457
  misc_feature (84)..(153): Pfam Name: RRM_1 Pfam Description: RNA recognition motif. (a.k.a. RRM, RBD, or RNP domain)
MEDEEHEVYGQEIPVDGEDVDMSGAGDDAAKLQELDEMKRRLKEMEEEAAALREMQAKVAKEMQGVDPNATTSENKEEMDARSVFVGNVDYACTPEEVQQHFNSCGTVNRVTILTDKFGQPKGFAYVEFVEVEAVQEAIKLNESELHGRQLKVAPKRTNVPGMKQPRGRGFNPYHGHPYMRPYGYSPYGYGRFPRFRRPRRPYF

SEQ ID NO: 19358 - DNA, 1652 bp, Panicum virgatum
  misc_feature: Ceres CLONE 1805458
  misc_feature: Encodes the peptide sequence at SEQ ID NO. 19359
gcgtcacggcgctttcggccacttctgctacttggaggacttgcacggcggcgggcgctgctgcccggccctgttggacccgggtgggtgggggctgctcgtgggatccaatccatggacggaggcaagaaggctgaccagccgcacggcgatgtcgccgaggaggaccccggccgccggcagcgttctgtggtggatgaagccgacggcgacgagaaggcgcctcgccggagcaagcgggttgcttccctcgacgtgttccgcggcctcaccgtcgctctgatgatactggtggacggcgccggcggcgagtggccggtcatcgggcacgcgccgtggaacggctgcaacctcgccgacttcgtcatgcccttcttcctcttcatcgtcggcatggccattcccctctccctcaagagaattcctgaccgtggttgggctgtgaggagagtagtcatcagaacattgaagctgctcttttggggaattctgttgcaaggaggttactctcatgctccggataaactgacatacggagttgacatgaagcacgtaagatggggtggaattctccagaggattgcccttgcatacttggtagttgcaattctagagatcgttacaaaagatgcaaagattcaggatcggtcaagttcgggtttctctatcttcagaatgtacttttcccaatggattgttgcatgctgcattctagtggtttaactgtcccttgtttatgggatttatgttcctgactgggaattcagagtgcaaaatactgacagcccaaactacggcaaagttttaatggtgacatgtggtacgagggggaaattaaaccctccttgcaatgctgtaggttacattgaccgcaaaatccttggcatcaatcacatgtaccagagaccagcatggagaaggcactgggcatgtactgacagttccccacatgagggaccttttaagaacgatgccccggcatggtgtgttgcgccattcgaacctgaagggatactaagctcattttctgcggtgttaagtacaatcatcggtgtgcactatgggcatgtacttgtccatatgaagagtcatacagacaggctgaggcagtgggttaccatgggcatagctcttcttgttcttgggatcattctacatttttcacatgcaattccgctaaacaagcagctctacacattcagttgcatctgcgtcactgccggcgctgctggaatcgtgttctccttactatacttcatggttgacatcctgaacctgcactgcgtatttgcgcccctgcgatggatcggcatgaacgcgatgctggtgtacgtgatggccgcggagggcatcttcgaggggttcctcaacgggtggtactacgagggcaccaacaacacgctggtttactgggtgaggaagcacgtgttcgtgaaggtgtggcactccaccagggtcggcatcctcctctacgtcctcttcgcgcagatcctcttctgggctctcgtctccggcgtcctccaccgcgctggcctctactggaagctctagcgaggatccaacagcttactgtacagacattattgtgcttccatttgttcagaattgtgtggatcgtatctgaattgcagctcgcaggccctgaatttgac

SEQ ID NO: 19359 - protein, 202 aa, Panicum virgatum
  misc_feature: Ceres CLONE 1805458
  misc_feature: SWISSPROT Homolog: EC 2.3.1.78 Heparan-alpha-glucosaminide N-acetyltransferase
MDGGKKADQPHGDVAEEDPGRRQRSVVDEADGDEKAPRRSKRVASLDVFRGLTVALMILVDGAGGEWPVIGHAPWNGCNLADFVMPFFLFIVGMAIPLSLKRIPDRGWAVRRVVIRTLKLLFWGILLQGGYSHAPDKLTYGVDMKHVRWGGILQRIALAYLVVAILEIVTKDAKIQDRSSSGFSIFRMYFSQWIVACCILVV

SEQ ID NO: 19360 - DNA, 1293 bp, Panicum virgatum
  misc_feature: Ceres CLONE 1805472
  misc_feature: Encodes the peptide sequence at SEQ ID NO. 19361
atcagatctcacttcccgttcttggcttcgtttcgacctcctctggcagcgagcatgtcttcgtcggagaaccccacggtgaccgagcgcggcagccgcgacgacaagcacgaggacggcgacaagaaggagggcggcggcggcttcatcgagaaggtcaaggacttcatccacgacatcggcgagaagatcgaggaggctgtcggcttcggcaagcccaccgccgacgtctccggcatccacatcccgcacatcagcctccaccgcgccgacctcgtcgtcgacgtgctcatcaagaaccccaaccccgtcccaatcccgctcgtcgacatcgactacctcatcgacagtgacggccgcaagctcgtctccggcctcatccccgacgccggcaccatccacgcgcacggcgaggagaccgtcaagatccccatctccctcgtcttcgacgacatcaagagcacctacaaggacatccagccggggagcatcatcccatacctcgtccgcgtcgtcctcctcgtagacgttcccatcatcggccggatcaagatcccgctcgagaagtccggcgagatccccgtcccctacaagcccgacgtcgatgttgagaagatcaagttccaccacttctccttcgaggagaccaccgccacgctgcacatcaagctcgagaacaagaacgacttcgacctcggcctcaacatgctcgagtacgagatgtggctcggcgacgacagcatcgcctccgccgagctcacgcagagcgccaatatcgagaagcaggggatcaccaggatgcagatccccttcagcttcaggcccaaggacttcggatccgcggtctgggacatgatcaggggcagggggacaggctacactatcaagggcaagattgatgtcgacactccctttggtaacatgaagctgcccataagcaaagagggtggaactactcgcatcaagaaggacgacgacgacgacgatgatgacaactgaggactgaagtgccgctgtaaccaaacacagatggcagtgaagtggagaggatgctgttaacgggtgcagtcgcctgcctgacatccttagcgctagttgagctctgcactgtctagcttcatgtgtctgtcgatctgcattgtctgaacatcctttgttagtttggactcgtctgtgctgtgaattccttctccaaacttttgtggttggagcatgaagaataagttcccatcacccctggttctttatggggctcgttgggagtgttctttagatcctgaattgttgcgccgt

SEQ ID NO: 19361 - protein, 314 aa, Panicum virgatum
  misc_feature: Ceres CLONE 1805472
  misc_feature (29)..(184): Pfam Name: LEA_2 Pfam Description: Late embryogenesis abundant protein
  misc_feature: Functional homolog of the protein sequence given in SEQ ID NO 50373
  misc_feature: Useful for making plants with altered alkaloid content
MSSSENPTVTERGSRDDKHEDGDKKEGGGGFIEKVKDFIHDIGEKIEEAVGFGKPTADVSGIHIPHISLHRADLVVDVLIKNPNPVPIPLVDIDYLIDSDGRKLVSGLIPDAGTIHAHGEETVKIPISLVFDDIKSTYKDIQPGSIIPYLVRVVLLVDVPIIGRIKIPLEKSGEIPVPYKPDVDVEKIKFHHFSFEETTATLHIKLENKNDFDLGLNMLEYEMWLGDDSIASAELTQSANIEKQGITRMQIPFSFRPKDFGSAVWDMIRGRGTGYTIKGKIDVDTPFGNMKLPISKEGGTTRIKKDDDDDDDDN

SEQ ID NO: 19362 - DNA, 1483 bp, Panicum virgatum
  misc_feature: Ceres CLONE 1805474
  misc_feature: Encodes the peptide sequence at SEQ ID NO. 19363
accgcacctagcattgcagtcttgcgaggaagcaaggaatagccagagctagtcgttgttgcttcttggggaaaatcggagttttgttttgagagctgggaatggcaccggccacgtctttcccgatcatcgacatggggctgctcgccgggcaggagaggccggcggcgatgggcatgctgcgcgatgcgtgtgagaactggggcttctttcaggttcgcgggcacagtaaagtaccaaaaccagtatgctgacagtcaaaatcggaacggagaaacttgccactagatgacgattattagtctattgcgtcgatgcacgcttaacgttcactgtttttcttctgttatactccggtgcagatcctgaaccacggcatctcgacggagctgatggacaaggtggagcggctgaccaaggaccactacaagcgggtgcgcgagcagcggttcctcgagttcgccagcacggcgctccaggacggcggcggcggcgcgaaggcggagaacctggactgggagagcaccttcttcgtccgccacctcccggagtccaacctcgccgacatccccgacctcgacgacgggtaccggcgcgcgatgaggcggttcgccggcgagctggaggcgctggcggagcggctgctggacctgctgtgcgagaacctcggcctggagaagggctacctcgcgcgcgccttccgcgggcccagaaagggcgccccgaccttcgccaccaaggtcagcagctacccgccgtgcccgcgcccggacctcgtgagcggcctgcgcgcgcacaccgacgccggcggcatcatcctgctgttccaggacgaccgcgtcgccgggctgcagctgctcaaggacggcgcgtgggtggacgtgccgcccacgcgccactccatcgtggtgaaccttggtgaccagctggaggtgatcaccaacggcaggtacaagagcgtggtgcaccgggtggtggcgcagtccgacgggaaccggatgtccatcgcgtccttctacaacccgggcggcgacgccgtcatctgcccggcgccggcgctggtgaaggccgaggaggccgcggcggcgtaccccaggttcgtgttcgaggactacatgaagctgtacgcgcggaacaagttcgaggccaaggagccgcggttcgaggccttcaagtccatggagacggagagctccaaccgccgcatcgccatcgcgtaacgaccgggcagggtatgccggagtcgggagtcgtacgtgtcagtagcagattggaatgtgctgaataaatgggcccgataggcctatcgagctagggcacgatgtgttcggcatcctcgctgtgtcgttgatcgctgttgctctgctctcgaccagcatgtgtcgtagttgtgcccgtaaaagcccgtttttgcgagcccccttgtgcggttctgcctgtgttctcaagttgcaggacagaaatttacattttttttttttgc

SEQ ID NO: 19363 - protein, 275 aa, Panicum virgatum
  misc_feature: Ceres CLONE 1805474
  misc_feature (111)..(211): Pfam Name: 2OG-FeII_Oxy Pfam Description: 2OG-Fe(II) oxygenase superfamily
  misc_feature: SWISSPROT Homolog: EC 1.14.17.4 Aminocyclopropanecarboxylate oxidase
  misc_feature: Functional homolog of the protein sequence given in SEQ ID NO 50854
  misc_feature: Useful for making plants with modulated heat sensitivity
MDKVERLTKDHYKRVREQRFLEFASTALQDGGGGAKAENLDWESTFFVRHLPESNLADIPDLDDGYRRAMRRFAGELEALAERLLDLLCENLGLEKGYLARAFRGPRKGAPTFATKVSSYPPCPRPDLVSGLRAHTDAGGIILLFQDDRVAGLQLLKDGAWVDVPPTRHSIVVNLGDQLEVITNGRYKSVVHRVVAQSDGNRMSIASFYNPGGDAVICPAPALVKAEEAAAAYPRFVFEDYMKLYARNKFEAKEPRFEAFKSMETESSNRRIAIA

SEQ ID NO: 19364 - DNA, 1239 bp, Panicum virgatum
  misc_feature: Ceres CLONE 1805478
  misc_feature: Encodes the peptide sequence at SEQ ID NO. 19365
attccattccaattccccgttcagatccgccgatttcttcttcggttcttctccttcttcccacagcggccgccgcagcagcacagggtactcgagtgagtgaccgcccgaccgattcacgaggatgctggccatcttccagaagcaggtggcgcacgcgccgcaggagctcaacagcccccggagcggcggcgccaagcccaggagccccgacgagatcctccgggacttccacgccgcgcaccccgccgacgccttctccgcctccttcgggggcggcgccgcgctcgcctgcgtcgccgcgcgcgcctgcccggccgctggccaccagcgcatgttctgcggcctcgacgacatctactgcgtcttcctcggccgcctcgacaacctcagcgccctcatccgccagtacggcctctgcaacaagtccaccaacgaggcgctgctcgtcatcgaggcctaccgcaccctgcgcgaccgcgggccctaccccgccgaccaggtcgtcaaggacctcgccggctcattcgccttcgtcgtcttcgacaacaagtccggcgccgtattcgcagccctgagcgccgacggcggcgtgcctctgttctggggcatcgcggcggacggctccgtggtcatctgcgaggaccgggagatcgtcaagcgcgggtgcggcaagtcgtacgcgcccttccccgtggggtgcatgttccacagcgagggcgggctcaagagcttcgagcaccccatgaacaggctcaaggcgttgccccgggtcgacagcgagggcgtcatgtgcggggccaccttcaaggtcgacaccttcaccaagatcaactccatgccacgtgtcggcagcgccaccaactgggccgcatgggacgaccaagccatctaggagtagatcatattttcaccgtctctttaattaagagcgccgctgctcacgcacgcaccagatagccatatccgcgccctttctttctcccttcttcgtcgctcgatgtttctttcctttccttccactaatgtatctgctggctacctgctagtgcttccattggaaggccatggtctcatcaagaccacgtacggaagcataacgcctttgttttactgcatgcttgtcgtcctcttcttccggctccttgtgctggcacattgtacatttccctgtgcttggggcttttgggcttggctgttgaacattatcaataagagtttgcttcaatcttatttact

SEQ ID NO: 19365 - protein, 256 aa, Panicum virgatum
  misc_feature: Ceres CLONE 1805478
  misc_feature: SWISSPROT Homolog: EC 6.3.5.4 Asparagine synthase (glutamine-hydrolyzing)
MLAIFQKQVAHAPQELNSPRSGGAKPRSPDEILRDFHAAHPADAFSASFGGGAALACVAARACPAAGHQRMFCGLDDIYCVFLGRLDNLSALIRQYGLCNKSTNEALLVIEAYRTLRDRGPYPADQVVKDLAGSFAFVVFDNKSGAVFAALSADGGVPLFWGIAADGSVVICEDREIVKRGCGKSYAPFPVGCMFHSEGGLKSFEHPMNRLKALPRVDSEGVMCGATFKVDTFTKINSMPRVGSATNWAAWDDQAI

SEQ ID NO: 19366 - DNA, 637 bp, Panicum virgatum
  misc_feature: Ceres CLONE 1805508-R
  misc_feature: Encodes the peptide sequence at SEQ ID NO. 19367
gatgatcgacgacaaggagctgcagtccgcgctctccggctacaaccagagcttcagcctccgcaccgtccacctcctcatgtacctattcaccaacaccaacgtccgaaagatcgggcccaaggaatttacttctgtgttttacagtcttcagaattggagagcaatatttgaaaggttcgatcgtgatcggagtggtaagattgactcatctgaactccgtgatgctcttctcagtctgggatattctgtctctccaactgtgctggacctgcttgtgtctaaatttgacaagactgggggcaagagcagagcaattgaatatgataacttcattgaatgttgtctcactgttaagggactgactgagaagttcaaggagaaggacccggcatactccggatctgcgacttttacttatgaggctttcatgctgaccgtgctccctttcctcatcgcctagtggcgcagttcagagcaaaagctaaacataccatgccagttgtgtaaaaaatgttcggagagttgttttggatttgactagtgttgctggggttgcgaatcataaagttgatgggtggttatgtttaacttagaaaatgctacaactgatatatagcgttggatctgtttgttc

SEQ ID NO: 19367 - protein, 153 aa, Panicum virgatum
  misc_feature: Ceres CLONE 1805508-R
  misc_feature (52)..(80): Pfam Name: efhand Pfam Description: EF hand
  misc_feature: SWISSPROT Homolog: EC 3.4.22.53 Calpain-2
MIDDKELQSALSGYNQSFSLRTVHLLMYLFTNTNVRKIGPKEFTSVFYSLQNWRAIFERFDRDRSGKIDSSELRDALLSLGYSVSPTVLDLLVSKFDKTGGKSRAIEYDNFIECCLTVKGLTEKFKEKDPAYSGSATFTYEAFMLTVLPFLIA

SEQ ID NO: 19368 - DNA, 474 bp, Panicum virgatum
  misc_feature: Ceres CLONE 1805508
tatccccggttctctcctcttttccgcagaaaaaaatttccattcaaagcccacccacgtttcaattcccaattccccacccaccaccatcgtttttcctttccacacccccagggccggctacccgccgcccggttccggttacccctacggccccgccgaagggggaagagaaggctacggcgcccccccgccatacggttccccccccggccctccccccccgcctaacgggaacaagcccccaaagaaaggcaaaacctcctcctcttccgccccgccctacaacggggccccgcccaacggaaacaagcccccaaagaaaggaaaaacctcttcctccccaccgcccaactacggagccccgcctccctcccaaccttacggggggggcggggaaggctacgaccccaacaagtacggggcgccctacggccccccgccgccctcgtccccccctccctacgacgcgcc

SEQ ID NO: 19369 - DNA, 1340 bp, Panicum virgatum
  misc_feature: Ceres CLONE 1805511
  misc_feature: Encodes the peptide sequence at SEQ ID NO. 19370
actaccaccagtccaccaccaccaccaccacctcctccgccaccaccacgccgcagccgtttccgcgagaccgcaaacccccgccgcttcgctccagcaacccaccgcatcccggcccgcgcggcagcagcaagcagccagcgttacgaccgccatggccgccgcgcgctacgacgtggagcagggcgggaggggcggggaggggatgtacccgccgccgccgccgccggagcagatgtacccgcaacgggagggggagagggagtgggtgccctggttcgtgccggtcgtcgtggccgccaacatcgcgctcttcgccgtcgtcatgtacgtcaacaactgccccacccacgccgcctcggctcgtcgcggcggcgcctgcgtcgcccgcgggttcctccaccgtttcgccttccagccgctcagcgagaacccgctcctcggcccatcgtcggcggcgctgcagaagctgggagcactcgtgtgggacaaagttgtgcacgagcaccagggctggaggctcctgacgtgcatctggctgcacgccggcgttgtccacctgctagccaatatgctcagcctcgtgctcatcggactcagactagagcaacaatttggatatctgagaatcggtgtcatctacattgtttctggcgttggaggcagcgtgctttcatctctgttcatcaggaacaacatctctgttggcgcttctggagctctctttggactccttggagccatgctgtcggagctcttcaccaactggaccatctactcgaacaaggctgcagccctggtgaccctcttaatcgtcatcgccatcaacctcgccattggcatcctcccgcacgttgataactttgcgcacattggaggattcctcactggtttcctcctggggttcatcttcctgatgcgcccgcattacggttggatgcagcgctatgtccggccctcggacatcaagtacaccaccaagaagtacctgccctatcaatgggttctgttggccgtagcttcggtcctcgctgtcctcggattcgccgtcgggatggggatgcttttcaagggagtgaacgcgaacgaccactgccagtggtgccactacctcagctgcgtcccgacatctagatggagctgtgggaagtgaagactagtgctcaagacaccttggactgaaaccaggagatggcgccttgtgaacatttttcgggcgagcatttggatgaatagatagatacagctcatactgtggtgtatatactatcatcagaacctgattgatcaatcaacgattcatttatttattcagctatattttaaatggaaatgacttc

SEQ ID NO: 19370 - protein, 332 aa, Panicum virgatum
  misc_feature: Ceres CLONE 1805511
  misc_feature (114)..(258): Pfam Name: Rhomboid Pfam Description: Rhomboid family
  misc_feature: SWISSPROT Homolog: EC 3.4.21.105 Rhomboid protease
  misc_feature: Functional homolog of the protein sequence given in SEQ ID NO 50231
  misc_feature: Useful for making plants with altered cell wall content and/or composition
MAAARYDVEQGGRGGEGMYPPPPPPEQMYPQREGEREWVPWFVPVVVAANIALFAVVMYVNNCPTHAASARRGGACVARGFLHRFAFQPLSENPLLGPSSAALQKLGALVWDKVVHEHQGWRLLTCIWLHAGVVHLLANMLSLVLIGLRLEQQFGYLRIGVIYIVSGVGGSVLSSLFIRNNISVGASGALFGLLGAMLSELFTNWTIYSNKAAALVTLLIVIAINLAIGILPHVDNFAHIGGFLTGFLLGFIFLMRPHYGWMQRYVRPSDIKYTTKKYLPYQWVLLAVASVLAVLGFAVGMGMLFKGVNANDHCQWCHYLSCVPTSRWSCGK

SEQ ID NO: 19371 - DNA, 1318 bp, Panicum virgatum
  misc_feature: Ceres CLONE 1805519
  misc_feature: Encodes the peptide sequence at SEQ ID NO. 19372
atatcccatcccccgccgacgcgacgctgttcgagggccgagcggaattcgtcgccgccggagccggagccgagggagcccgagatggtgaactcgttcttcgtgttctgcgggtgcgtggaccaggccagcgtggcggtggtggagaagtgggggcgcttcgtccgcctcgccgagccgggcctccacttcttcaaccccttcgccggggagtgcgtcgcggggtccctcaccacccgcgtccagtccctcgacgtccgcgtcgagaccaagaccaaggataatgtcttcgtccagctgatttgcaccattcaatatcgtgttgtcaaggaaaatgctgatgatgcattctatgagttgcagaatccccaacagcaaattcaggcttacgtctttgatgttgttcgggccatagttccaagaatgaatctggatgatcttttcgagcaaaagaatgatgtggcgaaatctgtactggaggagcttgaaaaggtgatggcagattatggttacagcattgagcacattctcatgattgatatcattcctgacgctgctgtgcgcaaagcaatgaatgagataaatgcagcccaaaggcttcagctggcaagcgtctacaaaggagaagcagagaaggttctcttggtgaagaaggcggaagcagaagcagaggcaaaatatctctccggtgtcggcattgccaagcagcggcaagctataaccgacggcctcagggagaacatcctgaacttctcgcactcggtgtcgggcaccagcgccaaagaagtcatggacctgatcatggtcacacagtactttgacaccatcaaggagctcggggacggctcgaagaacaccacggtgttcatcccccacggcccgggccacgtgaaagacatcagcgagcagatccgggacggcatgatgcaggcctcgagcagcaacgtgtagaccactcgttgacgtgggcacacacggctggggacgcctcagctcgggctgagcctcaggctaatctgtttatagtattagatcgttagtggtaaataacgagtgctaggactttcggcttgtcacctggagttgtatgcggtcctgaaactagtgtggatgaattttcgtatgagataatgtccaggccgtacgtgtttttgcatgttctttctagctatgacaagttatatactgatctggccttttagacaatgtatagcgcttcagttgatacgtgggtgtggatttttgcctgtgcagaatacttgtgaattgaagcattatatggttggaaaatctttacatggctcagctcctgtaattt

SEQ ID NO: 19372 - protein, 288 aa, Panicum virgatum; identical to SEQ ID NO: 10617
  misc_feature: Ceres CLONE 1805519
  misc_feature (10)..(184): Pfam Name: Band_7 Pfam Description: SPFH domain / Band 7 family

SEQ ID NO: 19373 - DNA, 986 bp, Panicum virgatum
  misc_feature: Ceres CLONE 1805532
  misc_feature: Encodes the peptide sequence at SEQ ID NO. 19374
atccttagcccgaccgactcgcgattccaaaccccctaaaggcccaaaccctcctccctgaacccgatccaacccaatccccggcggcggcggcgatggcagccgtgaccaacgccgacgtggaggtggtcgacttcgacctcgacgacgacgacctcatggacgaggacgccggggctgagcccgcgccggcccccgctcccgcgtcccgcctccgctccaccatcgcgggcgacgatgcgccgcgtaagaccaagggccgcggcttccgcgacgaccccaactcctcctctgccccccgagactcgcgcttcggcgctggggggcgcgccgacttcgactcgctcggctccggcggcggcccggcacccatccgatcaattgaaggatggattgtgctggtcactggagttcacgaagaagcacaagaagatgatcttcacaatgctttccgagaatttgggcaggtcagaaacctgcatttgaatttggatcgtcgtactggatttgtcaaggggtacgcattgattgaatacgagaactttgaagaagctcaggctgcaataaaagaactggatggaactgagctttatggacaaataataagcgttgattgggcatttagcagtggccctgctaagcgcagaaattctcagaagagacctccatcaagagctcgttcaaggaccccacccaagagaagatactgatgtttccccagcatgtcctgaacttactcggagtgatgaagtagtgcaagaagtctggggattccagattgcttggtgtatcaccgtagtttcgtcgttgctactagtatttggttgcctgctgttttcatttcgagaccatggtagttgtaagatactttcgtttctggttgatggagttgtgtttaacactatgtttgactttgccagtttgaggcaattgtaactgcagatcctttgcatctttgaccacaactagtgatgtgttggaattgg

SEQ ID NO: 19374 - protein, 204 aa, Panicum virgatum
  misc_feature: Ceres CLONE 1805532
  misc_feature (101)..(172): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAVTNADVEVVDFDLDDDDLMDEDAGAEPAPAPAPASRLRSTIAGDDAPRKTKGRGFRDDPNSSSAPRDSRFGAGGRADFDSLGSGGGPAPIRSIEGWIVLVTGVHEEAQEDDLHNAFREFGQVRNLHLNLDRRTGFVKGYALIEYENFEEAQAAIKELDGTELYGQIISVDWAFSSGPAKRRNSQKRPPSRARSRTPPKRRY

SEQ ID NO: 19375 - DNA, 1290 bp, Panicum virgatum
  misc_feature: Ceres CLONE 1805536
  misc_feature: Encodes the peptide sequence at SEQ ID NO. 19376
actcttgctccagcagcaaaatccattgctgagctctgctctgcagtttgctccctccctcaaaaacctacacaaaatccccagaaaagaaaatttataaccaaaaagacacaatagaagaaaaatcaagtgaaggtcaaaaatggcagatgttggcctatccactgctttctctcctctcagaggtccttggatagccgtgaggatcaggcagcgctgcaagcccgcaggagtcagcctctccccaaggaggaggagaacctcctgcgcggccgccgccatccgcgccgaggtgagcttcgtggaggccgacgaggcgaagaggctcgtcgccgaggagggtttcacggtgctggacatcagggacaggacgcagcgcgagagggcgtacatcaagtcctccacccacgtgcccctcttcatcgagaaccaggacaacggcattgggacgatcgtgaagcgtcaggtgcacaacaactttgccgggctcttcttcgggctgcccttcaccaagctcaacccggacttcaccaaggcggtgaaggagaagttctcaccggagagcaagctgctggtagtctgccaggaagggctcaggtcagcagcagctgcagatgcactggagagagaaggcttccaaaatattgcatgcatcacatcaggtcttcagacagtgaagccaggaacgtttgaatctgttgggaaaagtgagctgcaaaatgcagggaaagccggccttgtaaccatacaagggaagatttcagtagttctcgggactgttttgatcagtgcctacctttttataacatttttcccggaccaagcagagaagctctttgacttggctggcatcagtttgtgatcaaaactgatgtcatttccattcatattggtgctccaattggagggtccatgtttccgtaatcagaataactgtatcatcaagtcgacttactcagatgttcataccaagaaggaagtttggttcaatgtgtattatatagggaatttttgacaaatcagtgcatatattctccgaagcatcccttttcttccatgtacctcctatttccattctatgctagattcatggaagtatttaggcctccgcagatattattcaagatttctaataggggttttctatccatcttgtcatgctcatcctctgcagaacattgatcccaaaagactgtagaacttgataccaattgcagttgtagatgaaatgattgtcttgtgtaatgacctaatagcagagcctgaatacaccgtttctttgttatcttc

SEQ ID NO: 19376 - protein, 239 aa, Panicum virgatum
  misc_feature: Ceres CLONE 1805536
  misc_feature: SWISSPROT Homolog: EC 2.8.1.1 Thiosulfate sulfurtransferase
MADVGLSTAFSPLRGPWIAVRIRQRCKPAGVSLSPRRRRTSCAAAAIRAEVSFVEADEAKRLVAEEGFTVLDIRDRTQRERAYIKSSTHVPLFIENQDNGIGTIVKRQVHNNFAGLFFGLPFTKLNPDFTKAVKEKFSPESKLLVVCQEGLRSAAAADALEREGFQNIACITSGLQTVKPGTFESVGKSELQNAGKAGLVTIQGKISVVLGTVLISAYLFITFFPDQAEKLFDLAGISL

SEQ ID NO: 19377 - DNA, 1114 bp, Panicum virgatum
  misc_feature: Ceres CLONE 1805542
  misc_feature: Encodes the peptide sequence at SEQ ID NO. 19378
accatcgcaactcctgcccagtcagctcgtcccggcaacctcccttcccaccgccacaatgtcgggcaacatcgccttcggccggtttgatgactccttcagcgcggcctcaatcaaggcctacatcgccgagttcatctccaccctcgtcttcgtcttcgccggcgtcggctccgccatcgcctacaccaagttgtccggtggcgcgcctcttgacccttcgggtctgatcgccgtggcggtgtgccacgggttcgggctcttcgtcgcggtcgccatcggcgccaacatctccggcggccacgtcaaccccgccgtcaccttcggcctcgccctcggcggccagatcaccatcctcaccggcatcttctactggatcgcccagctcctcggtgccatcgtcggcgccgtcctcgtccagttctccaccggcgtggcgaccccgacccacggcctctccggcatcggcgcgttcgagggcgtcgtgatggagataatcgtcaccttcggcctcgtctacaccgtgtacgccaccgcggccgaccccaagaagggctccctcggcaccatcgcccccatcgccatcggattcatcgtcggcgccaacatcctcgtcgccggccccttctccggcgggtccatgaacccggcccgctccttcggccccgccgtggccagcggcgacttcaccaacatctggatctactgggtcggcccgctcatcggcggcggcctcgctggcatcgtctaccggtacatctacatgtgcggcgaccacgcccccgtcgccagcagcgacttctaagcgccccaagtagagggccgtcgatcggcgtgcattgttgtttggtttctcccaatcctagtgttggcagcataaagtgagggtcaggctgtgatgagcagcatcgcagcatgtcgtgtttggttcagaacttcagatcaaagccccggaggctgtgcacatgcgcttggatgattggtcatgtttctccattttctcatttttgtaactttattagtgtgaagttggtggggttccagaaccagagcatgcatttctgtttagtgtttacttttattgcgagatttgcaataacttatatttagtttc

SEQ ID NO: 19378 - protein, 248 aa, Panicum virgatum
  misc_feature: Ceres CLONE 1805542
  misc_feature (12)..(231): Pfam Name: MIP Pfam Description: Major intrinsic protein
  misc_feature: SWISSPROT Homolog: EC 1.9.3.1 Cytochrome-c oxidase
MSGNIAFGRFDDSFSAASIKAYIAEFISTLVFVFAGVGSAIAYTKLSGGAPLDPSGLIAVAVCHGFGLFVAVAIGANISGGHVNPAVTFGLALGGQITILTGIFYWIAQLLGAIVGAVLVQFSTGVATPTHGLSGIGAFEGVVMEIIVTFGLVYTVYATAADPKKGSLGTIAPIAIGFIVGANILVAGPFSGGSMNPARSFGPAVASGDFTNIWIYWVGPLIGGGLAGIVYRYIYMCGDHAPVASSDF

SEQ ID NO: 19379 - DNA, 1011 bp, Panicum virgatum
  misc_feature: Ceres CLONE 1805544
  misc_feature: Encodes the peptide sequence at SEQ ID NO. 19380
gacctcggaagcttctggagatccccaccacgcccctcgagccctaggagaaaaaggtaccgctccaatccgagaggcgcttacgcccccgcctggatttctgatagaaccctagcttttgcgaggagcctcgtctggtttgctccgccgagcatgggaagaaggtacgattacagcccctcacctccaagaggttacaggagaagagctcgaagtccaagccctcatggtcgttatggaggacgtgctagggacctcccaactagtcttctagtgaggaatcttcgccgggattgtaggcctgatgacctccgtagaccatttggaaaatttggccgtgttaaagatatataccttccaagggattactacactggggatcctcgaggatttgggtttatccaatactttgatcctgaggatgctgctgatgcaaaataccatatggatgggcatatgtttcttggaagggaaattactgttgtttttgcagaggagaacagaaagaagcctactgagatgagggcaagggaaagagtcagtagccgaggccgttcatatgatcggaggttgcgctcaaggtcgcctgagtactctgtctctccaaggggcagatcgcggtcccgcagcagaagctactcaccagcacctaagcgaaagcaccattcaaggtccccgtctcctagggagagatctttgtcgcgctcaccagtgggcagcagatcaaggagtgccagccctgctgttaagtctcctcgcagggagaggtctctttctgttagccaatgatgatgcatcatcagggctgagtagtgctacatgcatgacgatgtagttgctggcacaccgaatggaaccatatatgatccggattctttttgtcaccctacgctgggagtgctaaaaacatgtatggtgtatttcaaaacatttgatgagtgttttgagaatgtaacgtacctgttgactgggtgcagagatttgaagtgatttatgactctagtatggcac

SEQ ID NO: 19380 - protein, 211 aa, Panicum virgatum
  misc_feature: Ceres CLONE 1805544
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50855
  misc_feature: Useful for making plants with altered terpenoid content
MGRRYDYSPSPPRGYRRRARSPSPHGRYGGRARDLPTSLLVRNLRRDCRPDDLRRPFGKFGRVKDIYLPRDYYTGDPRGFGFIQYFDPEDAADAKYHMDGHMFLGREITVVFAEENRKKPTEMRARERVSSRGRSYDRRLRSRSPEYSVSPRGRSRSRSRSYSPAPKRKHHSRSPSPRERSLSRSPVGSRSRSASPAVKSPRRERSLSVSQ

SEQ ID NO: 19381 - DNA, 1771 bp, Panicum virgatum
  misc_feature: Ceres CLONE 1805547
  misc_feature: Encodes the peptide sequence at SEQ ID NO. 19382
ggctctttccccacgacttcgacctcgcctccctcccgatctcctctctctctctgtccactagccgtgttcgttttgcgtgagacggggagctaggaatccacggcatcggaaaaggcggccgcccaaattgccggtttccccgagagttttgtccgtcctgtccatcgcgggattggattctccggccatggctctcgccgcgctccgccggcacgccggccagttcttgagcaccagcaatgagctcatggcggcgtcgctctcgacggcgagttgcgcggaggagatgcagaaggcggaggggggagggtgccgcgacgacgcggcggcgctgcggctcaaggaggtggccatggcggcgatactggtggccggggtgctcggggtgggcctgccgctcgcgggccggaagcgccgcgcgatgcgcacggacagcgccgcgttcatggcggccaaggcgttcgcggccggggtcatcctcgccacggggttcgtccacatgctgcacgacgcccagaacgcgctctccagcccctgcctccccgccgtgccgtggcgacggttcccgttcccggggttcgtcgccatggtcgccgcgctcgccacgctggtgctcgacttcctcgccaccaggttctacgagacgaagcaccgcgacgaggccgcgcgcgtcaaggcagccgctgcggccgcgctcgcagcggcctcctccgcgtccgcgagtgaagaggatatcaccgtggtcaccgtcgtcgaggacgagcgcaaggccccgctcctgcaaacgcactgccatggacactcgcacggacacggacacagccacagccatggacacgagctggtgcaagtggagggccgagagggggatgtgtcggagcatgtccgctctgtcgttgtatcacagatactggagatggggatagtgtctcactctgtgatcatcggtttgtcactgggagtgtcgcggagcccgtgcacaatcaggccacttgtcgcagcactttcattccaccagttcttcgaggggtttgcattaggcgggtgcattgctcaggcacaattcaagaacctttcagcggttctaatggcatccttctttgccattacaacaccggcagggatagctgctggggtaggcttgtccacaatttacaatccaaatagcccaagggctcttgtgattgagggaattcttgactcggtgtcagccggcctcctgatatacatgtcgctggtggatctcattgctgcagacttcttgggttcgaagatgacagggtcgctgcgacagcaagtgatggcatacatcacactgttccttggtgcgatctccatgtcatcactggcaatatgggcttgagacctacccttgatcatcaggtaaaaggtgcataatcacccgaggaaattcctgtcgtgcgtgtatagtgctaatgttacgctctagtatcttgctgtgtctcatagtagtagcttgctggggctcataggatgacatgccctgttttcgaagggcatgaaacaatcaccgccatatgtaaaaaagtggggctcatgtactgcactgccccaacaatggtggttccataggtgagatgttaacggcgggtttctattgtactcgagcgtgtaactgcagtggttttctaaaacgacgagcaagcagtgatatgtatggcagccgctgcatcagctgctggctttgatttgatgtttcattgttactgtggctggtcctctattgtcaaattcttacggtgttggc

SEQ ID NO: 19382 - protein, 391 aa, Panicum virgatum
  misc_feature: Ceres CLONE 1805547
  misc_feature (49)..(388): Pfam Name: Zip Pfam Description: ZIP Zinc transporter
MALAALRRHAGQFLSTSNELMAASLSTASCAEEMQKAEGGGCRDDAAALRLKEVAMAAILVAGVLGVGLPLAGRKRRAMRTDSAAFMAAKAFAAGVILATGFVHMLHDAQNALSSPCLPAVPWRRFPFPGFVAMVAALATLVLDFLATRFYETKHRDEAARVKAAAAAALAAASSASASEEDITVVTVVEDERKAPLLQTHCHGHSHGHGHSHSHGHELVQVEGREGDVSEHVRSVVVSQILEMGIVSHSVIIGLSLGVSRSPCTIRPLVAALSFHQFFEGFALGGCIAQAQFKNLSAVLMASFFAITTPAGIAAGVGLSTIYNPNSPRALVIEGILDSVSAGLLIYMSLVDLIAADFLGSKMTGSLRQQVMAYITLFLGAISMSSLAIWA

SEQ ID NO: 19383 - DNA, 627 bp, Panicum virgatum
  misc_feature: Ceres CLONE 1805550
  misc_feature: Encodes the peptide sequence at SEQ ID NO. 19384
tccgcccgtcggaaggaaggagtagcccgctgtaccagctgccttcctactcgcttcccttgccgtcctcctcgcctacttcgcccccccccccccccctcatccggcgtcgtcttccaccgtcctccgccgggacacgcaaagatcttgtttcttcaatagaatatgtcgtgctttggatgctgtggtgatgaagatgcacaaggagtaccagattccaggaatccgtacccaggacaccatccagcaaggaatgatgcataccgtcctgctgatcaacctcccaagggtcctctgcctgtcaaaatgcaacccattgcagtccctgccattcctgtggatgagattagggaggtgactaagggttttggtgatgaagctctgattggtgagggctcctttggaagagtatatcttggtgttctaagaaatggtaggagtgcggcggtcaaaaagttggattctaataagcagcccgaccaagaattcttggcgcaggtgtctatggtgtcaaggttgaagcacgaaaatgttgttgagttgcttggttattgcgctgatgggaccctacgtgtccttgcttacgagtttgctactatgggctctcttcatgatatgcttcatgga

SEQ ID NO: 19384 - protein, 153 aa, Panicum virgatum
  misc_feature: Ceres CLONE 1805550
  misc_feature: SWISSPROT Homolog: EC 2.7.11.1 Non-specific serine/threonine protein kinase
MSCFGCCGDEDAQGVPDSRNPYPGHHPARNDAYRPADQPPKGPLPVKMQPIAVPAIPVDEIREVTKGFGDEALIGEGSFGRVYLGVLRNGRSAAVKKLDSNKQPDQEFLAQVSMVSRLKHENVVELLGYCADGTLRVLAYEFATMGSLHDMLH

SEQ ID NO: 19385 - DNA, 624 bp, Panicum virgatum
  misc_feature: Ceres CLONE 1805550-R
  misc_feature: Encodes the peptide sequence at SEQ ID NO. 19386
caaaccaagctcctgacatggcagctcggcttcactctactagggtgcttggaacattgggatatcatgcgcctgagtaggcaatgactggacaacttagctccaagagcgatgtgtatagcttcggagttgttcttctcgagctgttgactggaaggaaacctgtcgaccataccttgccaaggggacagcagagtcttgtgacatgggctaccccaaggcttagtgaagacaaggttaggcaatgtgttgactcaagacttggaggggactatcctcctaaagctgttgcaaagtttgcagctgttgccgcattgtgtgttcaatacgaagcggacttccggccaaacatgagcatcgtggtcaaggcgctccagcccctgctgaatgcgcgggcgactaaccccggagaaaatgccagatcataagcgtcacgtcatcgtaccccccccccctctctctcttgtatgatagataagatatgagtcgacaatgtcgttcttgcggacgtgtgttgtgattattcttcccccgatttgtaaacatcaagattcttgtacccccacaatatttgattctttctatcggttgcaagatgacctatttattggtggcgtatcatac

SEQ ID NO: 19386 - protein, 114 aa, Panicum virgatum
  misc_feature: Ceres CLONE 1805550-R
  misc_feature: SWISSPROT Homolog: EC 2.7.11.1 Non-specific serine/threonine protein kinase
MTGQLSSKSDVYSFGVVLLELLTGRKPVDHTLPRGQQSLVTWATPRLSEDKVRQCVDSRLGGDYPPKAVAKFAAVAALCVQYEADFRPNMSIVVKALQPLLNARATNPGENARS

SEQ ID NO: 19387 - DNA, 1217 bp, Panicum virgatum
  misc_feature: Ceres CLONE 1805552
  misc_feature: Encodes the peptide sequence at SEQ ID NO. 19388
gcgtctaagaaccctaacagtagagagaagctaggagctagcgctgtgcgcgacactgagctgagagaaggcaccgccggccggaccatcatgccgaaggaggatgtgagcatcgaggcggcggcagccgagaaggcgccgtactgggacccgccgccggcgccggtgctggacacgagcgagctgcagaagtggtcgctgtaccgcgcgctcatcgccgagttcgtggccaccctcatcttcctctacgtgagcatcgccaccgtcatcgggtacaaggcccagtccaacaacctgcagacgtgcaccggcgtcgggttcctcggcgtctcctggtccttcggcgccaccatcttcatcctcgtctactgcaccggcggcgtctcaggcgggcacatcaacccggccgtgacgttcgggctgttcgtggggcggaagctgtcgctggtgcgcaccgtgctgtacatcgtggcgcagtgcctgggcgccatctgcggcgcgggcatggtgaagggcatcgtggggggcgatctctacgacaccttgggcggcggcgcgaacgcggtcggcagcgggttctccgtcgcggcggccctcggcgccgagatcgccggcacgttcgtcctcgtgtacaccgtcttctccgccaccgaccccaagcgcaccgcgcgcgactccttcatcccggtgctggtgccgctgccgatcgggttcgcggtgttcgtggtgcacctggcgaccatccccatcaccggcacgggcatcaacccggcccggagcctcggcgccgccgtcatgtacaacaaggcatggagttaccactggatcttctggatcgggccggcgatcggggcgacggcggcggcgctgtaccacaagctcgtgctgcgcggggaggccgtcaaggcgctcggctccttcaggagcaccagcgccacggtgtgagccagcatgcccagcggcgaatgaagcttttgaaactggaggcctgcactgctccccactatatccattgtcctccaactgatttctctgctcaatcattcgtatgtcctcccgtttaattaaagtactagcagatccttgcatgatgaactgcctgtcaaggtgcgcgcgcttactgcttgtcgatctgtgccattttattttttttatttgggactacaaggtcgtcgaacatgtataaataaacatttatatgttatgctttatgagtg

SEQ ID NO: 19388 - protein, 284 aa, Panicum virgatum
  misc_feature: Ceres CLONE 1805552
  misc_feature (31)..(262): Pfam Name: MIP Pfam Description: Major intrinsic protein
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50195
  misc_feature: Useful for making plants with modulated water use efficiency
MPKEDVSIEAAAAEKAPYWDPPPAPVLDTSELQKWSLYRALIAEFVATLIFLYVSIATVIGYKAQSNNLQTCTGVGFLGVSWSFGATIFILVYCTGGVSGGHINPAVTFGLFVGRKLSLVRTVLYIVAQCLGAICGAGMVKGIVGGDLYDTLGGGANAVGSGFSVAAALGAEIAGTFVLVYTVFSATDPKRTARDSFIPVLVPLPIGFAVFVVHLATIPITGTGINPARSLGAAVMYNKAWSYHWIFWIGPAIGATAAALYHKLVLRGEAVKALGSFRSTSATV

SEQ ID NO: 19389 - DNA, 1396 bp, Panicum virgatum
  misc_feature: Ceres CLONE 1805569
  misc_feature: Encodes the peptide sequence at SEQ ID NO. 19390
aggcacccgacacagatggccgtggcaaaccctagcaatgcgataccctgatgagcgtcctcctttctctcgcctgggtttgtgagcgatctctctctctccccccgcgcgcggacagccagccgtataggggcgggatggcttcgcgggcggagcggggacgccgcgcccttgacgccatgaaagccctgggattctccaagaaggaggtcacccccgtcctcaggagcctcctcaagctctttgacaacagctgggagcccatcgaggacgagggctaccgtgccctggccgacgccaccctcgacgcccgtgaccgcccccaggggccagagcatggtagccaccgcccgagaatggttgcgccagaggaagatcactaccagccttctgcgtcccttgtggcccgtggcggtccctgcgacttggacagtgagacagaggcacctcgcgtcaagaggcctagaaccagctctaataatttctcagcagatcactctattgatcatcaattgtccccgtcgtctcctcttactgcacacgagatggcaaggaagattatggatgaagatttccaacaagctgtcttcttgagagagcctaagcctgagcctgatatggatgcagcacagagcttgcatgatgttcaagtcggtattgtttcccatatgttcaacgccagctcctcaggtgctgcaggtcctctagcattgcgaccacccgatcaaaatcaaatagagacttcaggtaataaaggcaggccagttcagcgttgtggaacaaggcgaccatccacttcctttattgaacctgcggacagcatggggaagcaagctcaaaacccggaaagttcgtctgatcacatagctgtgatgcacaacactcggacgggatttgcagatgaatatagacatgaagcacgttgcttgcacactgagatagcatcatccactatgggtgaggtcaagatgtcaataaaatgcaacatagacccatccaagttctgcatgcacagtttagaagcagttttcaggatggttgaggataaatgttttcgctcatacgagagtctgccaccaaatttttccattggcagcctgatcaatgagatatgcgaatgtgtagcacaactgggcaatgatcatactgcagaatataatatacaatctgattctgttgacaatggcagaaacttgcaaaatgagccaatgatgaatggtgccgcacttgtggaaccaattgcttgcattagtaggggaggtaggaaatataaatctgtagaagattcatggattttagaaacttcagataatagccaagaaaattcaatggatgctcagcatctggcactttctcacctaaggcatgcccacaatgcatctgatatatcaaatgg

SEQ ID NO: 19390 - protein, 419 aa, Panicum virgatum
  misc_feature: Ceres CLONE 1805569
  misc_feature: SWISSPROT Homolog: EC 2.1.1.43 Histone-lysine N-methyltransferase
MASRAERGRRALDAMKALGFSKKEVTPVLRSLLKLFDNSWEPIEDEGYRALADATLDARDRPQGPEHGSHRPRMVAPEEDHYQPSASLVARGGPCDLDSETEAPRVKRPRTSSNNFSADHSIDHQLSPSSPLTAHEMARKIMDEDFQQAVFLREPKPEPDMDAAQSLHDVQVGIVSHMFNASSSGAAGPLALRPPDQNQIETSGNKGRPVQRCGTRRPSTSFIEPADSMGKQAQNPESSSDHIAVMHNTRTGFADEYRHEARCLHTEIASSTMGEVKMSIKCNIDPSKFCMHSLEAVFRMVEDKCFRSYESLPPNFSIGSLINEICECVAQLGNDHTAEYNIQSDSVDNGRNLQNEPMMNGAALVEPIACISRGGRKYKSVEDSWILETSDNSQENSMDAQHLALSHLRHAHNASDISN

SEQ ID NO: 19391 - DNA, 1548 bp, Panicum virgatum
  misc_feature: Ceres CLONE 1805570
  misc_feature: Encodes the peptide sequence at SEQ ID NO. 19392
gtggtggtttgaaaatgacctcaaaggcttcagataattttaaaaaaaattgcagcgcacaaaaagagggcgagggaaagcacttctagagactagagagtggagacacgagcgttttgacgactcgtggaaacgtgcggtgtgcgttcgccaactaaccttttgccgctgcttgtttcccagcaaacggagggggccgtcacagcaagcgcgtggtgaccgcggtcgtcgcgaccgtcgccggcgtgctcctcctgctggcggtcggctgcttcgtctggaggaagaggaggaaacgtcagggcgagacggattcgtcgtcggcgccggccggtggagaggatgtgctcccgttcagggccaggaaacacccggcgctagaggaggattggaaatgcgccaagaaagacgtcgacctcccgttgtttgacctggaggtgatcctggccgccaccgacagctttgctcttcacaacaagattggcgaaggcggatttggtccggtttacatggggaagctcgaggacgggcaagaagtagccgtgaagaggctgtcccggagatcgatgcaaggggcggtggagttcaagaacgaggtgaagctgatcgccaagctccagcacaggaacctcgtgaggctgctcggctgctgcatcgacgaggacgagaggatgctcctgtacgagtacatgcacaaccagagcctcgacaccttcatatttgatgaagggaagcggaggttgctgaggtggcagaagcgctttgatatcattctggggatcgcgcggggtctgcagtacctgcacgaggattcgaggttcaggatcatccatagggacctcaaggctagcaacgtgctgctggacagaaacatggtccccaaaatttcagactttggtattgcaagaatgtttggaggtgatcagaccactgaatataccaaaaaagtcatcgggacatatggctacatgtctccagaatacgcaatggatggcgtgttctccctgaagtcagacatctacagcttcggcgtgatggtactagagatcatcaccggcaagaagaaccgaggcttctacgaagtcgagcttgatctcaacctcctcagatatgcatggatgctgtggaaagaaggccggagcgttgatttgcttgacgatgtgatggacggcagcttcaactgcggcgaggtgctgcggtgcgtccaggtggccctcctatgcgtggaagtgcagcccaggaacaggcccctgatgtcgtcggtggtcatgatgctggccagcgagaacgcgacggtgccggagcccaacgagcccggggtgaacatcgggaagaacacgtcggacacggagtcgtctcagggcctcacggccaacaatgtcacgataacggcgatagatgctaggtaggtcattggactggacgagtaggaattcgaaattcttgctgctctgatggtatagtagcgtgtgctgggtagcttactcttgtacagcaaaggttttgttaccattttttgttttgaaaaaaatcttaagcgtacaactc

SEQ ID NO: 19392 - protein, 299 aa, Panicum virgatum
  misc_feature: Ceres CLONE 1805570
  misc_feature (1)..(256): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50654
  misc_feature: Useful for making plants with altered carbohydrate content
  misc_feature: Functional homolog of the protein sequence given in SEQ ID NO 50856
  misc_feature: Useful for making plants with modulated biomass
  misc_feature: Functional homolog of the protein sequence given in SEQ ID NO 50857
  misc_feature: Useful for making plants with altered cell wall content and/or composition
MGKLEDGQEVAVKRLSRRSMQGAVEFKNEVKLIAKLQHRNLVRLLGCCIDEDERMLLYEYMHNQSLDTFIFDEGKRRLLRWQKRFDIILGIARGLQYLHEDSRFRIIHRDLKASNVLLDRNMVPKISDFGIARMFGGDQTTEYTKKVIGTYGYMSPEYAMDGVFSLKSDIYSFGVMVLEIITGKKNRGFYEVELDLNLLRYAWMLWKEGRSVDLLDDVMDGSFNCGEVLRCVQVALLCVEVQPRNRPLMSSVVMMLASENATVPEPNEPGVNIGKNTSDTESSQGLTANNVTITAIDAR

SEQ ID NO: 19393 - DNA, 1465 bp, Panicum virgatum
  misc_feature: Ceres CLONE 1805571
  misc_feature: Encodes the peptide sequence at SEQ ID NO. 19394
gttcaactccagcaaacaacatctccttctcctcctcctcgatctctccattcgcaaggcaagctcgctcacaactgattagttagcatcaacctcctccgatcacacacaagcaagcaacaagcagcagcatatatatggaggtctcgtcgtcttcggcggcggcggaggtgccccactacttcctctgcccgatctccctggaggtcatgcgcgacccggtgacgctcgccaccggcatcacctacgaccgcgccagcatcgagcgctggctcttctccgacggccacgccacctgccccgtcacgcgccgcgcgctcgcgcccggggagatggacgccacgcccaaccacacgctccgccgcctcatccaggcctggtgcgccgcgcaccacgtcgagcgcttccccacgccgcgcccgccgctcgactcctgccgcgtcgccgcgctcctcgacgagggccgccacggcagggaggcggccgcgctcagggagatcagggccgtcgccgccgagagcgaccgcaacaggcgctgcgtcgaggccacgcccggcgccctcgacttcctcgtgtccgtcgtcaccaagcactccaccgcaccggtgtcgtctaaggcggcagacgagttcttgctggattccccgacgcccacgagctcgccggcggaggacgcgctcggcgttctctactcgctcaagccatcggaaagcagcctggcgcagatcctgggaagtgaacccgacttcttggacaccttgacctccgtcctgcgccggccgagctaccggtcgcgcacctacggcatcctcctgctcaagtcgttgattgcggtgatggagccgacgcggctcacgacggtgaccgccgacctggtgcaggaggtggtgcgcgtggtctcggaccgggtgtcctccaaggcggtcaaggcggcgctgcacgtgctgtgccgtctgtgcccgtggggccggaaccgcgttaaggccgtcgaggccggcgctgtggcgacgctggtcgagctgctcctcgacgagggcggccgccgcgtcaccgagctggccgtggtggcgatcgaccacctctgtggatgcgccgagggccggtcggagctggtcgcgcacccggcggggctggccgtcgtgtccaagaaggccatgcgggtgtcgctggccgccaccgagagcgccgtgcgcgcgctccacgccgtggcgaggcactcgccgaccccggccgtgctgcaggatatgctctccgtcggagtggtagccaagctgatgctggtgttgcaggtggacgccggtgacaaggccaggctcagggcaaaggagatgctcaaggcgcacgctagggtttggaaggactcgccatgcttgcaagcacacctgaaggcgtcttacccatgatgatatatacaccaaatcatgtacattacattgattatttgtagataaaaggagcacacgtt

SEQ ID NO: 19394 - protein, 421 aa, Panicum virgatum
  misc_feature: Ceres CLONE 1805571
  misc_feature (11)..(88): Pfam Name: U-box Pfam Description: U-box domain
MEVSSSSAAAEVPHYFLCPISLEVMRDPVTLATGITYDRASIERWLFSDGHATCPVTRRALAPGEMDATPNHTLRRLIQAWCAAHHVERFPTPRPPLDSCRVAALLDEGRHGREAAALREIRAVAAESDRNRRCVEATPGALDFLVSVVTKHSTAPVSSKAADEFLLDSPTPTSSPAEDALGVLYSLKPSESSLAQILGSEPDFLDTLTSVLRRPSYRSRTYGILLLKSLIAVMEPTRLTTVTADLVQEVVRVVSDRVSSKAVKAALHVLCRLCPWGRNRVKAVEAGAVATLVELLLDEGGRRVTELAVVAIDHLCGCAEGRSELVAHPAGLAVVSKKAMRVSLAATESAVRALHAVARHSPTPAVLQDMLSVGVVAKLMLVLQVDAGDKARLRAKEMLKAHARVWKDSPCLQAHLKASYP

SEQ ID NO: 19395 - DNA, 1047 bp, Panicum virgatum
  misc_feature: Ceres CLONE 1805578
  misc_feature: Encodes the peptide sequence at SEQ ID NO. 19396
atcgagcaccctccaatcttcaaggcgtcgcagcaggcaaggcatcgatcgatcaatcaccagcagcgcgtgccgcgtagagagatcgagagagagagagagagagagagagagaaagagagagagaggagtctcaccggagaagggaggaatcgtcatcgccaccgccaccgccatgggcaaggtccgctccttcttctcccgcagcggcaagcgcggcgccggcccgtcctcgccgtcctcctccgcggcgggcagcgcgccgtcgtcgccgtccccgaggaagtcgtcggcgtcggcgccggtggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctcgcgcgcgtcctgcgcggcctcggggaggccgccaccgtcgcccagtgccgccgcatgatccagggcgtcgaccgcaacggcgacggcctcgtctccttcgacgagttcaagctcatgatggccgccggcggaggcttcggcaggatggcctcctcctcttcttaggcactcatctgtttgggcaagatcactgctcggctctgctcccacaaattggattcgttcgttgaattgcactgtacatacgtaacagcgagatcgaagagatcatcgccaccaaaccaaagtaattactagtactaggcccatatcacacggacaaaaccacatcgaaaaatagcacgattggttttgtatatgtacatatatcgccaatgtgcatccgttgtacatgatggatgttgaatgatttgttctggtttcagttc

SEQ ID NO: 19396 - protein, 202 aa, Panicum virgatum
  misc_feature: Ceres CLONE 1805578
  misc_feature (53)..(81): Pfam Name: efhand Pfam Description: EF hand
  misc_feature (163)..(191): Pfam Name: efhand Pfam Description: EF hand
  misc_feature (89)..(117): Pfam Name: efhand Pfam Description: EF hand
  misc_feature (127)..(155): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPVAPAAETKDEMERVFRKFDANGDGRISRSELAALFEGVGHAATDDEVSRMMEEADADGDGAISLPEFAALVRSADADADAVEEDLRHAFMVFDADGNGLITPAELARVLRGLGEAATVAQCRRMIQGVDRNGDGLVSFDEFKLMMAAGGGFGRMASSSS

SEQ ID NO: 19397 - DNA, 1153 bp, Panicum virgatum
  misc_feature: Ceres CLONE 1805580
  misc_feature: Encodes the peptide sequence at SEQ ID NO. 19398
gcatccaccgcagcggccgcgctctgtcgcgggcctcgagcgcacagaaccctgcgccgccgccgccgccgccgccgccgccgcagccgagagcatgaaggccatcgggagcggcggggagtggtggtggaacctgccatctctccgccgcaagtccgactctcgccgccgcggccgccgaaacaccgacccccgcgcccgacgccgcggcaccccgcgggagccgctctcgtcgtcctcctcctcctcggagtccgtcggccggagcagcggctggcccgtagagttccccttcaggcaggcgctcactgccgcctctctcaccctcaccggggacaccatcgcgcaggtccgcggccgcatcatcgaccgccgaagacgcggcgccgatcccgacagcaaggaactcataccggacatattgctgaatcatgattggcttcgtgcatttcgtatggcttcctatggattccttctttatggtccaggatcctatgcatggtatcagttccttgatcggtgtatgcccaagcagtcatttgtaaatttgtctgctaaggtcatactgaaccagatcgtgcttggtccttgtgttattgctgtagtttttgcttggaacaacttgtggttagggaaactatcagagctgccatctaaatatcagaatgatgcgcttcctacacttctatatgggtttaagttttggattcctgtatcaattgtcaactttgggatgattcctttgccagctcgtgtagcctttatgtcctcttgttccattttttggaacttttatctatcgactgctatgaacaagtgaatcttactgttcatcagatctggtggatcagcataaggtcgctgtaaaacttattcaagatgttgactagcataacatcaatggaggacgtgaagttttgtctgatcatgtatcaagcacctggctccattctgacttcaaaactcaaaaggcgttcaatttgttatttaggatatgtgctgcattagcttacttcagtgacaatggcatattgacattcatctctgaatagagatgcaggtgtattagttacgccatgagaatttgtgaattcactgctggatgttgtatcttaaattccatctcaaataaaaaagatcttttcagaaaatg

SEQ ID NO: 19398 - protein, 241 aa, Panicum virgatum
  misc_feature: Ceres CLONE 1805580
  misc_feature (176)..(241): Pfam Name: Mpv17_PMP22 Pfam Description: Mpv17 / PMP22 family
MKAIGSGGEWWWNLPSLRRKSDSRRRGRRNTDPRARRRGTPREPLSSSSSSSESVGRSSGWPVEFPFRQALTAASLTLTGDTIAQVRGRIIDRRRRGADPDSKELIPDILLNHDWLRAFRMASYGFLLYGPGSYAWYQFLDRCMPKQSFVNLSAKVILNQIVLGPCVIAVVFAWNNLWLGKLSELPSKYQNDALPTLLYGFKFWIPVSIVNFGMIPLPARVAFMSSCSIFWNFYLSTAMNK

SEQ ID NO: 19399 - DNA, 1635 bp, Panicum virgatum
  misc_feature: Ceres CLONE 1805589
  misc_feature: Encodes the peptide sequence at SEQ ID NO. 19400
acaaactgagttcacaactgagctcaatcacttggattaatccgccttccatttcggcttgatccttctccaagctcatggctccgaccacctcccttggcaagatctcgctcccgaggcagcagcgccgcctcctccaacctctcaactctccaaagcacaagcgcgttgccgccacacccccagctgtgttgctccaagaattgttcggggatgctcaggcagatcagcctcccaagacaagacgcgcctccgacgagactctagccgtccacgctggggagaagcttggcaagggcgcggatgaggccgtcacggactcgatcgcgacgccaattgtgagcgggacaacgcactggttcaagagctccgaggacctgatcgccttcaaggaaggccggcgccactgccacgagtacggccggtacagcaacccgacggtgaaagtcctggaggacaagatcagcgcgctggagagagccgaggcgaccctagtcacgtcgtcaggcatgaatgccatcgtggcaacgctgctcgcgctcgtgccgccgggcggccatgtggtaacgaccactgactgctacagcgaggcgcgcgccttcatcggcgataggctctccaagatgggcatcaggtccacattcatcgacctcgacgacatgaagtcactacaggctgtccttgatcagaacgatgtgactctcttctacgccgactccccaacaaacccactgcttaagtgcgtggacatcaggctggttgccgagctgtgccaccagaagggcgccttggtgtgcatcgacagcacgctcgcgtcgcccatcaaccagaagcccctcaccctcggcgccgacatcgtcctgcactccgctacaaagtacatggccggtcaccacgatgtcattgccggatgcgttagcggctcggaggcgctcatctccaaaatacgggcatggcactacgaccttggcggcgctatcagtccgaacgcggcttacatgatcatacgcgggcttaagacgatggcccttcgtgttgaggcacataaccgttcagcactgcaaatggcacgcctactggagtgccacccgaagattgaacgggtgcactaccctgggcttgagagcaatccatggcaccaagtcgccaagaatcagatgactgggtatggcggcgttgtcagcttcgaggtcaaatcagacctctgcggcaccatgaggttcgtcgatgcactagaaatccccttgatcgcaacatcgcttggtggttgcgagagcctggtgcagcagccggcagtcatgtcattctggggaaagagtgatgaggaaaaggccaagaacgggatcaaggacaacctggtgaggttcagtttcgggattgagaagtttgaggatttgagggacgacgttctccaagcattggagaagatttaggaacgaagcatgaagtacaaatttataggttttggacacacctagctagctagaaactgctatttacatacactgcaactttgctagctaactttataggaagttcaaaatgatattattttatgcacttgtagaaaggaaaaagatatagttcatccctgataattgatgaaatatggatgacaacagtacatgaatgctt

SEQ ID NO: 19400 - protein, 451 aa, Panicum virgatum
  misc_feature: Ceres CLONE 1805589
  misc_feature (61)..(449): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
MAPTTSLGKISLPRQQRRLLQPLNSPKHKRVAATPPAVLLQELFGDAQADQPPKTRRASDETLAVHAGEKLGKGADEAVTDSIATPIVSGTTHWFKSSEDLIAFKEGRRHCHEYGRYSNPTVKVLEDKISALERAEATLVTSSGMNAIVATLLALVPPGGHVVTTTDCYSEARAFIGDRLSKMGIRSTFIDLDDMKSLQAVLDQNDVTLFYADSPTNPLLKCVDIRLVAELCHQKGALVCIDSTLASPINQKPLTLGADIVLHSATKYMAGHHDVIAGCVSGSEALISKIRAWHYDLGGAISPNAAYMIIRGLKTMALRVEAHNRSALQMARLLECHPKIERVHYPGLESNPWHQVAKNQMTGYGGVVSFEVKSDLCGTMRFVDALEIPLIATSLGGCESLVQQPAVMSFWGKSDEEKAKNGIKDNLVRFSFGIEKFEDLRDDVLQALEKI

SEQ ID NO: 19401 - DNA, 1033 bp, Panicum virgatum
  misc_feature: Ceres CLONE 1805590
  misc_feature: Encodes the peptide sequence at SEQ ID NO. 19402
aaatccagctcctcctctcccctcgagctcccctggcaggcatcgacgatccaaagctagcgcaaccgcctccctatttgaggatcccaccgacctcctcttcttcccccacgacacgatcgaggagccacgaatccaattcccagccgagaaagcgaatctttgaggcagatcaacatccatggcggcggtgatggtggcgaggcaggggcgggagctgcagcgatacagcgacagcaccggcgggcgcgtcgtggtggggtgcatcccgtaccggctccgcgcgggcggcgaggtggaggtgctggtgatcagctcgcagaagaagggccccgcggggggcgtgctgatccccaagggcgggtgggagctggacgagtccatggacgaggcggcgcggcgcgaggccgcggaggaggccggcgtggtcggggagacgggccccgcgctggggcggtggtgctaccgcagccgcagctacgacgccacgtacgagggcttcgtgctcccgctgcgcgtcacggcggagctcgaccggtggcccgagatgggcgcccgccgccgcgagtgggtctcccccgccgaggccgtcgcgcgttgcccgcacgcctggatgcgcgaggcgctgcagcgcttcgccggcaccgtcgccggggccgaggcccaggccgcggcggccctcctcggctccgccctgtagccggggcgcgcgggctctgctccggcctcgcgcgtttttcggccggccggacgcgcgcgcgcggccggaggctccggctgctcctccgccgccggcggcggcggaacggagatgtgggtacacggtcacggtagtagatcggcgatggggcgcggccattgtgctgcgaccaaatcgatgtcacgaggacacggctctgtacagtcttggctgattggggattttttttttctctcagaagaaacatgtaaatctgacgtagtagttgacacaattcatcattgtgacacgagcaaaggaattaaaaacggcggcaaagattcaccaatgacc

SEQ ID NO: 19402 - protein, 172 aa, Panicum virgatum
  misc_feature: Ceres CLONE 1805590
  misc_feature (22)..(155): Pfam Name: NUDIX Pfam Description: NUDIX domain
  misc_feature: SWISSPROT Homolog: EC 3.6.1.52 Diphosphoinositol-polyphosphate diphosphatase
MAAVMVARQGRELQRYSDSTGGRVVVGCIPYRLRAGGEVEVLVISSQKKGPAGGVLIPKGGWELDESMDEAARREAAEEAGVVGETGPALGRWCYRSRSYDATYEGFVLPLRVTAELDRWPEMGARRREWVSPAEAVARCPHAWMREALQRFAGTVAGAEAQAAAALLGSAL

SEQ ID NO: 19403 - DNA, 1274 bp, Panicum virgatum
  misc_feature: Ceres CLONE 1805592
  misc_feature: Encodes the peptide sequence at SEQ ID NO. 19404
agagcccatcaccaccgtctccccatcgcgccaccgcaaaagccgcgaccaagtacccacagcaagctcctgctcctcctgattgttccactgctagtcgtcgtcttcttgttcttcgtcttgatcccgacggtcgtcttgttgcccccagaccgaaccatgtcgtcgtcctcgtcctctgcctccgacgccgccgcttcggcgccgttcgagaagcccagggccgtggtcaagaagctcctcgccgagtcgcagtccgagggacagggcgccaccgtccggaggagcatcggcaggcatgagctcaggaacctggaccccttcctcatgctcgacgagttctcagtctccaagcccgccgggttccccgaccatccccacagaggattcgagaccgtcacctacatgctcgagggcgccttcacccaccaggactttgcaggccacaagggcaccatcagggcaggggatgtccagtggatgactgccgggcgtggcatcgtgcactcggagatgccggcgggggacggggtgcagaagggcctgcagctgtggatcaacctctcctccaaagacaagatgatggagccccggtaccaggagctccagagcaaggacatcagccgcgccgaaaaggacggcgtcgaggtccggatcatcgccggcgaggccttcggcgtgcgctccccggtgtacacgcgcaccccgaccatgtacatggacttcaccatgcgcccggggtcggagctccaccagcccgtcccggagggctggaacgccttcgtgtacatcatcgccggcgagggcgtgttcggccgggacaagtcggcccccgtcggcgcgcaccactgcctcgtgctcggccccggcgacgggctcagcgtgtggaacaggtccggcgcgccgctgcggttcgcgctggtgggcgggcagccgctgggcgagccggtggtgcagcacgggcccttcgtcatgaactcgcgcgccgagatccagcaggccatggaggactactactacggcaagaacggattcgagagggccacccactggacatcctcctccgcctgaatgcctgatcgatccatccatcatacttgcatgggatgggacagagtcagcagaccattagctgatatactactgtactctgatcttgataattattttttttctccttagttgtatcgtactcctactagaaaggattatgtgtttttgtttatttgtatggtgattgtaataagcagggtggcgaatttatttgtagtctt

SEQ ID NO: 19404 - protein, 303 aa, Panicum virgatum
  misc_feature: Ceres CLONE 1805592
  misc_feature (37)..(133): Pfam Name: Pirin Pfam Description: Pirin
  misc_feature (186)..(291): Pfam Name: Pirin_C Pfam Description: Pirin C-terminal cupin domain
MSSSSSSASDAAASAPFEKPRAVVKKLLAESQSEGQGATVRRSIGRHELRNLDPFLMLDEFSVSKPAGFPDHPHRGFETVTYMLEGAFTHQDFAGHKGTIRAGDVQWMTAGRGIVHSEMPAGDGVQKGLQLWINLSSKDKMMEPRYQELQSKDISRAEKDGVEVRIIAGEAFGVRSPVYTRTPTMYMDFTMRPGSELHQPVPEGWNAFVYIIAGEGVFGRDKSAPVGAHHCLVLGPGDGLSVWNRSGAPLRFALVGGQPLGEPVVQHGPFVMNSRAEIQQAMEDYYYGKNGFERATHWTSSSA

SEQ ID NO: 19405 - DNA, 1058 bp, Panicum virgatum
  misc_feature: Ceres CLONE 1805593
  misc_feature: Encodes the peptide sequence at SEQ ID NO. 19406
actgcggcccattcataggcataggctggtgatcatatcacagctccacgtctccagttccagtctactcagccccctgcatagagtgctcctccttaatttgaaggaacaagcaagaaaaggagagaaagatgaccagcgtttggaagaccaaggttctgccccgcctcaacaagatctttgacaaggatggcaagaaggcggcggcggccgagttcctaaagtccttcaacaaggaggagattggcaaggagattaaggctctgttcaaggacaagaaaccagtcaagatcagcaagaagaactcggctgcagctaccaagttgctcgacgagctggctaagattgagttccctggagcaaagctggtgagcgacgcggtggccaagtccggcaccacgcccctctccccggcgatcaccttcgtcttcgacaaggttgcgccattcatccccaaggaggagcccaaggccgagccggaggccacctcccgggaagtcgccgtcgaggagaagaaggaggaggccgagcccccggccgctgcggcgacggaggaggctgcgccggcaccggcggaggcgtcggaggcggtagaggagaagaaggctgaggaggagaagccgacggaagccgcagccgaggccgcggcggcgccaccagctgaggagaagaagtgatcgccacgccagtcgacactgaatgaagaagctaagcaagcaaattaagctacgtagctagctccgatcctcctcgttgctggtaaattgaagttaccttaccgtgagatttaaattaaattactccctctccttcttgtcaaccacgtcgtcgtatatatatatatagtagctagctgctgcacaaattaatttgcatatatataagggtggtggatgcatgaacatttgttattcttttgtgtcacctcgatcgatggatggaccttctgtaaatttgtaatgggttttgcctttcttgttttttttttcttgattttggggtgattaaacatgcacgtgtaattatttgtattgatatgtttgctggtggtcatattt

SEQ ID NO: 19406 - protein, 181 aa, Panicum virgatum
  misc_feature: Ceres CLONE 1805593
  misc_feature (2)..(181): Pfam Name: DREPP Pfam Description: DREPP plasma membrane polypeptide
MTSVWKTKVLPRLNKIFDKDGKKAAAAEFLKSFNKEEIGKEIKALFKDKKPVKISKKNSAAATKLLDELAKIEFPGAKLVSDAVAKSGTTPLSPAITFVFDKVAPFIPKEEPKAEPEATSREVAVEEKKEEAEPPAAAATEEAAPAPAEASEAVEEKKAEEEKPTEAAAEAAAAPPAEEKK

SEQ ID NO: 19407 - DNA, 1146 bp, Panicum virgatum
  misc_feature: Ceres CLONE 1805600
  misc_feature: Encodes the peptide sequence at SEQ ID NO. 19408
cttcttcttcgcttggcggcggcttcggcttggcttggccactactgctccctcccactccactccctcaccgtcaccggctgcgcgcatggcgctccacgccgtctcccccgcggcggcctcctccccgctgcgcgccctctcgcgccgcctcgccgagcgccaaggctgtggttgcctcccaaagcaattggtttactcctccacgaactttgcaagacttcaggctggacaagtggactttgttggcaggccactcgttcttcagcactccgacaagagagcagttttgacgcatgccactatcgaagaaattgaagcagaaaaatctgtcattgaagagcaagctaaagaaaagatggagaaggcaatcgaaacggtccaaactaacttcaacactgtgaggacagggcgtgcaaacccggcaatgctggaccggattgaggttgagtactatggaactccagtgaacttgaagagcattgcacagataagcactccagatgcaacttctcttcttattcagccatatgacaagtcaagcctcaagcttattgagaaaacaatagttgccgcgaatcttggtgtaacaccaagcaatgatggagaagtgatacgagtgactgtcccaccactgacatcagatcgcagaaaggaattagcaaaaactgtagctaagttagctgaagatggcaaggttgctataaggaacataagaagagatgcaatcaaagcttatgataaactacagaaggaaaagaagctttctgaagataacgtgaaagatttgtcggctgatctacaaaaagtcacagatgggtacatgaaaaagatagaatccatccaaaagcagaaggaagaggaactgatgaaaatttagatctcaagctgacagtataactgtttggtgctgcgccggggatgcacgttctgtgtcggtgctttgctggaactttttggatgcaagttcagacaatggtagtgttgctgtgcttctgtttttgtaatggttagggttgaaaacggacggaaatattcccattccggcccgttctgttttctatttttgtccatccgtttctgtatttgtgggatcccgtttccgtatttacggaagtagaaatgaggtttctccgtccgtttccg

SEQ ID NO: 19408 - protein, 263 aa, Panicum virgatum
  misc_feature: Ceres CLONE 1805600
  misc_feature (97)..(261): Pfam Name: RRF Pfam Description: Ribosome recycling factor
MALHAVSPAAASSPLRALSRRLAERQGCGCLPKQLVYSSTNFARLQAGQVDFVGRPLVLQHSDKRAVLTHATIEEIEAEKSVIEEQAKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLAEDGKVAIRNIRRDAIKAYDKLQKEKKLSEDNVKDLSADLQKVTDGYMKKIESIQKQKEEELMKI

SEQ ID NO: 19409 - DNA, 1349 bp, Panicum virgatum
  misc_feature: Ceres CLONE 1805610
  misc_feature: Encodes the peptide sequence at SEQ ID NO. 19410
aagtcctcctctctttgctgacctcggacggagcagggggaaggaaggaagcgagcgagcgagcgagcgaggaggagagcatcgatcggtgaggggagagaggcatggcggggagggcgcggtacgacaaccccttcgaggagggcggcgccgacgaggtcaaccctttcgcggaccaggctaaaagaggagcatcaaacgctcagtccagctattccggtggcgcgttctacacaacgcaatcacgccctgctcctccgagcacacgccgttcgcctcttcctccggaacctgccgacttctacaatgactttgctaccccggtggacatccccatggacacaaacagggacatcaagacaagggagaaggaccttctggccaaggaggctgagttgaacaggcgtgagaaggaactcaaaaggagagaggaggctgccgcacgagctggcattgtattggaagagaaaaactggccaccatttttccccatcattcatcatgatattgggaacgagatacctatccatttgcaaagaacacagtacgttgcatttgcatcactattaggattggtcttgtgtctgttttggaacatcatctgtgttagcgctgcctgggcaaaagggtcaggtcctaagatatggtttcttgcaatcatatacttcattcttggatgccccggtgcctacttcctatggtaccggccactttaccgtgccatgaggaacgagagtgctctgaaatttgggtggtttttcctcttctacttggttcatatcgccttctgcgtgtatgcagctgtttccccttcaattctctttgtgggaaaatcattgactgggatttttccagcaatcgacttgatagacaatagcgtcattgttgggatcttctacttcgttggctttggattgttctgcctcgagtctttgctaagcatgtgggtcattcagcgtgtctaccggtacttccggggcagcgggaaagaagcggagatgaagcgggaggcagcacgtggtgcgtcgagggcagcattttgatgatccgtatatataagtatatatatatatatatatacaacacgtataatgttcatagtgtgaagtgtttgtagatcaaaaagacgtgcggagtagggttagtgtgatgtaaatctacagaatttaatttccttattttccactgagtttggagcccttcagattgatcagtcctgtcagtattagaatggagtaaatacacacacatgaaactagatggtttgttgttacatactgtatgtgacttttctgtgttgcctttgaccactttattctcctcgaattttagcaaaaataaagttgcag

SEQ ID NO: 19410 - protein, 312 aa, Panicum virgatum
  misc_feature: Ceres CLONE 1805610
  misc_feature (120)..(294): Pfam Name: SCAMP Pfam Description: SCAMP family
  misc_feature: Functional homolog of the protein sequence given in SEQ ID NO 50850
  misc_feature: Useful for biocontainment applications
MAGRARYDNPFEEGGADEVNPFADQAKRGASNAQSSYSGGAFYTTQSRPAPPSTRRSPLPPEPADFYNDFATPVDIPMDTNRDIKTREKDLLAKEAELNRREKELKRREEAAARAGIVLEEKNWPPFFPIIHHDIGNEIPIHLQRTQYVAFASLLGLVLCLFWNIICVSAAWAKGSGPKIWFLAIIYFILGCPGAYFLWYRPLYRAMRNESALKFGWFFLFYLVHIAFCVYAAVSPSILFVGKSLTGIFPAIDLIDNSVIVGIFYFVGFGLFCLESLLSMWVIQRVYRYFRGSGKEAEMKREAARGASRAAF

SEQ ID NO: 19411 - DNA, 1106 bp, Panicum virgatum
  misc_feature: Ceres CLONE 1805613
  misc_feature: Encodes the peptide sequence at SEQ ID NO. 19412
agcccgcaacacagccaggcatgtggcgccgcacctcccacctcctcctccgcaacgccgtcgccgccacccggcgatgccacccacagccgcttctggccccaccgccgccgcttcccctcgcaccgccatggctcgcctccacgtcctcctacgccacccaggcagcggcggccgcggcgaagcccctccggacggtgggccccttgctgcggctcaacgacctgcgggacaacccgggagcgacaaagcagaagacgcgcaagggacgcgggatcggctccggcaagggcaagacggccggccgcgggcacaagggacagaaggcgcgtggcaccgccaggttgggcttcgagggcggccagaccccgctccgccgccgcctgccccgacgcggattcaagaaccgcttctccctcacattccagccctgtggactgcggaaaattgcaaagctcatcaatgctggaaaaattgactcctctgaactgatcacgatgaagacactgaaggaaacaggtgcgattgggaagcaaataaaggatggtatccgtttaatgggccgtggagcagaagaaatcaaatggcctattcaccttgaggtcatcgaattctgcttcaccaaatgacaaaagtctgctcagatgtatgtctgatccggatttctcattcctcagaaccttttcgctaaaaatgggagttcaagcttctcaatctggaagactggaacagtcagtgagcaagtggatccccatagtttggctgcctcaagatctcactttagtgcagtgccaggcaccatccgagaaacctgttgaaccatgattccacggatcacttagcacacgaataaaaatccgggtgttttactttggctccatttctgatttcgtttattcacaatctactcgtaatgtggtgttgctcaaatgcttgagatctggccaatgtcgatcgtgcatctgtttccttaggcgtgttgttgtctgaattatgtatctgaaacatgtggcgttgctcgctggtttaccacctcgaactgagaaggtgtttggttggttcaaatgtaacgaaatcggattacggaaggcaataaatttcattac

SEQ ID NO: 19412 - protein, 202 aa, Panicum virgatum
  misc_feature: Ceres CLONE 1805613
  misc_feature (64)..(163): Pfam Name: Ribosomal_L15 Pfam Description: Ribosomal protein L15 amino terminal region
MWRRTSHLLLRNAVAATRRCHPQPLLAPPPPLPLAPPWLASTSSYATQAAAAAAKPLRTVGPLLRLNDLRDNPGATKQKTRKGRGIGSGKGKTAGRGHKGQKARGTARLGFEGGQTPLRRRLPRRGFKNRFSLTFQPCGLRKIAKLINAGKIDSSELITMKTLKETGAIGKQIKDGIRLMGRGAEEIKWPIHLEVIEFCFTK

SEQ ID NO: 19413 - DNA, 1061 bp, Panicum virgatum
  misc_feature: Ceres CLONE 1805634
  misc_feature: Encodes the peptide sequence at SEQ ID NO. 19414
cccaccccgcacggccacacctctccacctccgacgaccaccaccaccatggcggccgcctccctctcccacctctcccgccgcgccaccacctccgccgtcgcggcggcgccctccctccggcgcctcctctcggcaacctccaccgcccccgccgcgcagtccgccccgccgccgccgccgccgccgccgccgagcgcggccgcggccgcctcgacaggcgcggatcgggtgcggtgggactaccgcgggcagaggcagctggtgccgctgggccagtggatgcccaaggtggccgaggacgcctacgtcgcccccgaggctgtgctcgccggccaggtcaccgtccacgacggcgcctctgtctggagcggcgcggtgctacggggtgacctcaacaagatcacgctcggcttctgcrccaacgtccaggagcgatgcrtcctccacgccgcatgggcggcacctacaggacttccagctgagactcttgttgatcggtatgtgacagtgggtgcttactctctgttgcgctcttgcaccatcgaacctgagtgcatcattggtcagcactcgatccttatggaaggttcactggtcgaaaccaactcgatccttgaggctggctctgtcctgccccctggaaggcggattccaactggtgaactctgggctggaagcccagccaggtttgtccggaagctaaccaatgaggagatcatggagattccaaagctcgcgacggccatcaacgatctgatgcaaagccatttctcagagttcctcccttactctaacgcttatttggaggttgagaagttgaagaagtcattctcgattcccctgtaagagcatatttcccccccacatccagctgaattgaatgaggaataaaggtgcccaaatactagatgttttgtattgaatctaacttgtactctgggttgatctgttgcatcgcaaaatttttgtctattgttgttgtgagcctggggccacgcttgcaggaaccatatcgttgtatctgtttacctaatgcaatgcaatgcactgttctcgac

SEQ ID NO: 19414 - protein, 266 aa, Panicum virgatum
  misc_feature: Ceres CLONE 1805634
  misc_feature: SWISSPROT Homolog: EC 4.2.1.1 Carbonate dehydratase
  misc_feature (125)..(125): Xaa is any aa, unknown, or other
  misc_feature (132)..(132): Xaa is any aa, unknown, or other
MAAASLSHLSRRATTSAVAAAPSLRRLLSATSTAPAAQSAPPPPPPPPPSAAAAASTGADRVRWDYRGQRQLVPLGQWMPKVAEDAYVAPEAVLAGQVTVHDGASVWSGAVLRGDLNKITLGFCXNVQERCXLHAAWAAPTGLPAETLVDRYVTVGAYSLLRSCTIEPECIIGQHSILMEGSLVETNSILEAGSVLPPGRRIPTGELWAGSPARFVRKLTNEEIMEIPKLATAINDLMQSHFSEFLPYSNAYLEVEKLKKSFSIPL

SEQ ID NO: 19415 - DNA, 1188 bp, Panicum virgatum
  misc_feature: Ceres CLONE 1805635
  misc_feature: Encodes the peptide sequence at SEQ ID NO. 19416
tccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggaggctaggttagcatcctgtcaaaaaaaaaactccgatagctagcagcttgcctgattgatcatcccggaagatcaagcactgaaactccaatttcagttcagttatcaccgaggacactgactgaagtagagatggcggagcgttcagagaacgcggcgggggacatgatgagcaacatcatggacgccatcgccgagaacctcccgaacaagaagtccgtcaggttcgacgacggcgagggctccatctccgaccaggccaggaagctgttcggcggcggcgggcagggcggcaagaagtccgtccaccacgtcctgggcggcggcaagtccgccgacgtgctgctgtggcggaacaagaagatctcgtcgagcgtgctgggcgcagcgacgctgtcctgggtcttcttcgagtggctcgactaccacttgctcaccatcgccagcttggcgctggtgctcggcatggccgtgcagctcgcctggtccgcgctcgcctcgaacgtgccccgcctcgaggtgccggaggaggtgttggccgacgctggcagggccgccggcgcgcaggtgaaccgggccctgggcgcgctccaggacatctcctgcgggagggacctgaggcggttcctcatcgtgatcgccgtgttcttcgcggtcgcggtcgtcgggagcttctgcaacttgctgacggtcatctacatcgggttcgtgtgcgcgcacacgctgccggtgctgtacgaggagtaccaggaccaggtggacgagttcctgtgcagcatgctgggcctgctgcagcaccagtaccagaagctcggcagcaagggcgtcctcggcaaagggaaggccaggaagagcgactagctggttggttcgatttgctctgccgtgtaacataatctgctggggcggacggctggtccactgatacgcctgtctgcatgtacgcagccagctgcggtttcctgaaaccaactcgatgcctgtacagtgctgaaagtacttgcttgtgtaatgcactacagtaatgctttagtagcttcg

SEQ ID NO: 19416 - protein, 242 aa, Panicum virgatum
  misc_feature: Ceres CLONE 1805635
  misc_feature (67)..(241): Pfam Name: Reticulon Pfam Description: Reticulon
MAERSENAAGDMMSNIMDAIAENLPNKKSVRFDDGEGSISDQARKLFGGGGQGGKKSVHHVLGGGKSADVLLWRNKKISSSVLGAATLSWVFFEWLDYHLLTIASLALVLGMAVQLAWSALASNVPRLEVPEEVLADAGRAAGAQVNRALGALQDISCGRDLRRFLIVIAVFFAVAVVGSFCNLLTVIYIGFVCAHTLPVLYEEYQDQVDEFLCSMLGLLQHQYQKLGSKGVLGKGKARKSD

SEQ ID NO: 19417 - DNA, 1103 bp, Panicum virgatum
  misc_feature: Ceres CLONE 1805653
  misc_feature: Encodes the peptide sequence at SEQ ID NO. 19418
atctacaatacactgaattattgtttgttgggctaaagtgtcctgtcgtttcatgccattcctgctgctcctttgatgtgcagactgaggtgaattaccttggaacgttgtcacacccatatcttgtacggctcgttggctactgtctcgaagatgaacagcggctccttgtctatgagttcatgccacgcgggagtttggagaatcatctgttcagaaggagctcccatttccagccacttccctggaacctacgaatgaaaattgcccttgttgcagctaaaggtcttgcctttctccacagtgataatgctaaagtcatctaccgtgatttcaagacctctaatattcttctagatgcgaatttcaatgcaaagctctcggatttcgggctggcgaaggatggtccaactggcgacaagagtcatgtctccaccagagtgatgggtactcatgggtatgcagctccggaataccttgcgacaggtcatctgacggccaagagtgacgtctacagctttggagtagtactcctagaaatgctgtcaggacggcgcgcactggacaagaaccgcccgcatggggagcacaacctggtggagtgggctaggccatacctgagaagcaagcgacgcatattccgtatcctggacccccggctgggcgggcagtactccctcgctagggcacagaaggctgcagctctggcactgcaatgcctctcggtggagtccaggcacaggcccagcatggatgaggtggtaacagcgttagaacagctccaggacgccaaggagggagggcaccattacctacaaaagaggccgagcagtcggagcttggacagcagtggcgtgaaagcgtccatgaaggggaagcctgcctcttcttcaagaccaatttgagtcgacagagtattttcctttttcttttgcaggtgtaggtaacataatataggttcacagagggatttgtaaagaggcaggagttctgaatgttttgtgtttatattgtagtttttacatctttgagtctttgtaaagtacactatgtacatacataattacatccagtttggagtgttataaaattctgttcaagcc

SEQ ID NO: 19418 - protein, 300 aa, Panicum virgatum
  misc_feature: Ceres CLONE 1805653
  misc_feature (3)..(257): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
LQYTELLFVGLKCPVVSCHSCCSFDVQTEVNYLGTLSHPYLVRLVGYCLEDEQRLLVYEFMPRGSLENHLFRRSSHFQPLPWNLRMKIALVAAKGLAFLHSDNAKVIYRDFKTSNILLDANFNAKLSDFGLAKDGPTGDKSHVSTRVMGTHGYAAPEYLATGHLTAKSDVYSFGVVLLEMLSGRRALDKNRPHGEHNLVEWARPYLRSKRRIFRILDPRLGGQYSLARAQKAAALALQCLSVESRHRPSMDEVVTALEQLQDAKEGGHHYLQKRPSSRSLDSSGVKASMKGKPASSSRPI

SEQ ID NO: 19419 - DNA, 1264 bp, Panicum virgatum
  misc_feature: Ceres CLONE 1805673
  misc_feature: Encodes the peptide sequence at SEQ ID NO. 19420
cacgtccagctcacgccggtgcgccgcccgcccaagcgctcgcgcggtcgcgccgcaccgcgcgctcactcaccaaccgctgctataagtctattaaacacaggcccagatccgcgcctccaccctgccccgctgcccgccaccgcccgcacacaccaaccggcaccgcaccagcagcaccgtcgaccaccatggccgcctcgccgcgcctcgccatcctgctggcgctcctggcggcgtcgtcggcgcttgccgcggcgcagaaggccaaggcgaagccggcgcccgggccggccggggcggcggacgcggccccgccgacggacgtgaacaaggcgctcaaggacgaccagttcagcgagttcaagcagctgctccacgacacgcgcgtggacacccagatcaacgcgcagctgacggacagctacaacgggctgaccatcttcgcgcccaccaacgccgccttcgacaagctcaaggccggcgtgctcaacgggctgtcgccgcaggaccagatccagctggtcctctactgcgtgctccccaggttctacagcctctccatgctcggcaccctcaacggcaaggtcaacacgcaggggtccgggcacgacggcccctacaagtacgacatcaagcgcgcgggcaacaacgtcaacgtctccaccggcgtcaactccatgctcctggggagccccgtgagcaaggacttcccgctcgccgtctaccccgtcgacaaggtgccgctcccgtacgagctcttcggccccaagccgcccaccccggcgcccgcgccggccccggccccggccaagtccaagaccaagaagaagcacaagaaggccaccggcatcgccgagccgcccgtggccgacgactccaccgcctcggacggggacaagaagtcggcggccgcgcccgccgccggggtggccaggtgggtcgccgcgctcgggatgctcggcgccgctgtcctcggcggcctcttctgaggaaggatagaatcattcgaacatccggagatcagagggtgctggactggtggtggtggtgtgatccatggacgagatctcgtgcgtcgtgcattgccacgcacgatcgagctggcgtccccgtacactcatcgatcgatcgattattgatccctttaccgtgcatttgtgcgtccatcggctttattctttctctccctctttctttctttttttggcttcttggtgatttgtatttgtaacttaatgtggtatacactagtacttcttgc

SEQ ID NO: 19420 - protein, 266 aa, Panicum virgatum
  misc_feature: Ceres CLONE 1805673
  misc_feature (54)..(187): Pfam Name: Fasciclin Pfam Description: Fasciclin domain
  misc_feature: Functional homolog of the protein sequence given in SEQ ID NO 50242
  misc_feature: Useful for making plants with altered carbohydrate content
MAASPRLAILLALLAASSALAAAQKAKAKPAPGPAGAADAAPPTDVNKALKDDQFSEFKQLLHDTRVDTQINAQLTDSYNGLTIFAPTNAAFDKLKAGVLNGLSPQDQIQLVLYCVLPRFYSLSMLGTLNGKVNTQGSGHDGPYKYDIKRAGNNVNVSTGVNSMLLGSPVSKDFPLAVYPVDKVPLPYELFGPKPPTPAPAPAPAPAKSKTKKKHKKATGIAEPPVADDSTASDGDKKSAAAPAAGVARWVAALGMLGAAVLGGLF

SEQ ID NO: 19421 - DNA, 651 bp, Panicum virgatum
  misc_feature: Ceres CLONE 1805674
  misc_feature: Encodes the peptide sequence at SEQ ID NO. 19422
aagttccattccccatccgccatcacccaagccgaaccgaaaactgaccccaaacccaacccgcgaatcgcacccaattcgaccggggaatcgcgccatccgccaccatgagcttctcgtccatgagcaagcagcaggtgctggacgccggcgagggcgcgggggaggaggtcgtggagctcatcccgggcctgccggaggaggtggccgagaagtgcctcctccacctgcccttcctctaccaccgcctcttccgcaccgtctcctccacctggaaccgcttcctcaccgacgcccccggcaagccgccgctgctcgcccccgcccccgccgcggcggcgggcgcggtgtaggtatccttctcgctgccgttcctcttcgccttcgcgtatgaacccgcgtcggggggcctccagtgccacgcgctcgacacgttgacccggaggtggctcctgctgccgccggtgcccggcggcgccgcggccgggtcggtcgcggagattgggctcccccgcccctccgagatctacgcgatcgggggagtataggatggtggcaacaaggccgtaagctccccgaccatgtgatcatccacgaggagctggtgcgaggccgcgacggccatgcggacctcccgatggtgcatgaggg

SEQ ID NO: 19422 - protein, 81 aa, Panicum virgatum
  misc_feature: Ceres CLONE 1805674
  misc_feature (24)..(71): Pfam Name: F-box Pfam Description: F-box domain
MSFSSMSKQQVLDAGEGAGEEVVELIPGLPEEVAEKCLLHLPFLYHRLFRTVSSTWNRFLTDAPGKPPLLAPAPAAAAGAV

SEQ ID NO: 19423 - DNA, 650 bp, Panicum virgatum
  misc_feature: Ceres CLONE 1805674-R
gggaggtcgccggcgggaggcggaggatatacgtcgtcggcgccgggctcgacgtcgccgtgggcacggtgtccgccgccgccgccggtgccccccacggcgtcgaggaggaggtggtggagtgggaggtcgtcaagggccccgccgagttcgccggcctcgcgccctgcaacgcgcaggtcctttacgcttgaggcgcgcgcgccggaaccccccgcgcactccgcgggtggaacgtctctgtcgccggacgatggagggagctactacggctcggcccaagcgcccacgggccccacctgctccgtccgtacgcgtcaccttctcgccggcgaagcgccatgctggctcacatgtcagcggaacgtgacggctccagcgcctcgccggcagccgagcccaccggctcgcgacgtgggaccagtctgtcagcgagcagtttgcgggaggggctgaagggtcttttgggccactgtcctctactactagactctgcaagcaactaatcaagcgtgcaacggtgcaagcagtagatttttttttttttgcccccacagctttggagggtttttcttgtactagtagtatttgttgtatttctggagaaacaagaggacaacaaagaacgggacggatgtgatgtcctcgcc

SEQ ID NO: 19424 - DNA, 553 bp, Panicum virgatum
  misc_feature: Ceres CLONE 1805675-R
  misc_feature: Encodes the peptide sequence at SEQ ID NO. 19425
tgttggtactcccatatggagtttaccgatacagatttgttgtagatggagaaaggagatgtcttcctgaccttccctgtgaaactgatgcaaggggcagcgctgttaaccttgtggatgttaatgattttgttcctgaaagtttcgagagcgggacagaatttgaaccgcctccatctccagactccaggtatagtttccaggcacctgaggacaaggactttgctaaggagcctcctgctcttccttcccagctccatattggtgttgttaactcacagaactcagaagaaagttgcgcacggccgcagcacatagtcctcaaccacttcttcatcgagaagggctggggtgcccacccgctggtggcgctcggtcttacccacaggttagagtccaaatatgtaactgtcgtcctgtataaccccattgaccgatagcaaaagttgcccgcccatgaagagtggaagttaatgcttgccacctcattgcgagagcagcgatgaacaactcagagggtacatgcttgtaaaagcggtggaggttgaggagt

SEQ ID NO: 19425 - protein, 145 aa, Panicum virgatum
  misc_feature: Ceres CLONE 1805675-R
  misc_feature (57)..(143): Pfam Name: AMPKBI Pfam Description: 5'-AMP-activated protein kinase, beta subunit, complex-interacting region
LVLPYGVYRYRFVVDGERRCLPDLPCETDARGSAVNLVDVNDFVPESFESGTEFEPPPSPDSRYSFQAPEDKDFAKEPPALPSQLHIGVVNSQNSEESCARPQHIVLNHFFIEKGWGAHPLVALGLTHRLESKYVTVVLYNPIDR

SEQ ID NO: 19426 - DNA, 568 bp, Panicum virgatum
  misc_feature: Ceres CLONE 1805675
ataagagccccgcagccccctgctcttctcttcttcttcctcctcccttcccggggcaccagggacccccgccctggtggcatctccgtaatttcgccgcctcttcgccgccgcggggggtgggaggaggaggcatgggcaacgccagcggccgcgaggaggacgtcgcggccgtggacggcgacggcgccgacgtgtaggacggcggcggggactcgtcggtccgctcgtccgagcgcggcttcccgccgtacggcggcgggggagcaaaccacgtgcggcgcgcgtgctcggtgggagtcgtcggaggcggaggcggagctggatcgccgccagggagccccggccgctcgctctctccacggatgttcgtgccccaaacccctgtgcctccactgcaaagagctgctgatgtaaccccggtattcagccctatattaataaacgaaaaaaaagaataatacgatggtccccctccaaaggaaattcctgctttaattgtgtggacccttggagggaagaatgtatatgttgaaggatcatggtcataactggaaatcaagaaaag

SEQ ID NO: 19427 - DNA, 1215 bp, Panicum virgatum
  misc_feature: Ceres CLONE 1805690
  misc_feature: Encodes the peptide sequence at SEQ ID NO. 19428
aacggccacggatatcttcgccgcctgctgcgtcgcgagctctccccatggcgctccccctcgcccgcctcctcctccccgcgccccccgcctgccagtgccagcccccgcttggcctgcgcttccgcacgcgccacgtctccttcgctgcctgctcccgcggtcaccgcgccgccatcgctgcccgcgcggccgctagcgcccccgcggcctcggcgccggaggcggtggcggaggagaaggtggagccgcggacgcggctcgtcgcgcagaacatcccgtgggactacacggccgacgacatgcgcgcgctcttcgagaagcacggctccgtcgtcggcgttgagctttcaatgtacaatgccagtaaaaacagagggttggcatttgtaacgatgggttcagaagaggaggcttctgcagctctcaacaatctcaattcaactactttaaatgatagaaaaatcaaggtggactttgcgcgacctagaaagaagcaacctaagcaagttaagcaacctgttgtggtatcagatagctcggaaaagtacattctatttgtcggaaatttgacatggagagttagaaatcgtcaccttcgtgaattatttgcctcgaccccaggtgtcttatcagctgaagttatctttcataccactacaccaaggcgatccgctggttatgcatttgtttctttttcttcgaaagaggctgcagaggctgccatatctactttaaatggacagaatttgatgggacggcccattaatgtgatgttcaaagaagaaaatgctaagaagaatgaatcttctgtcccaaaggaagatgtgtccgtggtggaatcgtctgaacagagtgatagctaaacactaacttttccgagaatcaagaaaagtgaaatgaattgatctgtggttacatatattttgacccatggatgccatattgccgctccgttttgctggttcagggctcatcgattgtgaaatacgtgctctgttagtgggtgtgaaggtttggggattcagagtgaggggccggccatgaaaggaagggtcaaaatgcccaggctcgaactagcgcgatggatgagtctcctgttcactgcagtcgttcactgacgtgtcccaggaaaaccagatatgagatatttgtctgtcttcaaacccctcctaactccctatctcaaaagaaatgcaactctcttttttgcgg

SEQ ID NO: 19428 - protein, 272 aa, Panicum virgatum
  misc_feature: Ceres CLONE 1805690
  misc_feature (170)..(242): Pfam Name: RRM_1 Pfam Description: RNA recognition motif. (a.k.a. RRM, RBD, or RNP domain)
  misc_feature (72)..(142): Pfam Name: RRM_1 Pfam Description: RNA recognition motif. (a.k.a. RRM, RBD, or RNP domain)
MALPLARLLLPAPPACQCQPPLGLRFRTRHVSFAACSRGHRAAIAARAAASAPAASAPEAVAEEKVEPRTRLVAQNIPWDYTADDMRALFEKHGSVVGVELSMYNASKNRGLAFVTMGSEEEASAALNNLNSTTLNDRKIKVDFARPRKKQPKQVKQPVVVSDSSEKYILFVGNLTWRVRNRHLRELFASTPGVLSAEVIFHTTTPRRSAGYAFVSFSSKEAAEAAISTLNGQNLMGRPINVMFKEENAKKNESSVPKEDVSVVESSEQSDS

SEQ ID NO: 19429 - DNA, 1064 bp, Panicum virgatum
  misc_feature: Ceres CLONE 1805701
  misc_feature: Encodes the peptide sequence at SEQ ID NO. 19430
atccatccgaatccccaattcccaatcatcccctccgcgaaattctccgcccgatcgaagcgaagccaaaggagcctagcccccatcctctcaggatgcagatcttcgttaagaccctcactggcaagaccatcaccctcgaggttgagtcctcggacaccattgacaatgtcaaggctaagatccaggacaaggaaggcatccccccggatcagcagaggctcatctttgctggaaagcagctcgaggatggtcgcactcttgcagactacaacatccagaaagagtccaccctccacttggtgctcaggctcaggggaggcatgcagatcttcgtcaagaccctcactggcaagaccatcacgcttgaggtcgagtcttctgacaccattgacaatgtgaaggccaagatccaggacaaggagggcatccccccagaccagcagcgtctgatctttgctggcaagcagctggaggatggccgcacccttgctgactacaacatccaaaaggartccactcttcacttggtgctccgtctgcgkggtggtatgcagatttttgtgaagaccctgacyggcaaaacyatyaccctggaagttgagtcmtcagacackatygacaacgtgaaggcaaagatccaggacaaggagggaatccccccggaccagcagcgtctgatttttgctggcaagcagctggaggatgggcgcaccctggcggactacaacatccagaaggagtccaccctccaccttgtgctccgcctccgtggtggccagtaagttttgagggccatggagctgctgttatccctgggttcacaagtctggtgcttcctttgtctctcgaatggaggggttgtctctgtgtaccgtggtctgtcctggtcttgtggtgcgggtgtcttcgcctgtcctgatggaagtcctatgtggtctggttgtgtctgaacatttgctgctgtgcagcatgctacttggttgaattgtgatgaataagtgaaccctgaacttcgtgtgacattctgtttgctcatggtttctggaaatgttttgttattg

SEQ ID NO: 19430 - protein, 260 aa, Panicum virgatum
  misc_feature: Ceres CLONE 1805701
  misc_feature (37)..(105): Pfam Name: ubiquitin Pfam Description: Ubiquitin family
  misc_feature (113)..(181): Pfam Name: ubiquitin Pfam Description: Ubiquitin family
  misc_feature (189)..(257): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
PSESPIPNHPLREILRPIEAKPKEPSPHPLRMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 19431 - DNA, 882 bp, Panicum virgatum
  misc_feature: Ceres CLONE 1805702
  misc_feature: Encodes the peptide sequence at SEQ ID NO. 19432
ataaatcgcggccacccctctccgctgggagtagcacaagccgcgattagcccgtgaactccgcaaaagcagcgcgcgattttggatccagggctctagagtccggactgttcccgagttttctttctcccccaccgcaccaccccgcctgctcgcgccgcagcggacgagaccatgtgccccccgggcaggtacctgggcctcgacctctccgccgcgggcgtcggcggcgacctgaggccggcgttcgacgtgctggacgcggaccgggacggccgcatcagccgggaggacctcaaggccttctacgccaccgccggggggcggttcgacgacgacgacctggcggccatgatcgcggccgccgacgccgaccgcgacggcttcgtgcagtacgacgagttcaagcgcctgctggccggccgcgcggccgcggggggcgccggggggcggtccgcgatggaggacgcgttccggctcatggacctggacggggacggcaaggtcgggttcgaggacctcaaggcgtacctcgcgtgggccgggatgcccgcggcggacgaggaggtgcgcgccatgatccgcgtcgccggcggaggggacggcgacgaaggcgtggggatcgaggcgctcgccagagtgctcgcggtcgacttggaaggcatcgccctctgaaagctctgaactgcttgcggaggcagagcattgtgcgtcgttttccctgtgaatcttttctgaaaactcggttggtgacaccgagagatggatgtgatttggttggttcacgcggaccttgagcgcgcgtgtattgcgcgtgtatttacctgccactccatgagaatattgaaaattgcatcgatgctgcccattctggtgttttcg

SEQ ID NO: 19432 - protein, 166 aa, Panicum virgatum
  misc_feature: Ceres CLONE 1805702
  misc_feature (56)..(84): Pfam Name: efhand Pfam Description: EF hand
  misc_feature (95)..(123): Pfam Name: efhand Pfam Description: EF hand
  misc_feature (20)..(48): Pfam Name: efhand Pfam Description: EF hand
MCPPGRYLGLDLSAAGVGGDLRPAFDVLDADRDGRISREDLKAFYATAGGRFDDDDLAAMIAAADADRDGFVQYDEFKRLLAGRAAAGGAGGRSAMEDAFRLMDLDGDGKVGFEDLKAYLAWAGMPAADEEVRAMIRVAGGGDGDEGVGIEALARVLAVDLEGIAL

SEQ ID NO: 19433 - DNA, 671 bp, Panicum virgatum
  misc_feature: Ceres CLONE 1805705
  misc_feature: Encodes the peptide sequence at SEQ ID NO. 19434
aactcactccggcggcctccagctattgcagagcgacgacctccgagtccagcggctaacccaccagcttcccatccagttctcatcactggctagctagacagccagccagccagccagccagccagccaaggcaagccaccggtcatcgcacacgagacgctagttagcttctacatcaagcttattagcctccgatcctgctgcgagagagccgagcgagcgaggatgtcgagccggaggtcgtcgcgtggcaacatctccgaggacgagatcaacgagctcatctccaagctccaggccctgctccccagctcccgccgccgcggctccggccaggtgcgtcgtcgccgctagctgcgaaccgacccttcgactcgcattcagttcctcgcatcatacattcgctgcgcgtgcttctcgtcgcatggtgccctcttgctcataccatgcagctagctagcacctagcagcagagagctccttgttgtactggcggttgcgcctgttctcctttttctgttcaatcaaagcgtctaacactgcgcttggcgtggacgtgtaatgcaggcgtcgacgacgaagctgctcaaggagacgtgcagctacatcaagagcctccaccgggaggtggacgacttgagcgaccggctctcggacctcatgtccac

SEQ ID NO: 19434 - protein, 42 aa, Panicum virgatum
  misc_feature: Ceres CLONE 1805705
  misc_feature: Functional homolog of the protein sequence given in SEQ ID NO 50858
  misc_feature: Useful for making plants with modulated nitrogen use efficiency
  misc_feature: Functional homolog of the protein sequence given in SEQ ID NO 50859
  misc_feature: Useful for making plants with altered terpenoid content
  misc_feature: Functional homolog of the protein sequence given in SEQ ID NO 50860
  misc_feature: Useful for making plants with altered lignin content
  misc_feature: Functional homolog of the protein sequence given in SEQ ID NO 50861
  misc_feature: Useful for making plants with modulated biomass
MSSRRSSRGNISEDEINELISKLQALLPSSRRRGSGQVRRRR

SEQ ID NO: 19435 - DNA, 666 bp, Panicum virgatum
  misc_feature: Ceres CLONE 1805705-R
tgtccaccatggacagcaacagccccggcgcggagatcatccgcagcatccttcgctcctgatcgtgcgctctgcgggcggccccggcgcggcccggccgcgagaggaggtcaacggcgacgactacgacggccgcggccattccccggccggccacgtgcgggctcaattagctagctagggtatatatatataatatatctacaaatatgtgtatctttctcttcttcctttcactacctgtcgatcgatctccctagatctgagatcttgtggctagccccccataccaaaatgtactagctgcacgcacgcgtatgctgatctccctgctgctaagctccaccgggtagctagctagctaggacactagcgctagggcctaagcaagctaagctttatccaccctcctcactttagctcgctcgccgacctcctcctctcgctccctctccatgtgatctctctgtcgtcctccgcgctagctcttcttttgatgccccgcttgtattgttatccctgtaaatttagtcggtggcttggatcgagttggctagctctcttcagacaaccgaccgaccactactacctagagcaaattgattatcatcatctgtcgcatggtgtactgcctcaactttttattaaccactttaattacttgcg

SEQ ID NO: 19436 - DNA, 441 bp, Panicum virgatum
  misc_feature: Ceres CLONE 1805715-R
  misc_feature: Encodes the peptide sequence at SEQ ID NO. 19437
atgaccctgacgagggaccccagcttcaaggcggccctcgtcaccgcgctgtccggccggatcctcgagctctcgcccaccaaggattaacataccatcaccatcacacgagattcttcttggttgctcagattttctcgcagccatggtcaactgttgttggccttcctttgctcactgttctggcaaaacagcgagaacactggacatgaggatttgcagttcggcatcaggaattcaggatcaaccgcgccgcgcgcatccggacatggcgcggaccgaagatcatcacggcgggtggtctgatcggccggcgagatggtcgagtttagcagatcgaaaatagcacaggaaacaacatgaaactgtacaatccttataggcaaaaaacattgttcgcccatttttgcttgatcaaatgaaatcaatattttttttttg

SEQ ID NO: 19437 - protein, 29 aa, Panicum virgatum
  misc_feature: Ceres CLONE 1805715-R
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 1388 in the 11/479,226 US patent application
  misc_feature: The sequence is a functional homolog of SEQ ID NO 1824 in the 10/412,699 US patent application
  misc_feature: The sequence is a functional homolog of SEQ ID NO 2068 in the 10/374,780 US patent application
  misc_feature: The sequence is a functional homolog of SEQ ID NO 652 in the 10/412,699 US patent application
  misc_feature: The sequence is a functional homolog of SEQ ID NO 942 in the 10/225,066 US patent application
MTLTRDPSFKAALVTALSGRILELSPTKD

SEQ ID NO: 19438 - DNA, 503 bp, Panicum virgatum
  misc_feature: Ceres CLONE 1805715
gcacgctcaggcattcctactcccagcttctgccctcctctcttcgttctgtctcgtgtcctcttctcgatcgagcgctcgatctgcggccctgttgttgacctgcgaaacgccggcctgagacgtcaaagcgggaggggtgaccaatagatggatccatggataaacagccagccttctcggagtattgacctgcacgtcggcctgccgccgctcatgcgccagcaggggccggtgcgggtggccaaggccaaggtgctcgtcgaggagaacttcctgcagcctcgaaaaagacaacccaaagccgcggcccgcgagacggggctccaaaggatgaccaaggagaagaggaacctggcgcaagcagaggcagccggggccggaaagaacgaggtgatgccgacctcgtacacagataggatgacatggagaacatctggcatcacacgtcctacctccagctcggaggaccgcccgaagaccaccctgcacagctgaccgac

SEQ ID NO: 19439 - DNA, 675 bp, Panicum virgatum
  misc_feature: Ceres CLONE 1805724
  misc_feature: Encodes the peptide sequence at SEQ ID NO. 19440
taccgccagcttttccaccctgagcagctcatcagtggcaaggaggatgctgccaacaactttgcccgtggtcactacaccattggcaaggagattgttgacctatgccttgaccgcatcaggaagcttgccgacaactgcactggtctccagggcttcctcgtgttcaatgctgttggtggaggaacgggctctggccttggttccctcctccttgagcgcctgtctgttgactatggcaagaagtccaagctcgggttcactgtgtacccatctccccaggtctccacctcagttgttgagccatacaacagtgtcctgtccacacactccctcctcgagcacactgatgttgctatcctgcttgacaatgaggccatctacgacatctgccgccgctcccttgacattgagcgcccaacctacactaacctcaacaggcttgtgtctcaggttatctcatctcttactgcctccctgaggttcgatggtgctctgaatgttgatgtgaatgagttccagaccaacttggtgccctacccaaggatccacttcatgctttcatcctatgcgccagtgatctctgctgagaaggcctaccatgagcagctgtcagtcgctgagatcactaacagtgccttcgagccatcctccatgatggccaagtgtgaccct

SEQ ID NO: 19440 - protein, 224 aa, Panicum virgatum
  misc_feature: Ceres CLONE 1805724
  misc_feature (1)..(164): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
YRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCD

SEQ ID NO: 19441 - DNA, 653 bp, Panicum virgatum
  misc_feature: Ceres CLONE 1805724-R
  misc_feature: Encodes the peptide sequence at SEQ ID NO. 19442
accctcgccatggcaagtacatggcctgctgcctcatgtaccgtggagatgttgtgcccaaggacgtgaatgctgctgtggccaccatcaagaccaagcgcaccatccagtttgtggactggtgcccgactgggttcaagtgcggcatcaactaccagcctcccagcgtggtgcctggcggtgatctggccaaggtgcagcgcgctgtgtgcatgatctccaactccaccagtgtggttgaggtgttctcccgcatcgaccacaagtttgacctcatgtacgccaagcgcgccttcgtgcactggtatgtgggtgagggcatggaggagggtgagttctcggaggcccgtgaggaccttgctgcgctggagaaggactatgaggaggttggtgctgagtttgacgatggtgaggagggtgacgagggcgatgagtactagacgacccttcctggtgcttctctgtcaggcctgcgtgctgctactatccagtgatctgcctgagtggctcgtactattgtgttatgttttgtctgtctgtttgaactttgagtcgttcatgtgtggtttacaacacctgatgttgtaagagtgtaagactcgaatgttggttttccttttcgctactgggtactatgaatgtttgttatgatc

SEQ ID NO: 19442 - protein, 145 aa, Panicum virgatum
  misc_feature: Ceres CLONE 1805724-R
  misc_feature (1)..(87): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
PRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDDGEEGDEGDEY

SEQ ID NO: 19443 - DNA, 1432 bp, Panicum virgatum
  misc_feature: Ceres CLONE 1805729
  misc_feature: Encodes the peptide sequence at SEQ ID NO. 19444
gcgtgcagccacaaatcctcgccgccgccggccctcggacccagccgacgagatgccgccttccagctccaccccccgcctcgcgctgcccgccatgacccggtcccaggcggaccccgacctcccgtccctcatctccgacctcacctccccgctcctccactcccccgccgcatcttccggcgccgccgcccccgtcttctcctcctcctccctctccatccccgcccccgccgccgcggcgcccaagccagcagtccccacccctctcgcgcgcgccgccatcggggcctgcgcgggcgccgccgcgggggccttcacctacgccgcgctgctccccatcgacgccgtcaagacccgcctccaggccgccgcggctccctccgccaccgcctggcaggtcttcctcgacatcctccgcaccgacgggcccctcggcctctaccgcggcctctccgccgtcatcctcggctccgcctcctcctccgccgtctacttcggcacctgcgagctcgccaagtcgctgctccgcccccacctcccgcccttcctcgtgcccccgcttgccggcgccagcggcaacatctcctcctccgccatcatggtccccaaggagctcatcacgcagcgcctccagtccggcgccgccacaggccgctcctgggaggtgctcctccacatcatccagacccacggcttcttcggcctgtacacgggatacgccgccacgctcctccgcaacctccccaccggggtgctcagctactcctccttcgagtacctcaaggcattcaccctcaagagtcgccacaaggagagcctcacgccaggggagagcgtgctctgcggtgctcttgcaggggctatatccgccgcactcaccactccgctggacgtcgtcaagacgcgcctcatgaccagggtcggaacggagggcagccgcaccgtgctggggacgatgagggaggtggtcgccgaggaggggctcatgggcctgtcccgtggcattgggcccagggtgctgcacagcgcgtgcttcgccgcgctaggctactgtgcctttgagaccgcaaggcttgccattctgcagtggtaccttgaaggttgccaaaggaaggctgcagcacagccacagatggagcctcgagttgctgctgctgctgctgccacttgaatttgtcgtctcttccttcattccttgagggaaggtaactgttgctggtcctcatgcctcagtatgctagtgctggcagtgtgtggttttgtttcagttaagtagatcaggtgtattgtatgctatcttgaggttgatgtacctattaaagtttctcggctttagcatcatcaagagttcattgtggactcgaatgacctcagaccataagagttatataataccaggaaatcaaccttttggttattctattgctcc

SEQ ID NO: 19444 - protein, 359 aa, Panicum virgatum
  misc_feature: Ceres CLONE 1805729
  misc_feature (61)..(149): Pfam Name: Mito_carr Pfam Description: Mitochondrial carrier protein
  misc_feature (244)..(334): Pfam Name: Mito_carr Pfam Description: Mitochondrial carrier protein
  misc_feature (151)..(238): Pfam Name: Mito_carr Pfam Description: Mitochondrial carrier protein
MTRSQADPDLPSLISDLTSPLLHSPAASSGAAAPVFSSSSLSIPAPAAAAPKPAVPTPLARAAIGACAGAAAGAFTYAALLPIDAVKTRLQAAAAPSATAWQVFLDILRTDGPLGLYRGLSAVILGSASSSAVYFGTCELAKSLLRPHLPPFLVPPLAGASGNISSSAIMVPKELITQRLQSGAATGRSWEVLLHIIQTHGFFGLYTGYAATLLRNLPTGVLSYSSFEYLKAFTLKSRHKESLTPGESVLCGALAGAISAALTTPLDVVKTRLMTRVGTEGSRTVLGTMREVVAEEGLMGLSRGIGPRVLHSACFAALGYCAFETARLAILQWYLEGCQRKAAAQPQMEPRVAAAAAAT

SEQ ID NO: 19445 - DNA, 1035 bp, Panicum virgatum
  misc_feature: Ceres CLONE 1805736
  misc_feature: Encodes the peptide sequence at SEQ ID NO. 19446
cccagttcgccacccgcggagccacgtcgctttaattagcgcccggcacccccaggcggccaggccctcgccttcctccgtcttcctcctctcgctctcatccactctcctcccccctcgccactgcggtgcggagcttcggcggctcggctcgagcagaagaaaatgcaacgggcagtgcaagccatcaggttgcatggcagtgtgcttaaatatgctgttcaacaacacatcagcgctcccaaaccagcaatgcttcctgctgccttttctcgcttcatgtcagcttcatctgctcgcctagaggacagtggatttgaaactgccactgtagctgatatcttgaagtctaaagggaagagtgctgatggatcttggctctggtgcaccacagaggacagtgtctatgatgctgtcaaatcgatgacgcaacacaatgtgggggctttggtggtggtcaaaccgggacaggaaaaatcaattgctggcattgtcacggagagagattatctccggaaaatcatagtgcaaggacgatcttccaagtcaactaaggttggagacatcatgactgaagagaacaaactgatcaccgtgaagcctggcaccaaggtcctgcaagcaatgcagctgatgacagagaaccgcatcagacacatcccggtggtcgaaggcacggggatgctggggatggtctccatcggcgacgtcgtccgtgcggtggtcagcgagcacaaggaggagctgaacaggctcaacgcctacatccagggaggctactaggacgacgcccctacctcccagcgatgtccgccttcgatatccaataactcgaccagtgatgatgacgaaataggccgtgtgttcgcggacaatgctgttgaattgcgcaaggtgtttttcccccgcttgttctgtgtgtatattgctgaaaggcgggcgtgacagtgcgcctggtgctggggcgcacagactatctgacggtggaaacaacggaaataaaaagcgtgccgccgccgtgtgcttcctttgcag

SEQ ID NO: 19446 - protein, 205 aa, Panicum virgatum
  misc_feature: Ceres CLONE 1805736
  misc_feature (65)..(187): Pfam Name: CBS Pfam Description: CBS domain pair
  misc_feature: SWISSPROT Homolog: EC 1.1.1.205 IMP dehydrogenase
MQRAVQAIRLHGSVLKYAVQQHISAPKPAMLPAAFSRFMSASSARLEDSGFETATVADILKSKGKSADGSWLWCTTEDSVYDAVKSMTQHNVGALVVVKPGQEKSIAGIVTERDYLRKIIVQGRSSKSTKVGDIMTEENKLITVKPGTKVLQAMQLMTENRIRHIPVVEGTGMLGMVSIGDVVRAVVSEHKEELNRLNAYIQGGY

SEQ ID NO: 19447 - DNA, 569 bp, Panicum virgatum
  misc_feature: Ceres CLONE 1805738
  misc_feature: Encodes the peptide sequence at SEQ ID NO. 19448
cttcatcgttcctcttcgtctgccgacacatcgacaggattgtttcccaggtgggtgtacggtgacacctgcgaaggacgctcccagcctattgaccactactgcttgatgagaccacaagatatccattaccataggcccgtcactgactgtcactcttgctcacatctagcatctgaaatggctgctgccctggctgccgcttccatagtgttcaacgacaacaagaactactccgacaaccttgtcgaaggtcccaaagccccgtccaaattctccaaggtgacgctcgggctatacaatgcgaatgcatcctaccagccaattttctacacttccaccaactactgggatgactttgtgtggggcggtgcttggatgtattttgccacgcgcaacaattcatatctcaccatcgccacacccccgggaatggcaaatcatgctggagactactgggttggcagtccaaactatggagtatttacctgggatgacaaacttccatgagcttcacgttcttctcagcaggttgctactcttcctaagtccagggtacccttacgaag

SEQ ID NO: 19448 - protein, 169 aa, Panicum virgatum
  misc_feature: Ceres CLONE 1805738
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
LHRSSSSADTSTGLFPRWVYGDTCEGRSQPIDHYCLMRPQDIHYHRPVTDCHSCSHLASEMAAALAAASIVFNDNKNYSDNLVEGPKAPSKFSKVTLGLYNANASYQPIFYTSTNYWDDFVWGGAWMYFATRNNSYLTIATPPGMANHAGDYWVGSPNYGVFTWDDKLP

SEQ ID NO: 19449 - DNA, 638 bp, Panicum virgatum
  misc_feature: Ceres CLONE 1805747-R
  misc_feature: Encodes the peptide sequence at SEQ ID NO. 19450
ttcatctcacgaataaaatttaaagaggatataataatctcgtcacctgatgtatctctggttgagcttggaccggatgtggaatttcttatactagcaactgatggtctttgggattacatgaaaagctctgaagctgtagcatttgtccgagatcaactacgtcaacatggtgatgtacagttggcctgtgaggcacttggtcagaaagctctggatgaacggtcacaagacaatattagcatagtcatagctgacttggggaggacaaactggaaggcgttgcccgtggaaaggccaaacttgttcttggaactaagtcaagcagttgtgactgtaggggttgtcgcagtaggaatttggttctcatcgctgcttacattacagtaggactagttctgttcagacgtgtacattacttattgaattacatcttccgctggtagctgcaatatgtatattcctataggtcgattaatatagtgtaatctgttgtataatggtgaacgggtgaagtactggtgaaggtgtatagttcatccggctgattacagctgagtgtggtttgagtccaatgcgagaatgaatgatatgtcctgtattccttttccgttgtgatattgagaaactgaaaactc

SEQ ID NO: 19450 - protein, 129 aa, Panicum virgatum
  misc_feature: Ceres CLONE 1805747-R
  misc_feature: SWISSPROT Homolog: EC 3.1.3.16 Phosphoprotein phosphatase
FISRIKFKEDIIISSPDVSLVELGPDVEFLILATDGLWDYMKSSEAVAFVRDQLRQHGDVQLACEALGQKALDERSQDNISIVIADLGRTNWKALPVERPNLFLELSQAVVTVGVVAVGIWFSSLLTLQ

SEQ ID NO: 19451 - DNA, 364 bp, Panicum virgatum
  misc_feature: Ceres CLONE 1805747
gatctgatctgaaataggccttgctgtgaccgccagtgggattcttccctgcctccggcctggcaacggcggcatggacggcggttacaatcggcgaatgacgacgaactacaccacggaggcccagggacgtcccccccccgggcgcctcctcggaggaagtcgtcactaccatgtccacccttttcttctccctcgccgggcgacgcaacagcaggggctgctccatgctgcccgctggcttccgcaagacccccttctgggctgcaggcggaggggaagacgctggccctccccctgctgataggggtggcgagcagcgcctaaatctcgtgtggagcacatgatccctgccgatgcgctc

SEQ ID NO: 19452 - DNA, 1442 bp, Panicum virgatum
  misc_feature: Ceres CLONE 1805748
  misc_feature: Encodes the peptide sequence at SEQ ID NO. 19453
aattggcacttggcagttgctgagcctgagcgcgctcgccttcgccctcgctgtcgccgtcgacgttgccggcggcgatggggaactcgcaggcttcaccggcgtccgcctccagctcccgcttcgtcgtggcctctagggccttctcgaagcaggagctggatagcctccgcgcgctattcacctccctcgcagcgcagtcgcagaccagcggccgcgccatctcacgcgctgtcttcctcgagtactacggggtgcggggggcgttaggcgagaggctgtttcagttggtgggtaaggagagtggcgggagcgatggagtcacgttggaggatttgatcatctccaaagcaacatatggaaggggaactcgagacgaagttgatgagttcatttatcaactatgtgacgttacaggagatggtgtcttaacaaggtctgatctggaagctgtcttggcctccattcatgaaactgtatttgcagaaaacaagggagttggggaaggttccaataacaaaacgtttgaagcattcctcaactctgcagtattttcgaaggatgctgaaggggtctcagagaaggctatgtcattatcagactttaggaactggtgcactctcttgccctcattgaggaaattccttggaaatttgttgatgccccctgattcaggcagaccagggtttgaagtaccactgcttcactatcctgaaaacatctccactgatttgctacttctaaataaagagtatgcttggcatattggaggtggtttttcccaacatgaggtgcaagaatggaagcttttatatcatagttctcttcatgggcaaagcttcaacactttcttaagcaaagtaacgaatggtgatgcacagactgttctaattgttaaagatacagaaggatcagtttatggtggatatgcatcacagccttgggaaaggcacagtgatttttatggtgacatgaagtcattcctcttcaaattataccctcaagcatcaattttccgccctacaggagcaaacaaaaatttgcaatggtgtgctataaacttcagctctgagaacatacctaatggtattggatttggagggcagccccatcattttgggctctttttatctgcaaatttcgatcaagggcactcatttacttgtagcacgtttaccagccctccattttccaagacaaacaggttcaggccagaggttattgaatgttggggcatacaaatgaggggtgcacaagatgaaaaaccggagcttgtcaaggggactgtccttgagagattcaaagaggatcgcaacatgctgaagttggttggtttagccaattcgagtgattaaggactgacagaggatcacattttgcaaactgttagtcttggagagcctgtacatcacatgtttataaaaacagtcaatctggagacc

SEQ ID NO: 19453 - protein, 425 aa, Panicum virgatum
  misc_feature: Ceres CLONE 1805748
  misc_feature (244)..(388): Pfam Name: TLD Pfam Description: TLD
MGNSQASPASASSSRFVVASRAFSKQELDSLRALFTSLAAQSQTSGRAISRAVFLEYYGVRGALGERLFQLVGKESGGSDGVTLEDLIISKATYGRGTRDEVDEFIYQLCDVTGDGVLTRSDLEAVLASIHETVFAENKGVGEGSNNKTFEAFLNSAVFSKDAEGVSEKAMSLSDFRNWCTLLPSLRKFLGNLLMPPDSGRPGFEVPLLHYPENISTDLLLLNKEYAWHIGGGFSQHEVQEWKLLYHSSLHGQSFNTFLSKVTNGDAQTVLIVKDTEGSVYGGYASQPWERHSDFYGDMKSFLFKLYPQASIFRPTGANKNLQWCAINFSSENIPNGIGFGGQPHHFGLFLSANFDQGHSFTCSTFTSPPFSKTNRFRPEVIECWGIQMRGAQDEKPELVKGTVLERFKEDRNMLKLVGLANSSD

SEQ ID NO: 19454 - DNA, 1178 bp, Panicum virgatum
  misc_feature: Ceres CLONE 1805754
  misc_feature: Encodes the peptide sequence at SEQ ID NO. 19455
atccccatcctgcgcagagcgccgcagcgggggagctacaccgcacgtgctcgccggcgccggctcgtgcgcgcttgcgttgcgcgccccgaaacttcggccggccggagcaccgcgcgacggcggccaactgctgccagtctgcaactctgaatacacacacgcgcacgcacatcctgcccgggggccggggccggggccggggccgcgcgtacaaatagcaccgtgccccccttccaataatccaacgcgcatccacaactccacaagaatctgtcggctgccctgcccaccacctccaccacctcaccagctagcaagctcattgacatcacccaaccacaagctagctcctcgctggtcctcctcggcgacgagcgagagaggtctcgcctcggctccccatggccgccgaacctgcggacgccgggagcagttcctccatggcggacgtgtacaagggcgagctcacgccgctgcagcggcacgtcgccttcttcgaccgcgacaaggacggcgtcatctacccctccgagacatacgaagggttccgcgcgatcggggccggcgtcccgctctccgccttcagcgccctcttcatcaacggcctccttggacccaagaccgtgctggagaacgagaaggctccagcgttcaagctccccatttacgtgaagaacatccaaaagggaaagcacgggagcgactcgggcgtgtacgatgccaacggaaggtttgttcctgaaaagtttgaggagatcttcaagaagcatgcccacactaggcctgatgctttgacaggcaaagagctgcaggagctgctaaaagcaaacagggagcctaaggacttcaaaggatggctgggtggtttcactgagtggaaggtgctctactccctctgcaaagacgaaaaagggttccttcacaaggacactgtcagggcagtctatgatggcagtctattcgaaaggttggagaaggagaggaagtctgaggagtctactaataagaaatgataagaacatcatatataaagctagcgtgcatgaatttgtaaattatattatggcgtgtgtggatcagtaattttttgtcctagtttgtcaattaatcttttatatatgtaataacaagagcctgtcctctcgtctaaatatattgaaagtattttgtggatc

SEQ ID NO: 19455 - protein, 203 aa, Panicum virgatum
  misc_feature: Ceres CLONE 1805754
  misc_feature (17)..(192): Pfam Name: Caleosin Pfam Description: Caleosin related protein
MAAEPADAGSSSSMADVYKGELTPLQRHVAFFDRDKDGVIYPSETYEGFRAIGAGVPLSAFSALFINGLLGPKTVLENEKAPAFKLPIYVKNIQKGKHGSDSGVYDANGRFVPEKFEEIFKKHAHTRPDALTGKELQELLKANREPKDFKGWLGGFTEWKVLYSLCKDEKGFLHKDTVRAVYDGSLFERLEKERKSEESTNKK

SEQ ID NO: 19456 - DNA, 1088 bp, Panicum virgatum
  misc_feature: Ceres CLONE 1805757
  misc_feature: Encodes the peptide sequence at SEQ ID NO. 19457
cccttcgttccctgggtacatagatagatagatctgaacatatcaaacaattttccgccgctcgctttcagccgaaaacaaccatggctgctgctgtcaagcagaagcaggccgcctccgtggcgctagtcttcctcctcgccgtgttggtcgcgccgcctccggccgccgtggtagcggcggacggcgacggcacgacgcacctgagcttcttcatgcacgacatcgtgtcgggcagcgacccgactagggtgcaggtgatcaagggccccgggtcggcagtgacggccccggcgctgggcatgtccttcggcgacacggccgtgatggacgacgcgctgacggagacctcgtcgccgggctcggcggcgctggggcggatgcagggcatctacatgctgtcgtcgcagtcgggcgcggcgctgatggtgtgcgccaacctggtgctgacctcgggcgaccacaacggcagcaccatcgccgtgctggggcgcgacgacacggccgccgacgtgcgggagctcgccgtcgtgggcggcaccggcaagtacaggatggccaacgggtacgtgctgtggaagacgaccagcatgaagggcgccgacgccaccacccagctcgacgtctacctcaccaccggcaacgccaccaccatcgacgccgcggcgcccgtctcgcccggtggcggcggcggcgggtcctgtgggtccaagtcgagctcgggtgctggcgcgaggagggccggcggtgggtgggtgagggcgtgcgccgtcgccatggtggttgcggtggttggatcgtcctggggttggtgagcagcggatggattgacaacggatgagtggtggacattgctttgcttgcgttgcgttagtgggtgagtgtgtggaaggaaagttgggtgagatgtccgtcagtgcagtgggggttggtcgaggagtgagatgcttgttgccacctgcctgcatgtgctttgcacgctgcggcatcatggcctgcctgcctagctcatttcttttcccctaccccaccccgatgcacgcatgtggattcttcttgctttctactgatcgatgaggcttgctttc

SEQ ID NO: 19457 - protein, 243 aa, Panicum virgatum
  misc_feature: Ceres CLONE 1805757
  misc_feature (13)..(185): Pfam Name: Dirigent Pfam Description: Dirigent-like protein
MAAAVKQKQAASVALVFLLAVLVAPPPAAVVAADGDGTTHLSFFMHDIVSGSDPTRVQVIKGPGSAVTAPALGMSFGDTAVMDDALTETSSPGSAALGRMQGIYMLSSQSGAALMVCANLVLTSGDHNGSTIAVLGRDDTAADVRELAVVGGTGKYRMANGYVLWKTTSMKGADATTQLDVYLTTGNATTIDAAAPVSPGGGGGGSCGSKSSSGAGARRAGGGWVRACAVAMVVAVVGSSWGW

SEQ ID NO: 19458 - DNA, 1701 bp, Panicum virgatum
  misc_feature: Ceres CLONE 1805759
  misc_feature: Encodes the peptide sequence at SEQ ID NO. 19459
accaccaccttgcgcctccccaaccccagccgctccggcgacggcgccgccgccgccgccgcctggcggtggaacctgccggaccatataattgagcaatagcatgctacttccttcattttcggtcaaaggctgatgcaaaagaaggaagcctaggtgaagttgaacagtgatctatgagtacagtgttacagctagatgatagtctgacattgatcatgtgactcgtttactatagtaatatgcccatggttctgtttttccatcaggcgtctactttactatggaatgcctaggtctttctttgcatctatatgcattttcaatactctacatgttataatttacaaggcaatccttttgtcccttccattatgttccgtatcattaaatttaaagatttatgttgtctattccatttgccagatgatttaaatctctattttttttagtagatgcatgacatagtacctacaaaagcttaatgcacggtggccttgtacccactcaagttaggaccagccacaggtcatagcgttttgtgctggcctgcaaggccttaatgtttgtcgtaagtttggtcctgactcctgaaccacgtaggttgtttaattttgtttcagctttccttggttgtctttgataataatactaagacacttgctttgcagataaaaaatatataaaaaagttatgtcttgataatgatatgatctccttttgcatggatagattgattgtgactccaattttttttccctgtgtatgattgatctaccttcctgttgtcatgctcaggtgaattgttgtttaagagtctgcgtcaatttataaattcgtgtccacgtacatctcacatgtcactttaatggtatgaaagggagaaaagggagaaatacagatagaggggagggggggggggggaggccactgaatgaggtagggcagaatgggattccaatctaaggttgccttaatggcccaagaattattcagctctgcgattgtgaggtggatttgctggaccatcaattcagccagcccaattcggtcttctacagctccacaggtatgagtgaatgatcatgtgaaacttttgcgtgccttaccaccaccgggtccacgagtaacatccctttaggaggaggggcaggacaggaggaggaaagatggctataaatatatatggtgcgtgatgaagaggtggggagcatcttgtgctgaaagcaaagcctggctggctggaaagaagtggggaagctgacgatgaagaggctgttgatcgtgcaaaggtgtgagccgattgtgcggttcagctgctgcagcgtgcgctacggggagtgccgtcggaaccatgcggcaagcacaggaggctacaccatcgacgggtgccgtgagtttatcgctgaaggggaggagggcactggcaccgctctcaagtgcgcggcctgtggttgccaccgcagcttccaccgcagggtgcaggtgtatgaggttgcatgggactacggatccgacacatcgtcgaccgagtagggatgtgctgcaagcttggagtcctgctgttctgcaatggcaaatgcccaacaattcgtccccttcccatgtgtctctgacgacaagctgcctggtgcttgtctaggacccttgtgattctttgtaacttggagctcaaatttatctacttattctttcactctg

SEQ ID NO: 19459 - protein, 89 aa, Panicum virgatum
  misc_feature: Ceres CLONE 1805759
  misc_feature (18)..(77): Pfam Name: ZF-HD_dimer Pfam Description: ZF-HD protein dimerisation region
  misc_feature: Functional homolog of the protein sequence given in SEQ ID NO 50410
  misc_feature: Useful for making plants with modulated low light sensitivity
  misc_feature: Functional homolog of the protein sequence given in SEQ ID NO 50409
  misc_feature: Useful for biocontainment applications
  misc_feature: Useful for making plants with modulated biomass
  misc_feature: Useful for making plants with modulated flowering time
  misc_feature: The sequence is a functional homolog of SEQ ID NO 64 in the 10/714,887 US patent application
  misc_feature: The sequence is a functional homolog of SEQ ID NO 64 in the 11/435,388 US patent application
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 106 in the 10/714,887 US patent application
  misc_feature: The sequence is a functional homolog of SEQ ID NO 106 in the 11/435,388 US patent application
  misc_feature: The sequence is a functional homolog of SEQ ID NO 62 in the 10/714,887 US patent application
  misc_feature: The sequence is a functional homolog of SEQ ID NO 62 in the 11/435,388 US patent application
  misc_feature: The sequence is a functional homolog of SEQ ID NO 624 in the 10/666,642 US patent application
  misc_feature: The sequence is a functional homolog of SEQ ID NO 104 in the 10/714,887 US patent application
  misc_feature: The sequence is a functional homolog of SEQ ID NO 104 in the 11/435,388 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 52 in the 10/714,887 US patent application
  misc_feature: The sequence is a functional homolog of SEQ ID NO 52 in the 11/435,388 US patent application
  misc_feature: The sequence is a functional homolog of SEQ ID NO 620 in the 10/666,642 US patent application
  misc_feature: The sequence is a functional homolog of SEQ ID NO 102 in the 10/714,887 US patent application
  misc_feature: The sequence is a functional homolog of SEQ ID NO 102 in the 11/435,388 US patent application
  misc_feature: The sequence is a functional homolog of SEQ ID NO 54 in the 10/714,887 US patent application
  misc_feature: The sequence is a functional homolog of SEQ ID NO 54 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: The sequence is a functional homolog of SEQ ID NO 1554 in the 10/666,642 US patent application
  misc_feature: The sequence is a functional homolog of SEQ ID NO 44 in the 10/714,887 US patent application
  misc_feature: The sequence is a functional homolog of SEQ ID NO 44 in the 11/435,388 US patent application
  misc_feature: The sequence is a functional homolog of SEQ ID NO 114 in the 10/714,887 US patent application
  misc_feature: The sequence is a functional homolog of SEQ ID NO 114 in the 11/435,388 US patent application
  misc_feature: The sequence is a functional homolog of SEQ ID NO 628 in the 10/666,642 US patent application
  misc_feature: The sequence is a functional homolog of SEQ ID NO 68 in the 10/714,887 US patent application
  misc_feature: The sequence is a functional homolog of SEQ ID NO 68 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 46 in the 10/714,887 US patent application
  misc_feature: The sequence is a functional homolog of SEQ ID NO 46 in the 11/435,388 US patent application
  misc_feature: The sequence is a functional homolog of SEQ ID NO 616 in the 10/666,642 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: The sequence is a functional homolog of SEQ ID NO 66 in the 10/714,887 US patent application
  misc_feature: The sequence is a functional homolog of SEQ ID NO 66 in the 11/435,388 US patent application
  misc_feature: The sequence is a functional homolog of SEQ ID NO 48 in the 10/714,887 US patent application
  misc_feature: The sequence is a functional homolog of SEQ ID NO 48 in the 11/435,388 US patent application
  misc_feature: The sequence is a functional homolog of SEQ ID NO 56 in the 10/714,887 US patent application
  misc_feature: The sequence is a functional homolog of SEQ ID NO 56 in the 11/435,388 US patent application
  misc_feature: The sequence is a functional homolog of SEQ ID NO 124 in the 10/714,887 US patent application
  misc_feature: The sequence is a functional homolog of SEQ ID NO 124 in the 11/435,388 US patent application
MKRLLIVQRCEPIVRFSCCSVRYGECRRNHAASTGGYTIDGCREFIAEGEEGTGTALKCAACGCHRSFHRRVQVYEVAWDYGSDTSSTE

SEQ ID NO: 19460 - DNA, 1134 bp, Panicum virgatum
  misc_feature: Ceres CLONE 1805761
  misc_feature: Encodes the peptide sequence at SEQ ID NO. 19461
tttcctcagtacaagtaccgtgatttctacattgcgggagagagctacgcaggtcactatgttccacagctgtcccagcttgtgtacaagaacaacatcggtgtagagaagcctgatatcaacttcaaaggattcatggtcggaaacggcgtgaccgacgaccgcatcgacactatcggcatgttcgagtactggtggcaccatggcctcatctccgacgagaccctagacagcgggctgaaggtttgcctggacaatagcaccttgaccaagccctcgccggagtgccagaaggtcatggacaaggtcgccgaggagcaaggcaacatcgacgtctacagcatctacacgccgccgtgcgataaggggaccccatacgcgcgcaggcgccaccgcacattgatgctgcctccgtacgacccgtgcacatccttctactcgaccaactacctgaacatccccgaggtgcagagggccatgcatgccaacgtcagcggcaacaagggcccatggattatgtgcaacttggccatatatgataactggacaacagacacaatcatttccatgctacccatctacaaggagctcattgcagctggcctcaaggtctgggtcttcagtggcgacaccgacactgcggtgccgctgagctcgaccaggcgctcccttgctgccctgggccttcctgttaagaccagctggtacccctggtacattgtcccaaccgaggttgctggctggagcatggagtatgaaggcctgaccttcgtcaccgtccgcggcgccgggcacgaggttccactgcaccgcccggagcaggcgctcgtcctgttccagcacttcctgcagggcgaaccgatgccggccgaggcgaaaaatggcagcgtcatcctccttcctagtgagaaggcggcctcctactgagcacggaagcacctgacgcttgtgcttgacgacgacacgactccactacgaataaaagctgctgttgatctggatgttgagaatgataaaagctggagtaccttgtttcttcaaaaagctatgaataatgtgtaaaccgttggcttggccatgggtctctgttgtttttctcctgaaaagccttatataaaattatgaataatgcgg

SEQ ID NO: 19461 - protein, 308 aa, Panicum virgatum
  misc_feature: Ceres CLONE 1805761
  misc_feature (1)..(285): Pfam Name: Peptidase_S10 Pfam Description: Serine carboxypeptidase
  misc_feature: SWISSPROT Homolog: EC 3.4.16.6 Carboxypeptidase D
FPQYKYRDFYIAGESYAGHYVPQLSQLVYKNNIGVEKPDINFKGFMVGNGVTDDRIDTIGMFEYWWHHGLISDETLDSGLKVCLDNSTLTKPSPECQKVMDKVAEEQGNIDVYSIYTPPCDKGTPYARRRHRTLMLPPYDPCTSFYSTNYLNIPEVQRAMHANVSGNKGPWIMCNLAIYDNWTTDTIISMLPIYKELIAAGLKVWVFSGDTDTAVPLSSTRRSLAALGLPVKTSWYPWYIVPTEVAGWSMEYEGLTFVTVRGAGHEVPLHRPEQALVLFQHFLQGEPMPAEAKNGSVILLPSEKAASY

SEQ ID NO: 19462 - DNA, 1200 bp, Panicum virgatum
  misc_feature: Ceres CLONE 1805765
  misc_feature: Encodes the peptide sequence at SEQ ID NO. 19463
agatcgatcgagcaccccaaacttgcacacaatcaccatcagttctagtagacaggacatgtaataattaagttcaaatcccctcggcgatcgagctcgagtgactcattccaatttccacaaacactgccgatccatctctgtaattgactccgatatttgtgcgcgcagatcgacatcgacgatgagctccgtggacgccaccggcggcgagaagaagacgtcgtggccggaggtggtgggcctgccggcggaggaggccaagaagatcatcctcaaggacatgcccgacgccgacgtcgtcgtcctgcccgccggctcgccggtgaccatggactggaggtccaaccgcgtccgcgtcttcgtcgacaccgtcgctcagaccccgacggtgggctgaatgataaacgtaccgcctgcatgctggatcaaagctgctagctagcgcctacacccttgatgttccttcctgattgcccttactggtttagcttttagctagtacactagaaaagggaagatctagagatcaaataattgaagctcatcaaatagtatggggaatggagctagctgctgtctagaataaaactgatggaatgcatgaataaacaatgtattactgcagtacttcacattatgtgtccgtattcagggggctaacaatgtatatattcttatgtttgcagagaagcgccttgggcttcaaccagcatgcactgctgcctgaagggcaaacaatctagttgtacagctaacagttgctaggtttgcgctcacgttttttctctactaaaaaccttataaaatggcccttttggcctttgccggaaataaatactgtatgtttgcgccgaagagtgtacattaatcctgtagctgaagaccccacgcagaatcaagggaggagtgatgcatgcaagtttgatgcctttgccggaaataaatactgtatgtttgctgtaaagcctaagccattggccctctggttgtatctgttgatatagtagtggcttcctgttgtttggcctttgttgtaacataagcagaggcgcactagccttcgtttacagttaagctgaattattagtaccagctttcctggactgtttggtatgtaatatgacttgtttcttgtgcaaatggagtctcatgtaatccaggtctaagatgtgaatgtttcatttctagttttgcttg

SEQ ID NO: 19463 - protein, 71 aa, Panicum virgatum
  misc_feature: Ceres CLONE 1805765
  misc_feature (12)..(71): Pfam Name: potato_inhibit Pfam Description: Potato inhibitor I family
MSSVDATGGEKKTSWPEVVGLPAEEAKKIILKDMPDADVVVLPAGSPVTMDWRSNRVRVFVDTVAQTPTVG

SEQ ID NO: 19464 - DNA, 1166 bp, Panicum virgatum
  misc_feature: Ceres CLONE 1805781
  misc_feature: Encodes the peptide sequence at SEQ ID NO. 19465
ttgcaatcgcctgccccctcctaccaccctcttccctcttaatgcagccaagcaacaaccccgggagggagctagcgagcgagaatctccgcgcgtgctagcagagggaacaagaaggcgaggaggtgaccagctgagcgaggtggctgctgcagcaatggcggctgacctggggttcgaggagaccgagctccggctgggcctgcccggcggcggcggatgcggagggggagatggcgaggggaccaggagcgcctccggccagaggggcttcgccgagaccatcgacctcaagctgaagctggagccggcggcggccgccgtcgtggaagatgagaaggaggtggtggatgccgccgaggaggccgcggcggccgacgagtccccggccgggaagatgaatcggtcgcccagccagagtgtcgtcgtcgccgcccccgctcaacccgaccccgccgagaatccgcgcgcccccgaggctcaggtggtctgatggccgccggtgcgctcgttctcgacgaacatcatgtccgtgcrgtccgagaagggcgccggcagcaaggacgccgacgccgacaagtcctcgccggcagccggcggcggcgccgcgttcgtgaaggtgagcctggacggcgcgccgtacctgcgcaaggtggacctcaagatgtacaagagctaccaggagctgtccaaggctctcgagaagatgttcagctccttcaccattggaagctgtgggtcccaagggatgaacggcatgaacgagagcaagctggtggatgtgttcaacggctccgagtacgtgccgacctacgaggacaagaacggtgactggatgctcgtcggcgacgttccgtgggagatgtttgtcgaatcgtgcaagcgccttcggatcatgaagggatcagaagccattggcctggcgcccagggccatggagaaatgcaagaacagaagctgaacacatggggccgccagatgcaagaaccaagtctagctctgcagctctgctcgtctctgtatcatactcgtccctgttctccaagcctgtacctcctgatcagggaagtcattttggtgtgtcaactgttctatcagttccagtgagtcagtcagccagccaggcaggcagtcagtcagtgttcaagtctcatcttgtcatatac

SEQ ID NO: 19465 - protein, 144 aa, Panicum virgatum
  misc_feature: Ceres CLONE 1805781
  misc_feature (1)..(136): Pfam Name: AUX_IAA Pfam Description: AUX/IAA family
  misc_feature: Functional homolog of the protein sequence given in SEQ ID NO 50147
  misc_feature: Useful for making plants with modulated nitrogen use efficiency
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Functional homolog of the protein sequence given in SEQ ID NO 50146
  misc_feature: Useful for making plants with altered terpenoid content
  misc_feature: Functional homolog of the protein sequence given in SEQ ID NO 50148
  misc_feature: Useful for making plants with altered alkaloid content
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 890 in the 10/412,699 US patent application
  misc_feature: The sequence is a functional homolog of SEQ ID NO 739 in the 10/374,780 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 636 in the 11/479,226 US patent application
  misc_feature: The sequence is a functional homolog of SEQ ID NO 648 in the 11/479,226 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 737 in the 10/374,780 US patent application
  misc_feature: The sequence is a functional homolog of SEQ ID NO 204 in the 10/225,066 US patent application
  misc_feature: The sequence is a functional homolog of SEQ ID NO 292 in the 10/412,699 US patent application
  misc_feature: The sequence is a functional homolog of SEQ ID NO 40 in the 10/225,068 US patent application
  misc_feature: The sequence is a functional homolog of SEQ ID NO 82 in the 10/374,780 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 667 in the 11/479,226 US patent application
  misc_feature (4)..(4): Xaa is any aa, unknown, or other
MSVXSEKGAGSKDADADKSSPAAGGGAAFVKVSLDGAPYLRKVDLKMYKSYQELSKALEKMFSSFTIGSCGSQGMNGMNESKLVDVFNGSEYVPTYEDKNGDWMLVGDVPWEMFVESCKRLRIMKGSEAIGLAPRAMEKCKNRS

SEQ ID NO: 19466 - DNA, 607 bp, Panicum virgatum
  misc_feature: Ceres CLONE 1805783-R
  misc_feature: Encodes the peptide sequence at SEQ ID NO. 19467
agaaatggagttatcttcgtggaggactgacgacgctcgatcgggactatggattgatcaacaatatccatcatgacattggaactcatgtcatccaccactttttcccccaaatcccgcattaccatctcattgaggcgactgaggcagcaaaaccagtgcttggcaagtactacaaagaaccaaagaagtcaggtcctctaccgttgcatctatttggggtgctgtcggaaagcttaaagcaagaccactatgttagcgatactggagaggtagtcttctaccaaactgacaagatgatgaacacctctgcacaaaattcagattgacatataaaccatagctagtagcatattcttcatttttctcagggggctgtgcctgaagacgtgaccagcctcctgggacctctgattggtgtgcccgagtccaatgatatgtcgattcaagaatgtaagttggcaaagtattgttcatgcagaaaagagggtaaatgtaattctttccaatgatggaagacggaggcgacctcctatgtaacaaaacaaacatgtgattctttggacaagaggtatatttcagtaaagagcggaaaaagagtttagct

SEQ ID NO: 19467 - protein, 108 aa, Panicum virgatum
  misc_feature: Ceres CLONE 1805783-R
  misc_feature: SWISSPROT Homolog: EC 1.14.99.33 Delta(12)-fatty acid dehydrogenase
  misc_feature: Functional homolog of the protein sequence given in SEQ ID NO 50738
  misc_feature: Useful for making plants with modulated heat sensitivity
KWSYLRGGLTTLDRDYGLINNIHHDIGTHVIHHFFPQIPHYHLIEATEAAKPVLGKYYKEPKKSGPLPLHLFGVLSESLKQDHYVSDTGEVVFYQTDKMMNTSAQNSD

SEQ ID NO: 19468 - DNA, 210 bp, Panicum virgatum
  misc_feature: Ceres CLONE 1805783
gacaacccctcgaagaacttcaaaggatccgatgacggaaacgtcgtgacctataactttaacaccctcgacggattgtttgagtactattggcaccacggccacatctctgactagacagtaaagagcggtttgaagatttgcatggacagcagcaacttcaccgtgaactcgacggaaggtcataagatcatagacaaggccaccgag

SEQ ID NO: 19469 - DNA, 1667 bp, Panicum virgatum
  misc_feature: Ceres CLONE 1805784
  misc_feature: Encodes the peptide sequence at SEQ ID NO. 19470
ggtttcctctctgcacagcttatcccccgtccgcttctcaaaaaaaaaaaaaagcttatcccccgtccgctccaggtctccaccctgccactcgaactgctcctcgtcctcgacgccgggcgcgccgcgcggggggatcatggcctgaagtgaaatcccgcaccgcgacgctgcgagggtgacaaggataactttctcagaccagggaaggaagacatctccttgacgcggtagagcttttgatggttgctataagtattcaggggtgagttaggacaggaagatactgctgaagcgaaacagagagtgtcaagagagtttgtttcaagatggatgaagaccagggagttaggtattggtgccacatgtgtgaggaggtgatcgatcctatgccggaaatgaagtgtcctagctgtgagggtgggtttgtggaagagatggactctgaaggctttgaaccagctacaaacacaaggtctgatcgctccctctccgttttggctccactgctttttggtatgctggggggttcctcgcgcagatcaagactcaggagggaggccatggaggatgctgatgctgatgaggatgatgaagaggatgattcagaccgtgagtttgaactattcagtaggaggcgaaggaggatgccctcgtcagcacttgccaggctgattcaaactatgcgtgatgacatgaggggcttggatgacactgacagtgatacagagagagatatggagagagaaagaagggagaggcagagggcagagaggcaggctgtcgagaggagggtggagaggcagagggagaggctgagcaatcgtgggagagagaggacagaaagcctaatactgatcaactctaacaatgaggccatcattctccaaggaacgtttggacgcgatgacaaccaagaggaatcaagcaacacaagttctggtgtatcagctgcggattactttcttggtcctggcttagatattctgttgcagcgtttggcagagagtgatctcaatcgttctggcacaccacctgccaagaaggaggcggtagctgcattgccaactgtgaacatcaaggaagtgttgggttgttcagtctgtcttgaggattttgagatgggagcagaagcaaagcagatgccctgtcagcataaattccactgtcagtgcatccttccatggctggagcttcacagttcttgcccaatttgtcgatttcagttgcctactgaggagacgaagaacccatgtgaatcagccagcagtgccggggccatgaacggtgatggagacaatgttgctgcaagcagtagtgatacagaaattactaaccgtaatggagataaccattcagatagtcctatcttctctgctttgagcgcactcttctctgatccatcctcgtcatctgatgatgaaagtgctccacactcttctgagacctgaagacaccgccggatgcaggcttgcagtatggtgaaggtgatctgaaatgtgagactggcatctttatattgtagtttctgtacatatctctgaattggcaccccccagaagacaagatattctattctcttttctgaaaactatgtggcttgtagtgtgctagtgcttgctatgtttacttatcttaaataaaagttagcctctagtgtgcgtacc

SEQ ID NO: 19470 - protein, 373 aa, Panicum virgatum
  misc_feature: Ceres CLONE 1805784
  misc_feature (256)..(296): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MDEDQGVRYWCHMCEEVIDPMPEMKCPSCEGGFVEEMDSEGFEPATNTRSDRSLSVLAPLLFGMLGGSSRRSRLRREAMEDADADEDDEEDDSDREFELFSRRRRRMPSSALARLIQTMRDDMRGLDDTDSDTERDMERERRERQRAERQAVERRVERQRERLSNRGRERTESLILINSNNEAIILQGTFGRDDNQEESSNTSSGVSAADYFLGPGLDILLQRLAESDLNRSGTPPAKKEAVAALPTVNIKEVLGCSVCLEDFEMGAEAKQMPCQHKFHCQCILPWLELHSSCPICRFQLPTEETKNPCESASSAGAMNGDGDNVAASSSDTEITNRNGDNHSDSPIFSALSALFSDPSSSSDDESAPHSSET

SEQ ID NO: 19471 - DNA, 1446 bp, Panicum virgatum
  misc_feature: Ceres CLONE 1805787
  misc_feature: Encodes the peptide sequence at SEQ ID NO. 19472
gtcctcctcttctccctcgctgccggtcaattcatcgtcgtctccgccatttccctccctcccacctgcctgcctgcctataagaagaggaggagacaacgaccgctaggaaaaaggcgatcgagaggggagggagcaatcggagtccgagatggaggccagcaacgggcagatccaccagccgacggaggagaagctcatcatcgacacggatcccggcatcgatgacagcatagcaattatgatggcatttcagtcgccaggcgtgcaagtgctagggctcaccaccattttcggcaattgcacaacggagcacgccacacgcaatgccttgatcctgtgcgagaaggcaggccatcctgaggttccagtagcagagggcagccatgagcctctaaagggaggaaagccgtgtgttgccgactttgttcacggatctgacggccttggggagatagagcttcctgatcccactatcaagaaagttgaccaaagcgctgctgaatccttggttgataaggtcttacagtttcctggagaggtctccgtactcgccttgggccctctgacgaacgtagcattggctatcaagaaggatccctcctttgtgaaaaacgttaaaaagattgttgtgctgggtggggccttctttgcagctggaaatgccaccccttctgctgaagcaaatatccacagtgacccggaggcagcggatatagttttcacttctggggctgaaatctacgtggttggcctcaacatcacaacgcaagtcagcttcacagacaaggatctcctggagctgaggaactcgaaagggaagcacgcgcagttcctatgcgacgtgtgcaagttctacctggactggcacatcaagtcttacggcgcccctgtaattttcctccatgaccccgtgagcttcgcggcgctggttcgcccggacctgttcacgttcaggaagggcgtggtgagggtggagacccagggcatctgcgccgggcatacctccatggacttgttgctgaagaagtggaattcggagaacccgtggactggccactcgccgatctcggtcgcgtggacggtcgacgtgcccaagatggtcgcgtttgtgaaggagctcgtcaccagagagtgacgaaaccagctggcttaacatgagttgtttgtatacagtgacaatccgagcattgcgcagtccgcgccgcggtgcgcaccaaatttgagatgcatcaacatttgacgtactgcaaaggctattataatagtcagaatcatcggttccatacctctggacccagaatcaatttgggagggagtcgaggtctttacatcaacttgatgtaacgatcttgagatcataaagcttccttcatcggaagaaaaaaaaaacaatttcagaaaaaaaatcaacatggttgaacgtctgttggagtgttgtttttc

SEQ ID NO: 19472 - protein, 328 aa, Panicum virgatum
  misc_feature: Ceres CLONE 1805787
  misc_feature (13)..(325): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MEASNGQIHQPTEEKLIIDTDPGIDDSIAIMMAFQSPGVQVLGLTTIFGNCTTEHATRNALILCEKAGHPEVPVAEGSHEPLKGGKPCVADFVHGSDGLGEIELPDPTIKKVDQSAAESLVDKVLQFPGEVSVLALGPLTNVALAIKKDPSFVKNVKKIVVLGGAFFAAGNATPSAEANIHSDPEAADIVFTSGAEIYVVGLNITTQVSFTDKDLLELRNSKGKHAQFLCDVCKFYLDWHIKSYGAPVIFLHDPVSFAALVRPDLFTFRKGVVRVETQGICAGHTSMDLLLKKWNSENPWTGHSPISVAWTVDVPKMVAFVKELVTRE

SEQ ID NO: 19473 - DNA, 1157 bp, Panicum virgatum
  misc_feature: Ceres CLONE 1805790
  misc_feature: Encodes the peptide sequence at SEQ ID NO. 19474
accgcatctcacaccccctgagctcagctccaagcacagtcgtctcctcctcctgtggtcagagcgagcgagaggccagaggccgtgaaaatgccgatcaccaggatcgccgtcgggagccaccaggaggtgtaccacccgggtgccctcaaggcggcgctcgctgagttcatctccaccctcatcttcgtcttcgccggccagggctccggcatggccttcagcaagctgtccgccggcggcgctacgacccccgctggcctgatctcggcggcggtggcgcacgccttcgccctgttcgtggccgtttccgtcggcgccaacatctccggcggccacgtgaacccggccgttaccttcggcgccttcgtcggcggcaacatcaccctgttccgcggcctcctgtactggatcgcccagctcctgggctccaccgtggcgtgcttcctcctccgcttctccaccggcggcctcgccaccggcaccttcggcctgaccggcatctccgtgtgggaggccctggtcctcgagatcgtgatgaccttcgggctggtgtacacggtgtacgcgaccgccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgggtcggccccctcattggcggcggcctcgccggcgtcatctacgaggtgctcttcatctcccacacccacgagcagctccccaccaccgactactgagctgagggctgaggcttcggtcgccgccgccgacgttcgcgcgcagccgccggttcctccgtccgtttgatcagttcggcaccgccgccgtttaagttagttttccctcgcaccgcgtgttgcttgcatcgaccaccgccatgcttagcgtaccatgaacccgaactctccgccgccgctgcgccgctcgccatggtttgcttcgatcagtcgcatcaagttggaaactgtaaccgccaccgtgaattccggaccccgtttgcatgcttctgtaaaatttgtgaatttgcccgcgagtactctatttgccatcc

SEQ ID NO: 19474 - protein, 250 aa, Panicum virgatum
  misc_feature: Ceres CLONE 1805790
  misc_feature (13)..(233): Pfam Name: MIP Pfam Description: Major intrinsic protein
MPITRIAVGSHQEVYHPGALKAALAEFISTLIFVFAGQGSGMAFSKLSAGGATTPAGLISAAVAHAFALFVAVSVGANISGGHVNPAVTFGAFVGGNITLFRGLLYWIAQLLGSTVACFLLRFSTGGLATGTFGLTGISVWEALVLEIVMTFGLVYTVYATAVDPKKGSLGTIAPIAIGFIVGANILVGGAFDGASMNPAVSFGPALVSWSWTHQWVYWVGPLIGGGLAGVIYEVLFISHTHEQLPTTDY

SEQ ID NO: 19475 - DNA, 1191 bp, Panicum virgatum
  misc_feature: Ceres CLONE 1805799
  misc_feature: Encodes the peptide sequence at SEQ ID NO. 19476
acacctcgagcgcgacatccactctgacttccactctcctccccctcacccccatctttcttgctctcgccgcgacgacgcgcacccgcaccggattcgggcgacgccggcggcaggctccgatctagagacgatgtcagccgcgggctcctcgccgtccgcctcctcctccaccaagcggttggaagggaagtccgccctcgtcaccggtggtgccaccggtattggtgaagccatcgttcgcctcttcagagagcatggcgcgaaggtcggcatcgcggacgtccaggacgaagccggccagcggctgcgcgacgccctcggagaccaggacgtcatgttcgtccactgcgacgtcacggtcgaggaggacgtgagggccgccgtcgacgcggcggccgcgcggttcggcgcgctggacatcatggtgaacaacgccggcatcacgggcaacaaggtcaccgacatccgcaacgtggacttcgccgaggtgcgcaaggtgttcgacatcaacgtgcacggcgtgttcctcgggatgaagcacgcggcgcgcatcatgatcccccagaagcgcggctccatcgtgtcgctggcgagcgtggccagcgtcatcggcgggatgggcccgcacgcgtacaccggctccaagcacgccgtggtcgggctcaccaagagcgtcgccggggagctcgggcgccacggggtgcgcgtcaactgcgtgtcgccctacgccgtgcccacggcgctgtccatgccgcacctgccccagggcgcgcgcgccgacgactccctcaaggacttcctggccttcgtcggcggcgaggccaacctcaagggtgtcgacgtgatgcccagggatgtggccgaggcggtgctctacctggcaagcgacgaggcgaggtacgtcagcgcgctcaacctcatggtggacggcggcttacagccgtgaaccataacctgaaagcgttcgaggattagctcaagctgttggcagcatttgccagctctggtagtgttgtccctgctgttctgctgcaattcagagatgtggcatgtgctaatatatgtagcagattcgactgtgctgtattcatgtgtctgcaagactaatgtgccagtatatgaatgtctcgcaactgattggatattcattgggagtgtgcggaaagaatgtatttccagcagtacttg

SEQ ID NO: 19476 - protein, 271 aa, Panicum virgatum
  misc_feature: Ceres CLONE 1805799
  misc_feature (20)..(187): Pfam Name: adh_short Pfam Description: short chain dehydrogenase
  misc_feature: SWISSPROT Homolog: EC 1.1.1.288 Xanthoxin dehydrogenase
  misc_feature: Functional homolog of the protein sequence given in SEQ ID NO 50862
  misc_feature: Useful for making plants with modulated salt sensitivity
  misc_feature: Functional homolog of the protein sequence given in SEQ ID NO 50863
  misc_feature: Useful for making plants with modulated drought sensitivity
  misc_feature: Useful for making plants with modulated water use efficiency
MSAAGSSPSASSSTKRLEGKSALVTGGATGIGEAIVRLFREHGAKVGIADVQDEAGQRLRDALGDQDVMFVHCDVTVEEDVRAAVDAAAARFGALDIMVNNAGITGNKVTDIRNVDFAEVRKVFDINVHGVFLGMKHAARIMIPQKRGSIVSLASVASVIGGMGPHAYTGSKHAVVGLTKSVAGELGRHGVRVNCVSPYAVPTALSMPHLPQGARADDSLKDFLAFVGGEANLKGVDVMPRDVAEAVLYLASDEARYVSALNLMVDGGLQP

SEQ ID NO: 19477 - DNA, 605 bp, Panicum virgatum
  misc_feature: Ceres CLONE 1805807-R
  misc_feature: Encodes the peptide sequence at SEQ ID NO. 19478
agagcagcggctacggccttgtcgccaactccgtcgagcgctcccgggccaagggcggcccgcgcggcaatgagacgccgacgaggggctcggcggtgcccaagttcggcgactgggactcgaacccggcgtcggcggacggctacacgcacatcttcaacaaggtgagggaggagaagcagacccaggccgggaagcagggggcgctcgacaaggacgccgcgcgtggcaccggcgccaagcagcacgacgacggctacgtctcatcgaagttctcatgctttggatggtgcaagtagagatgtgctaatgaatggtgatggatacagatgctggttcctttggggactccaaatttggagagaggggaggtcgtgattcagcagcctaggctccattcacatttctgggccatcaaacactctccacaatcttcttgcaatagcttcacttttttgaggtgatagatagagctgttcatggttactgttatgctagagtaagcattgaattgttgtgtttgttcttcagtattgaatttgcagtatgtgtaccacaggtttgaactcactctgaattgaatgtacgatattggtgtgtgggtt

SEQ ID NO: 19478 - protein, 98 aa, Panicum virgatum
  misc_feature: Ceres CLONE 1805807-R
  misc_feature (23)..(95): Pfam Name: NOI Pfam Description: Nitrate-induced NOI protein
SSGYGLVANSVERSRAKGGPRGNETPTRGSAVPKFGDWDSNPASADGYTHIFNKVREEKQTQAGKQGALDKDAARGTGAKQHDDGYVSSKFSCFGWCK

SEQ ID NO: 19479 - DNA, 122 bp, Panicum virgatum
  misc_feature: Ceres CLONE 1805807
atagtcctgccggccggcctcactagggtcgatcaccatgcaagctaatatgaatcgagaggagcatcctatcccgccccttcttgcgcagctgcaggtgcatgctggtcaccgccttcaga

SEQ ID NO: 19480 - DNA, 1065 bp, Panicum virgatum
  misc_feature: Ceres CLONE 1805810
  misc_feature: Encodes the peptide sequence at SEQ ID NO. 19481
gaccggcctgccttgctttccccgagcacgcgtcgcgcgtgcatcacatcacaccgaccatctggtcccgagcccagcgacgacgacgagaacggacaaactgcggcggaccgacccggaagcaggccagggcccgatcctcccctctccccgccggtcgccgccctcgtccccgggcgcggtagccccgtcgacgccggcgggcagcgtgagatatgggttgctcctcctccgtgccagctagaagtacaggagggctgaacactgtcaacaacgatacctcttctgccactgattcaaaggacttgcgtgctaagttggtattgctgggagattcaggtgttggcaaaagctgcattgttcttcgctttgttcgtggtcagttcgatcctacttccaaggtaactgttggtgcatcctttttgtcacaaacattggcattggaagactcaacaatagtgaaatttgaaatttgggatactgctggccaagagaggtatgctgccttggcaccactttactacagaggagctgctgctgcaattgttgtttatgatataactagtccagaatcatttaacaaagcacagtactgggtaaaggaacttcagaagcatggtagtcctggtattgtaatggttttggttggcaataaggctgacctacatgagaatcgaagtgtatcttcacaggatgcacaggagtacacagagaagaacaatatgttttttattgagacgtcagcaaagacagctgataatataaaccaactgtttgaggaaattgctaagaggttgcctaggccaacgacgtcctgacaaaaacccatgtgtattgaagagctacacaaatacaagtttgtaccatgtactgcatgtccgcccatatgtatgggtactgtgtggaagactgacgttcatgtaaagcttattccattctgttaattgtggagactctttggtattgaatatctattgtctgatgttgcaacaactggtaatctgattgtttcttgtgttttccttttcctttttttaagggcaattgaattacgaagtggttgtg

SEQ ID NO: 19481 - protein, 200 aa, Panicum virgatum
  misc_feature: Ceres CLONE 1805810
  misc_feature (34)..(196): Pfam Name: Ras Pfam Description: Ras family
  misc_feature (34)..(149): Pfam Name: Miro Pfam Description: Miro-like protein
MGCSSSVPARSTGGLNTVNNDTSSATDSKDLRAKLVLLGDSGVGKSCIVLRFVRGQFDPTSKVTVGASFLSQTLALEDSTIVKFEIWDTAGQERYAALAPLYYRGAAAAIVVYDITSPESFNKAQYWVKELQKHGSPGIVMVLVGNKADLHENRSVSSQDAQEYTEKNNMFFIETSAKTADNINQLFEEIAKRLPRPTTS

SEQ ID NO: 19482 - DNA, 1070 bp, Panicum virgatum
  misc_feature: Ceres CLONE 1805816
  misc_feature: Encodes the peptide sequence at SEQ ID NO. 19483
atctcaagccagctgcaagtctcactcctaatcctaaaccacaagacacctcagtgttagtagtgcaatggcgaccagcaccatggccctctcctctacggccttcgccggcaaggccgtcaacgtgccatcgtctctcttcggcgaggcccgcgtgaccatgcgcaagaccgcggcgaagcccaagccggccgcctccggcagcccgtggtacggcccagaccgcgtgctctacctcggcccgctctccggcgagcccccgagctacctgaccggcgagttccctggcgactacggctgggacaccgccgggctctcggccgaccccgagaccttcgccaagaaccgggagctggaggtcatccactcccgctgggccatgctcggcgcgctcggctgcgtcttccccgagctgctcgcccgcaacggcgtcaagttcggcgaggccgtctggttcaaggcgggttcccagatcttcagcgagggcgggcttgactacctcggcaacccaagcctgatccacgcgcagagcatcctcgccatctgggcctgccaggtcgtgctcatgggcgccgtcgaggggtaccgcatcgccggcggcccgctcggcgaggtcgtcgacccgctctaccccggcggcagcttcgacccgctcggcctcgcsgrygaccccgaggccttcgcsgagmtcaaggtmaaggagctcaagagcggcctcctcaccctcttaggcatgttcgggttattagttcaggccatagtcacgggcaagggcccacttgagaacctagcaggccatcttctcgacccggtaaacaacaaagcaaggacatatgccaccaagttaattcccggcaagggaggtgtccgatcccgaactgtggggatagggggggggtcaaagaaaagagagcgcatcggtttcagtgtgtgcgcatgatgtaaattagtggggtccatccaaccgagatctgatttttttttttcattgtgtgaactcagagccaatgcaacgagatgctggttcttcctttcagccatccgcaacgactaaacgagaagttggtagc

SEQ ID NO: 19483 - protein, 285 aa, Panicum virgatum
  misc_feature: Ceres CLONE 1805816
  misc_feature (58)..(226): Pfam Name: Chloroa_b-bind Pfam Description: Chlorophyll A-B binding protein
  misc_feature (195)..(195): Xaa is any aa, unknown, or other
  misc_feature (203)..(203): Xaa is any aa, unknown, or other
MALSSTAFAGKAVNVPSSLFGEARVTMRKTAAKPKPAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLAXDPEAFAEXKVKELKSGLLTLLGMFGLLVQAIVTGKGPLENLAGHLLDPVNNKARTYATKLIPGKGGVRSRTVGIGGGSKKRERIGFSVCA

SEQ ID NO: 19484 - DNA, 1143 bp, Panicum virgatum
  misc_feature: Ceres CLONE 1805818
  misc_feature: Encodes the peptide sequence at SEQ ID NO. 19485
aaaaaaaaagctcttcaacccaacccgcaagcaaactctcgctcgcatccccccgcaccagcaagagagagagacgaggagtcgacgagcccagaccctgagctccagcgcgcgccgccgccacagccgccggcgatggatccgaagctgacggaggtggcccaggtgttcgcccgcttcaaggcggcgtatgcccgcaacgacctcgacgcctgcgtcaccctcctctcgcagctcaaggtccagctcaccaaattccccagccttcctccgttgtttcagcagacgcccaacgctgtggaggagctcaaacttgcacgggacatttatgagcatgcggttgttttgagcgtgaaacttgaggaccaagatgcttttgaacgcgatttctgccagctcaagccttattacatggatacatgtggcataattcctccctcaccagaggagtacccaattttgggactcaatcttctgaggttgttggtccagaatagaattgcagagttccacactgagctggagcttctgcctgtcaaggcacttgagcatccttgcatcaagcatgccatcgagcttgagcaatcctttatggagggtgcctacaaccgagtgttgagcgctcggcaggctgtgccgcacgagacctatgtttacttcatggaccttcttgccaaaacagttagagatgagatcgctgggtgcagcgagaaggggtatgattccctatccataagtgatgccaaacaaatgctgatgttcagctcggaccaagaattgcaccagtacatcacagaggagcacccggaatgggagattaagaacggctccgtcttcttccagaaggccaaggagtcgcagccctgcaaggagatcccatccttgcagctaatcaaccagacgctcagctatgctagggagctggagcgcattgtatgatttagttccacaataatttcgatgaatgttttttcccctctggtcacttggcatggcctgtactgtcattacgtttcatcacagcccttgtgtctgaaaaatttcatcatgtgaacctctggagctgtatctgcccgaccgatattaaattgttagctccatttgtgtttcaccatggtcacttgaaaaaagttaaattcatag

SEQ ID NO: 19485 - protein, 267 aa, Panicum virgatum
  misc_feature: Ceres CLONE 1805818
  misc_feature (24)..(209): Pfam Name: SAC3_GANP Pfam Description: SAC3/GANP/Nin1/mts3/eIF-3 p25 family
MDPKLTEVAQVFARFKAAYARNDLDACVTLLSQLKVQLTKFPSLPPLFQQTPNAVEELKLARDIYEHAVVLSVKLEDQDAFERDFCQLKPYYMDTCGIIPPSPEEYPILGLNLLRLLVQNRIAEFHTELELLPVKALEHPCIKHAIELEQSFMEGAYNRVLSARQAVPHETYVYFMDLLAKTVRDEIAGCSEKGYDSLSISDAKQMLMFSSDQELHQYITEEHPEWEIKNGSVFFQKAKESQPCKEIPSLQLINQTLSYARELERIV

SEQ ID NO: 19486 - DNA, 540 bp, Panicum virgatum
  misc_feature: Ceres CLONE 1805827-R
  misc_feature: Encodes the peptide sequence at SEQ ID NO. 19487
gcctggtggcaagctcattctaaatggccatacccaactgaggaagacaaggctagactggtacaggaaacagggctgcaactaaagcagatcaacaactggttcatcaaccagcgtaagcggaactggcacagcaatccggcatcatcctcatctgacaaaagcaagagaaaaaggtgatggaaatgctgagcaatcctggtagagcgtggttggagaagaattatatgtaaataacgcgtctactgagaagaatggcaccatatttgttgcgtgggaaacaaccattcgagtgggcgtttcctgagccccatattcatacagagatatcacacgatgtaataatgttgtaagtagtcacgtaaaactaaataatttgtatagcgaatcactagagactagcattcatgtttggtattgtataattttaattgattgagcgtactgtctctgtataaccctatggttcaaatgtatttgactagcactcgatattgtattttgtgtaagtattgtcatgtaaaccgtggttacaagttt

SEQ ID NO: 19487 - protein, 59 aa, Panicum virgatum
  misc_feature: Ceres CLONE 1805827-R
  misc_feature: The sequence is a functional homolog of SEQ ID NO 710 in the 10/374,780 US patent application
  misc_feature: The sequence is a functional homolog of SEQ ID NO 711 in the 10/374,780 US patent application
  misc_feature: Functional homolog of the protein sequence given in SEQ ID NO 50864
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time
  misc_feature: The sequence is a functional homolog of SEQ ID NO 713 in the 10/374,780 US patent application
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 712 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: The sequence is a functional homolog of SEQ ID NO 709 in the 10/374,780 US patent application
  misc_feature: Functional homolog of the protein sequence given in SEQ ID NO 50865
  misc_feature: Useful for making plants with altered carbohydrate content
  misc_feature: Functional homolog of the protein sequence given in SEQ ID NO 50866
  misc_feature: Useful for biocontainment applications
  misc_feature: Useful for making plants with modulated biomass
  misc_feature: Functional homolog of the protein sequence given in SEQ ID NO 50508
  misc_feature: Useful for making plants with modulated light quality response
  misc_feature: Useful for making plants with modulated light quality sensitivity
AWWQAHSKWPYPTEEDKARLVQETGLQLKQINNWFINQRKRNWHSNPASSSSDKSKRKR

SEQ ID NO: 19488 - DNA, 264 bp, Panicum virgatum
  misc_feature: Ceres CLONE 1805827
aaagcctccgccacttgactcctctccccgtctccgtcccgtggtcctcctccccctccccttccccctcgagctcgcgtcgcctcgaccagcctccgcagcccgcgccggcaggtggctggatctctcggggatagccgggagccgggctgcgggggatggcgttccactacccggaccacgcgcgggggatggacccccctgccgcgggcggggtccgggtcggggggcaggccaaccctagcttcgtgcccgccacaacgc

SEQ ID NO: 19489 - DNA, 1170 bp, Panicum virgatum
  misc_feature: Ceres CLONE 1805850
  misc_feature: Encodes the peptide sequence at SEQ ID NO. 19490
aacccgcaccgccgcgcggccggaagtcaccaaatcgcgtcggctagaccatcgcgcggccactcctccacccaccgccggcgccgcgccagcctgcagccaccgcctgccggaccccccgctctccgcgcacgcacgccgcatggccgcctcgtacttcaaccactcctcctacccgccggcgccgcctccgccgccggggacctcctcgtacggcgcgtaccgcagcgcctacccgccggcgccggcgccctccaccgcttacggcgcctactacgaccgcgcggagcaagccctcccggcacgggacgagctccgcaccctcttcatcgctggcctccccgccgacgccaagccgcgcgaggtctacaacctcttccgcgacttccctggatacgtctcttcccatctccgcactggcaaatcctcccaggcatatgcatttgctgtatttgctgatcaaccatctgccttagctgccttaactgcgacaaatggaatggtgtttgaccttgagaagaattgttctctacatgtggatctcgcaaaatccaattctagatcaaagcgcttgagatcagatgatgcttcaccttattctcctgagaaaagaactaaaaggccaatgggatttcctgattcagttacacaagctttgagtctagtacttttgtcaggaagttgtgcgggatttgtgaagctgaagatgcaaaacaagcttggagctccagttgcatttgttgatttcaaggatgcgaacagctcaactgaagccctaaatcgtctccaaggagttgtcctgtattcatcacctggcgagggaatacgcttagaatatgccaaatcccggatgggccttcgtaagcgtgataagcgcccctagtgcagctgaaagataagggatttgaacaactatcaacgttgttcactcatgactggttctgacaccgaacccgctgacatagtcatgcaggaaatgtattggccatgttttagatgcatgacatgatgtaactgggtttggttgtatcacttagtattgtcagtgcacatcccccctccctcccctatcatgtcaccggccctcttcagattttaagctagtagtgttgttatgaattgataacacatttactctttaacatggttatgagaaatcagtcttgcagc

SEQ ID NO: 19490 - protein, 246 aa, Panicum virgatum
  misc_feature: Ceres CLONE 1805850
  misc_feature (61)..(132): Pfam Name: RRM_1 Pfam Description: RNA recognition motif. (a.k.a. RRM, RBD, or RNP domain)
MAASYFNHSSYPPAPPPPPGTSSYGAYRSAYPPAPAPSTAYGAYYDRAEQALPARDELRTLFIAGLPADAKPREVYNLFRDFPGYVSSHLRTGKSSQAYAFAVFADQPSALAALTATNGMVFDLEKNCSLHVDLAKSNSRSKRLRSDDASPYSPEKRTKRPMGFPDSVTQALSLVLLSGSCAGFVKLKMQNKLGAPVAFVDFKDANSSTEALNRLQGVVLYSSPGEGIRLEYAKSRMGLRKRDKRP

SEQ ID NO: 19491 - DNA, 1229 bp, Panicum virgatum
  misc_feature: Ceres CLONE 1805858
  misc_feature: Encodes the peptide sequence at SEQ ID NO. 19492
atgcacaagcgcgcctcctactcgtcaacaagatcctcccccggccgcttctcatccagcttccagtagtcggtcgcctccgccgcgagtacgactagcagtggttctgaacgattgacggggtagcgactcttgcggcggcggcggccatggacccgtggatcggcgggcagccttccctgagcctggacctcaacgtcggcctgcccacggcgcgcccggtggcaccggcggccaaggtcctcgtcgaggagaacttcttggccgtcaagaaggagcgggagcaggtggaggcgctggaggcggagctccggcgagtgggcgaggagaacaagcggctcagcgagatgctgcgggcgctggtggccaagtacaccgagctgcagggccaggtcaacgacatggtggccgcgggaaacaaccgccagtcctccacgtcggagggcggctcggccgcctcgccgcccaggaagcgcatccggagcgacagcctcgacaccgccggcggcggccaccaccgcaagccgtcgccgccgttcgccatcccggtccacgaccagatggagtgctcgtcggccgccgtggccgtcttccacgagcccggcaggcgcatccgggaggagtgcaagcccaaggtgtcccgccgatacgtccacgccgaccccgccgacctcagcctcgtggtgaaagatgggtaccaatggcggaagtacggacagaaggtgaccaaggacaacccgtgcccgcgcgcctacttccggtgctccttcgcgccggcgtgcccggtgaagaagaaggtgcagcgcagcgcggaggacaagaccatcctggtggccacgtacgagggcgagcacaaccacgggcagccgccacagcacgacggcaagggcgcgaagccggccgcggcgagcgaggcggtccggccggcgccactgcctctgcagcagcagaagcagcagcagcaacagaggcacgaggccgcggcggcgggaccatcggaggtcgtgaggaagaacctggcggagcacatggcggccacgctgacgagggaccccggattcaaggcggcgctcgccagcgcgctctccggccggatcctcgagctctcgccgaccagggattgattatatattaggacctgaaccacgaacgattggtccgtagatagcgaattgatgattcagattcagacgattagccgcgatagctcaaaaaaagtttcacgatcc

SEQ ID NO: 19492 - protein, 324 aa, Panicum virgatum
  misc_feature: Ceres CLONE 1805858
  misc_feature (179)..(239): Pfam Name: WRKY Pfam Description: WRKY DNA -binding domain
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MDPWIGGQPSLSLDLNVGLPTARPVAPAAKVLVEENFLAVKKEREQVEALEAELRRVGEENKRLSEMLRALVAKYTELQGQVNDMVAAGNNRQSSTSEGGSAASPPRKRIRSDSLDTAGGGHHRKPSPPFAIPVHDQMECSSAAVAVFHEPGRRIREECKPKVSRRYVHADPADLSLVVKDGYQWRKYGQKVTKDNPCPRAYFRCSFAPACPVKKKVQRSAEDKTILVATYEGEHNHGQPPQHDGKGAKPAAASEAVRPAPLPLQQQKQQQQQRHEAAAAGPSEVVRKNLAEHMAATLTRDPGFKAALASALSGRILELSPTRD

SEQ ID NO: 19493 - DNA, 1592 bp, Panicum virgatum
  misc_feature: Ceres CLONE 1805871
  misc_feature: Encodes the peptide sequence at SEQ ID NO. 19494
agtgtatagcagcttattaccgtgtcggtggctactgactactgctgctgccaagcacaacattattattacacatatggctccacccttacaaggcctaataatagtagtagtccttgccgcttccatgcccgtcgtcttcgtggtgggcgctgcggcaccatccggctacatcagcgtacccctcatccagcagactgtttccgctaccttggatttctccacctctgtgtacctcatggagtttaagctcaacggctcgttggtgtccggcatcatggacaccggcagcgacctcacctggacgaacaattcccagttggtcgactccgccacgagtttcccttgctacaacgccaccaccacaaagggaaaggggaggaggagcaactgcgacttggtcgtcgactccgacgtgaacagctgcacaaaggaggatgcaaacaaggagtattatttgtgcggtggggactgcatcttcaacatctcttacgccgacggttccgtcgccagaggcgtcatgacaaatggcaccctaattcttggaggaggagaaaacacccccaggcccatcatcttgggttccgccgtcaacttgggctgtaaaccctctgctcgtgtcaatgacaggagatgcgggtcgtacagcgccggcgggaccgtcgggcttggcccgggcaaactatcactggtgcagcagctagatttgcacggtttctcctacttgctagcaggtggcgaaaaagacaagagcagcaagatagtgttttacctgcgtcccaagcctctgccgccggtaccgggacaggcggattgttgggaatcgacgcctctggtggacatacaaggagctgggcacttccccaggtactactacgtcaagctgacgggaatatcgatgggcggccaagagctgctggacatccccaagaccacattcagcatggactctaatagtggcgacagaggcatgatcatcgattcaggctccacctacactaagctccccaaggaagtctttggtaaggtcagtgaggccgtggctcaccaaatgaacatgaatcgcaagcccaatcctgccaacaaggggatgacctgttttgagggtgcaaagcttcctaacagtatgcccaacatggaactgcgcttcgccggcgaggccaaaatgattttgcctgtggcaaactatatggccgtcgatggcaagtacggggaatcatgcttagccatgaaggaggcacatgacaacagcgtggatacattcatcttgggcaacttccagcagaagaacatagaaatgttcttcgacatcaggggcaagaaactgtcatttaagtcgagcaaatgcagcggagacatgcacgcagccgtgtaggatccatcctctactatctattcctatctctatctatctatccgcagcgcaggctgtgtgccccaacgatcgaccgcgaccaagaggacggccagagctctacttgaaatcgtccgtccgttatatatctgcaaataaactgcacgcgcatctatgcatgtgatccacgatgtacgtaccggttatgtattggttgtgcaaaatattggacgtctgc

SEQ ID NO: 19494 - protein, 415 aa, Panicum virgatum
  misc_feature: Ceres CLONE 1805871
  misc_feature: SWISSPROT Homolog: EC 3.4.23.12 Nepenthesin
MPVVFVVGAAAPSGYISVPLIQQTVSATLDFSTSVYLMEFKLNGSLVSGIMDTGSDLTWTNNSQLVDSATSFPCYNATTTKGKGRRSNCDLVVDSDVNSCTKEDANKEYYLCGGDCIFNISYADGSVARGVMTNGTLILGGGENTPRPIILGSAVNLGCKPSARVNDRRCGSYSAGGTVGLGPGKLSLVQQLDLHGFSYLLAGGEKDKSSKIVFYLRPKPLPPVPGQADCWESTPLVDIQGAGHFPRYYYVKLTGISMGGQELLDIPKTTFSMDSNSGDRGMIIDSGSTYTKLPKEVFGKVSEAVAHQMNMNRKPNPANKGMTCFEGAKLPNSMPNMELRFAGEAKMILPVANYMAVDGKYGESCLAMKEAHDNSVDTFILGNFQQKNIEMFFDIRGKKLSFKSSKCSGDMHAAV

SEQ ID NO: 19495 - DNA, 947 bp, Panicum virgatum
  misc_feature: Ceres CLONE 1805893
  misc_feature: Encodes the peptide sequence at SEQ ID NO. 19496
aaaaaaaaaacctagcacccaccgcgatccgctcgccggagggaggaggggccacccgcaggcgccgatggaggtgaagctgtggaacgacaagcgcgagcgggagctcctggagagctacgcggacctgtacgcgatcatcaaggccacggagaagctggagcgggcctacgtccgcgacctcgtctccgccgccgactacgaggcggagtgcctcaagctcatctcccagttcaactccctctcctcctcgctcgccggcgccgtcaccgtcccgcgcttcgtccaggcgtaccgcctcgactgccccgccgcgctcaaccgcctcctgcagtccggcgtcccggccaccgtcgagctccgcgccgcgtccaactcctctgcgccgaccgccaccgccgcctcagccgccgccatcgcgcactgcgtgcagaccttcatcactgccatggacgccgtcaagctcaacatgctcgccaacgaccaggtccgcccgctgctgcaggacgtcgccacctccatggccaggctcggacccctgctgccgcccgacttcgaggggaaggtcaaggtcaacgagtggctcggcaagctgcataagatgggcgccgcggatgagctcaccgagcagcaggccaggcagctcaacttcgacctcgactcggcgtacagtgcctttttggctgcgctgcctgccagcatgtgactgggcaaggatatgcctgcttcattcctgtttggttggttccttctattttgttatgcttttgactgcgtggatcactactgtagttccgtagatacatgtacttgtggtcatgctaatatgctatattgctgttaatcgacattgtgcgagtggcttccatttcatttttatacagtaaatatgtttacggcttgccatgcgtttatgctacaatatgtgcatatggcctattcaattg

SEQ ID NO: 19496 - protein, 212 aa, Panicum virgatum
  misc_feature: Ceres CLONE 1805893
  misc_feature (18)..(209): Pfam Name: VPS28 Pfam Description: VPS28 protein
MEVKLWNDKRERELLESYADLYAIIKATEKLERAYVRDLVSAADYEAECLKLISQFNSLSSSLAGAVTVPRFVQAYRLDCPAALNRLLQSGVPATVELRAASNSSAPTATAASAAAIAHCVQTFITAMDAVKLNMLANDQVRPLLQDVATSMARLGPLLPPDFEGKVKVNEWLGKLHKMGAADELTEQQARQLNFDLDSAYSAFLAALPASM

SEQ ID NO: 19497 - DNA, 733 bp, Panicum virgatum
  misc_feature: Ceres CLONE 1805894
  misc_feature: Encodes the peptide sequence at SEQ ID NO. 19498
agacggccttgcttgcttgctttccgtgtagccgaagaagaatcaatccaccgtcgcgttcgcgtccgtccgctcgcctcaggagaagaaccaatcaatggcgcccctcggagacggatcagcttccggcgcgtcgcccaacctggtggtgtcgttcggcgagatgctcatcgacttcgtgcccgacgtggcgggcctctcgctcgccgagtcgggcggcttcgtcaaggcccccggcggcgcgcccgccaacgtcgcctgcgccatctccaagctcggcggctcctccgccttcctcggcaagttcggcgacgacgagttcgggcacatgctggtgaacatcctgaagcagaacgacgtcaacgcggagggctgcctcttcgaccagcacgcgcgcaccgccctggccttcgtcaccctcaagaagaacggcgagcgcgagttcatgttctaccgcaaccccagcgccgacatgctgctcaccgaggccgagctcaacctcgacctcatccgccgcgccaagatcttccactacggctccatctcgctcatctccgagccctgccgcagcgcccacctcgccgccatgcgcgccgccaaggccgccggcatcctctgctcctacgaccccaacgtgcgcctcccgctctggccctcggaggaggcccgcagggccggcatcctcagcatctggaaggaggccgacttcatcaaggtcagcgacgacgaggtc

SEQ ID NO: 19498 - protein, 211 aa, Panicum virgatum
  misc_feature: Ceres CLONE 1805894
  misc_feature: SWISSPROT Homolog: EC 2.7.1.4 Fructokinase
MAPLGDGSASGASPNLVVSFGEMLIDFVPDVAGLSLAESGGFVKAPGGAPANVACAISKLGGSSAFLGKFGDDEFGHMLVNILKQNDVNAEGCLFDQHARTALAFVTLKKNGEREFMFYRNPSADMLLTEAELNLDLIRRAKIFHYGSISLISEPCRSAHLAAMRAAKAAGILCSYDPNVRLPLWPSEEARRAGILSIWKEADFIKVSDDE

SEQ ID NO: 19499 - DNA, 518 bp, Panicum virgatum
  misc_feature: Ceres CLONE 1805894-R
  misc_feature: Encodes the peptide sequence at SEQ ID NO. 19500
tcaccgacggcgacaaggggtgcagatacttcaccaaggacttcaagggcagcgtgcccggctacaaggtgaacaccatcgacaccaccggcgctggtgacggcttcgtcggctccctgctcgttaacgtcgccaaggacgactccatcttccacaacgaggagaagctccgcgaggcgctcaagttctccaacgcctgcggcgccatctgcaccacccagaagggcgccatcccggcgctgcccaccgtcgccgccgcgcaggagctcatcgccaagggcaactagacgccgccgctgcggccaccaccgtgccgccttggtcgcccctcgacgtcgtcatcctttgaattcgtattattaggaggttgttagctgctcttcttaattattagatggctggtggtgtgttctcgtgcgggttaatttagctcagtgtggtgtgcggtgtgtgagatgaacatggttttcgcccggggcattaataaaagttggcatgcgtggtggattttttttagc

SEQ ID NO: 19500 - protein, 94 aa, Panicum virgatum
  misc_feature: Ceres CLONE 1805894-R
  misc_feature: SWISSPROT Homolog: EC 2.7.1.4 Fructokinase
TDGDKGCRYFTKDFKGSVPGYKVNTIDTTGAGDGFVGSLLVNVAKDDSIFHNEEKLREALKFSNACGAICTTQKGAIPALPTVAAAQELIAKGN

SEQ ID NO: 19501 - DNA, 1866 bp, Panicum virgatum
  misc_feature: Ceres CLONE 1805915
  misc_feature: Encodes the peptide sequence at SEQ ID NO. 19502
aaatccacacaaccagcggccccgaaacggccactccctcccctcatcctctccggctctccgccccccgtccgctctccgtcacaagcctcgtctgcttcgtcttccggcagcgcggcaatgcagacgttccacgccgcgcccgcctccttcctcgcgccgcccgctccccacctccttccgccaggcgcaccggccctaagagggtgtctatcggcaaagggtcctgtccctgccgcggtcgccagccggtcgcgcgcttgcttcccgtcgtcccgccgcccgagccggcgccggcggtgctccagggctgcttcgtccggtgctgctgcgacggtcacctcggtggatgatgccaagaaggatgtgctcgtagcactctcccaaatcatcgatcctgatttcggcacggacatcgtctcgtgtgggtttgtcaaggatttagagatcaatgaggcattggatgaggtatcatttcgtctggagctgacaactcccgcatgtccaatcaaagacgagtttgaacaaaaggcaaacgaggttgttgcagcacttccatgggtcaagaaggtagaagtcacaatgtctgcgcaacctgcacagccagtatatggaggtgaccttccagaaggactgcagaagatctcaaacatcatagcagtatcaagctgcaagggaggagttggaaaatctactgttgctgtaaatctagcttatacactagccggaatgggagccagggttggaatctttgatgctgatgtcttcggtccaagcttaccaactatggtttctccacagaaccggttgctagtgatgaacccagaaagcagaagtatccttccgactgagtatttgggcgtcaaaatggtgtcttttggatttgctggacaaggaagagcaatcatgcgaggtccaatggtttccggagtcattaatcagttgctgaccactactgattggggcgagcttgactaccttgtcattgacatgcctcctggaacaggcgacatacacttaacactctgtcaggtagctccattgactgcagctgtgattgttaccacgcctcagaagctggctttcattgatgtcgcaaagggagtaaggatgttctctaagctgaaggttccttgtgttgcagttgttgagaacatgtgctactttgatgctgatggaaagcgttattacccatttggacagggttctggaactcaggttgtggagcaattcggaatacctcacctcttcgatttgccgatacggccaactctttcagcttctggagatactgggatacctgaagtagtggctgatccacaaggagatgttgccaagacatttcaaaatcttggagtttgtgttgttcaacaatgtgctaaaattaggcaacaagtttcaacagcagtgtcctatgatagatcaattagagcgatcagagtgaaagtgccagattcagatgaagagttcttgttgcatccggcaacagtcaggaggaatgatcgatctgctcaaagcgtggatgaatggacaggagagcagaaaattcagtacggtgatgtaccagatgacatcgagcctgaagagattaggccgatgggaaactacgctgtttctataacttggcctgatggatttagtcagatagcaccttacgaccaattggaaatgcttgagcgggtagtggatgctccgcgtgcagcaacacctgcagtggcctcatcatgatacagtgcgaaaccgtgttcagttctcaagggacaagaaagcaggctttccttgcaattagcttctcatataatttataggtctacagttaaaaattatttattgaaataagagacagcgttcttcttattttcagcc

SEQ ID NO: 19502 - protein, 535 aa, Panicum virgatum
  misc_feature: Ceres CLONE 1805915
  misc_feature (179)..(387): Pfam Name: CbiA Pfam Description: CobQ/CobB/MinD/ParA nucleotide binding domain
MQTFHAAPASFLAPPAPHLLPPGAPALRGCLSAKGPVPAAVASRSRACFPSSRRPSRRRRCSRAASSGAAATVTSVDDAKKDVLVALSQIIDPDFGTDIVSCGFVKDLEINEALDEVSFRLELTTPACPIKDEFEQKANEVVAALPWVKKVEVTMSAQPAQPVYGGDLPEGLQKISNIIAVSSCKGGVGKSTVAVNLAYTLAGMGARVGIFDADVFGPSLPTMVSPQNRLLVMNPESRSILPTEYLGVKMVSFGFAGQGRAIMRGPMVSGVINQLLTTTDWGELDYLVIDMPPGTGDIHLTLCQVAPLTAAVIVTTPQKLAFIDVAKGVRMFSKLKVPCVAVVENMCYFDADGKRYYPFGQGSGTQVVEQFGIPHLFDLPIRPTLSASGDTGIPEVVADPQGDVAKTFQNLGVCVVQQCAKIRQQVSTAVSYDRSIRAIRVKVPDSDEEFLLHPATVRRNDRSAQSVDEWTGEQKIQYGDVPDDIEPEEIRPMGNYAVSITWPDGFSQIAPYDQLEMLERVVDAPRAATPAVASS

SEQ ID NO: 19503 - DNA, 1182 bp, Panicum virgatum
  misc_feature: Ceres CLONE 1805918
  misc_feature: Encodes the peptide sequence at SEQ ID NO. 19504
atcccgccatgtcctctcctctgcctctctctcatctctagcctccctcctcttcctcagcctccgacgacgctgttagctgagagcaagggaggccctggtctacgccagccagccagccatgctggtgcgctgcgacgtctgcggcgccgagccggccgccgtgctctgctgcgccgacgaggccgcgctctgctccgcctgcgaccgccgcgtccaccgcgccaacaagctcgccgacaagcaccgccgcatcccgcttctccatccctccggcgacgactccgccgccgccgccgccgccgcgccgctctgcgacgtctgcaaggagcggaggggcctggtgttctgcgtggaggaccgcgccatcctgtgcctcgactgcgacgaccccatccacagcgccaacgacctcaccgccaagcactcccgcttcctcctcgtcggggcgaaactctcagccgggctcgtcgaccaggcgcccccctccctggacgactgccggggcagcggctccgacgagccccacgacgtcgccgccatctgcccgccgcaggcggccaagagcttggctcttgattgcagcaacagccacggcggcggcggcggcggcggaggcggcggcggcggcggaagcagcggcggcagcagcagcatctccgactacctcaccaacatctgccccggctggcgcgtcgacgacctcctcttcgacgacgccgcgttctccgccgcctcggaggaggccaggcgcgacgagcacgagcaggttccgtccctggacgccgacctcttcgacgtggtcgccggccggccggggaagcgcggcgcgtggtacggcggcgcgatgggcctcgagaaggtgcctgctgctgctgcctccattgcggtcccgacggcggctaagcagcaggggcgcgtgagggagaggcactggagctgcgacagcgacagcgacgtgttcgcggtgccggagatctcgcagccgccgccggccaagaaggcgcggccgccggcgccgacgttctggtgcttctgatcgagctgcgccaccagcccggccgccatgctagctcgatccgcgtgtgcacttcgctactactgtgtaccagtgtgtgtgatctcgctgttactgtactgttaccttatacttgccactactagcagtgctcaagcccagtc

SEQ ID NO: 19504 - protein, 305 aa, Panicum virgatum
  misc_feature: Ceres CLONE 1805918
  misc_feature (60)..(107): Pfam Name: zf-B_box Pfam Description: B-box zinc finger
  misc_feature (1)..(47): Pfam Name: zf-B_box Pfam Description: B-box zinc finger
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
MLVRCDVCGAEPAAVLCCADEAALCSACDRRVHRANKLADKHRRIPLLHPSGDDSAAAAAAAPLCDVCKERRGLVFCVEDRAILCLDCDDPIHSANDLTAKHSRFLLVGAKLSAGLVDQAPPSLDDCRGSGSDEPHDVAAICPPQAAKSLALDCSNSHGGGGGGGGGGGGGSSGGSSSISDYLTNICPGWRVDDLLFDDAAFSAASEEARRDEHEQVPSLDADLFDVVAGRPGKRGAWYGGAMGLEKVPAAAASIAVPTAAKQQGRVRERHWSCDSDSDVFAVPEISQPPPAKKARPPAPTFWCF

SEQ ID NO: 19505 - DNA, 1297 bp, Panicum virgatum
  misc_feature: Ceres CLONE 1805924
  misc_feature: Encodes the peptide sequence at SEQ ID NO. 19506
ccccattcagatccgccactattcttcttcatttcttcttccacagctagctagctagcagccggtgggtgcagcagcagcagcagcaggacaccgatccggccgactacaagcaaggatgctggccatcttccagaagcaggtggcgcacgcgccgcaggagctcaacagcccccggagcggcggcgccgccaagcccaggagccccgacgagatcctccgggacttccacgccgcgcaccccgccgacgccttctccacctccttcgggggcggcgccgcgctcgcctgcgtcggcgcgcgcgcctgccctgctgccggggccggccaccaccagcgcatgttctgcggcctcgacgacatctactgcgtcttcctcggccgcctcgacaacctcagcgccctcatccgccagtacggcctctgcggcaagtccaccaacgaggcgctgctcgtcatcgaggcctaccgcaccctgcgcgaccgcgggccctaccccgccgaccaggtcgtcaaggacctcgccggatcattcgccttcgtcgtcttcgacaacaagtccggcgccgtattcgcagccctgagcgccgacggcggcgttccgctctactggggcatcgcggcggacggctccgtggtgatctgcgaggaccgggagatcgtcaagcgcgggtgcggcaagtcgtacgcgcccttccccgtggggtgcatgttccacagcgagggcggcctcaagagcttcgagcaccccatgaacaggctcaaggcgatgccccgggtcgacagcgagggcgtcatgtgcggcgccaccttcaaggtcgacaccttcaccaagatcaactccatgccgcgcgtcggcagcgccaccaactgggccgccgcatgggacgacaaagccatctagagctgctagctactagtagaacatcatatcttttcactctctctttttttttcaatcaaatcaagagcgccgctgctagccatgtgccctttctttcttgttttcttccttcttcgtcgcccgctatatatgctagctgctgctttaatttttccttccgatccactacactaatgtatctcaagaccacgtacggaagcatgccgcctttgttttactgcctgatgtcgtcctcttcctccttgtgttggcacattgtacatttccctgtgcttgtggacttggctgttgaacatgatcagtaacagtttgtttgcctcaataatcttatgtaacttactgatgtttaggcgtttagcttctgtatgtaaggtttatatttttatttgttac

SEQ ID NO: 19506 - protein, 261 aa, Panicum virgatum
  misc_feature: Ceres CLONE 1805924
  misc_feature: SWISSPROT Homolog: EC 6.3.5.4 Asparagine synthase (glutamine-hydrolyzing)
MLAIFQKQVAHAPQELNSPRSGGAAKPRSPDEILRDFHAAHPADAFSTSFGGGAALACVGARACPAAGAGHHQRMFCGLDDIYCVFLGRLDNLSALIRQYGLCGKSTNEALLVIEAYRTLRDRGPYPADQVVKDLAGSFAFVVFDNKSGAVFAALSADGGVPLYWGIAADGSVVICEDREIVKRGCGKSYAPFPVGCMFHSEGGLKSFEHPMNRLKAMPRVDSEGVMCGATFKVDTFTKINSMPRVGSATNWAAAWDDKAI

SEQ ID NO: 19507 - DNA, 696 bp, Panicum virgatum
  misc_feature: Ceres CLONE 1805934
  misc_feature: Encodes the peptide sequence at SEQ ID NO. 19508
agccagctcccagctctcctctcacactgctccactccctcacctagaagagaacacagaaccggatccagagcagagcgtgttgcgccggcctagctcttgggtcgtcaagtctccgttcgttctttctttctccaaccggcagctgatctcctgtgttaatcccgaccggagctgcctgcgatgggcatcgtcgacgtcgtctccgtgttctgcaccctgccgaggactcgccggcacctcaagaagaggaagcagttccagacggtggagatgaagatgcggatcgactgcgaggggtgcgagcgcaaggtgagcaaggcgctggagggcatggagggcgtgagctccgtggaggtggcgccgcggcagcacaaggtgacggtggccgggtacgtggacgccggcaaggtgatgcggcggttggcgcggcggacgggcaagcgcgtggagccgtggccctacgtgccctacgacgtggtggcgcacccctacgcgccgggcgcctacgacaagaaggcgccgcctgggtacgtgcgcaacgtcgtcgccgaccccgccgccgcgccgctcgccagggcctcctccaccgaggtcaggtacaccgccgccttcagcgacgagaaccccaacgccgccggcgccgacaggaaggaggagcaagaagccggggaggaggagcagaaagaggagcaa

SEQ ID NO: 19508 - protein, 170 aa, Panicum virgatum
  misc_feature: Ceres CLONE 1805934
  misc_feature (29)..(91): Pfam Name: HMA Pfam Description: Heavy-metal-associated domain
  misc_feature: Functional homolog of the protein sequence given in SEQ ID NO 50155
  misc_feature: Useful for biocontainment applications
MGIVDVVSVFCTLPRTRRHLKKRKQFQTVEMKMRIDCEGCERKVSKALEGMEGVSSVEVAPRQHKVTVAGYVDAGKVMRRLARRTGKRVEPWPYVPYDVVAHPYAPGAYDKKAPPGYVRNVVADPAAAPLARASSTEVRYTAAFSDENPNAAGADRKEEQEAGEEEQKEE

SEQ ID NO: 19509 - DNA, 1198 bp, Panicum virgatum
  misc_feature: Ceres CLONE 1805937
  misc_feature: Encodes the peptide sequence at SEQ ID NO. 19510
gtcgtgttgggtgtcgccgcgtcgcctgcatccagcttcctcctccctgaaccctcgccgccgccgccgccgctccgggtccgtgcccctgccggcgccgccgccgccgagagagggagaatagggaggatggccggcgccctcgacatgtccctcgacgacctcatctccaagaacaagaaaacccagccgcgccccagcggccgaggcccgacctccggaggcggaggccccgcacccacggcgccgcgccgtcgcttcaacgcccgcgcagccgcagccccgtaccaccgcggcaccactttccctttccaggcgcggcggcccatggcttatgctggatacggagccgcccagccccagccttcgatggacgcgcccaccatgctctacatctccaacctcgactatggcgtcaccaacgacgacatcaaggaactattttctgatgtcggcgatatccagcgttactccatcaactatgacaggagtggaagatcaaagggaactgcagaggttgtcttctcaagaaggtctgacgctctagctgctcttaagaggtacaacaatgtgcagcttgatggcaaacctatgaaaattgagatcattgggacaaatattgaggcgccaccaatggctaccttctccttcaatccaccatctggaaacttcaatgggcctttcagaaggcccggaagaggtggtgatggaggatggcctcggggtagaggtggattcggtgggcgtgggcgggggcaagggagccgtgggcgagggaggggagggcgtggcggtgagaaagtttcagctgaagatctggatgcggacttggacaagtaccacaaagcagcaatggagaccagctaaatggttctgacactgattcaacacaggcaataggccttgctctgtctccttctgtaggaatgctgatgcagacatgtatcggttcatgagcggagagcgtgtaaggttaagctgtaagaagcttcttttgtttcaccgagcatgttgggtaatgagatgatggtgggtgagggctgattatttgggacatgaggtgttgccggtgaccaaatgggactctgttaattataatttagtaatttagaagcttgtagaaggggatagaatagagacgagaagtttttatggttttcttgcatttgcacttggaggtggaggcctggaggtcatc

SEQ ID NO: 19510 - protein, 245 aa, Panicum virgatum
  misc_feature: Ceres CLONE 1805937
  misc_feature (87)..(157): Pfam Name: RRM_1 Pfam Description: RNA recognition motif. (a.k.a. RRM, RBD, or RNP domain)
  misc_feature: Functional homolog of the protein sequence given in SEQ ID NO 50867
  misc_feature: Useful for making plants with modulated biomass
MAGALDMSLDDLISKNKKTQPRPSGRGPTSGGGGPAPTAPRRRFNARAAAAPYHRGTTFPFQARRPMAYAGYGAAQPQPSMDAPTMLYISNLDYGVTNDDIKELFSDVGDIQRYSINYDRSGRSKGTAEVVFSRRSDALAALKRYNNVQLDGKPMKIEIIGTNIEAPPMATFSFNPPSGNFNGPFRRPGRGGDGGWPRGRGGFGGRGRGQGSRGRGRGGRGGEKVSAEDLDADLDKYHKAAMETS

SEQ ID NO: 19511 - DNA, 1242 bp, Panicum virgatum
  misc_feature: Ceres CLONE 1805941
  misc_feature: Encodes the peptide sequence at SEQ ID NO. 19512
acccacacaggaaaccgcaagagccacacgccccgcgcacccaccaacccaaagggggaggaacagccgccgccaacgccgccgccgccgccgcgcgcggagtcacaccaccactccagtactccactaccgagcgcgcgcgagagagagagagggagaggggaggcgcctgggcggcggagatggcggcgggagcagggacgcgggaggagatggtgtacatggcgaagctggcggagcaggcggagcggtacgaggagatggtggagttcatggagaaggtcgccgcggcggcgggcgccggggagctcaccgttgaggagcgcaacctgctgtcggtcgcctacaagaacgtcatcggcgcgcgccgcgcgtcgtagcgcatcgtctcttccatcgagcagaaggaggaggcccgcggcgccgcgggccacgccgctgccgccaggggctaccgcggccgcgtcgaggccgagctctccggcatctgcgcggggatcctgcgcctcctcgacgaccgcctcgtccccgccgccgccgccgtcgacgccaaggtcttctacctcaagatgaagggcgactaccaccgctacctcgccgagttcaagaccggagccgagcgcaaggacgccgctgactccaccctagccgcctaccaggccgcccaggacatagccataaaggagctgccgcccacacaccccatcaggctcggcctcgcgctcaacttctccgtcttctactacgagatcctcaactcgccggaccgcgcgtgctcgctcgccaagcaggccttcgatgaagccatttcagaactggacactcttggggaagagtcctacaaggatagcaccctgatcatgcagcttcttcgtgacaacctcaccttgtggacttctgacatgcaggatgatggcggcgatgaaatgagggatgcgagcaagcccgaggatgagcagtagccatcgattcaagcaactgccgtctctatctcttaaccctttgggtagtcgtgatgcttgtacaaggaccattttcgtgtgtcctttatcatcggatctgcttacctttcgttttgttatattcctatattgtgttatccatgtattgttttactttcctactggaaccctgttagtgtgtgggagagaataacctaagcctgcctttaactagtacaaggattgtcaactcttttgtactatgattgaatggttatgcatgttccatatatatccagcg

SEQ ID NO: 19512 - protein, 130 aa, Panicum virgatum
  misc_feature: Ceres CLONE 1805941
  misc_feature (1)..(116): Pfam Name: 14-3-3 Pfam Description: 14-3-3 protein
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 789 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: The sequence is a functional homolog of SEQ ID NO 786 in the 11/479,226 US patent application
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application
  misc_feature: The sequence is a functional homolog of SEQ ID NO 404 in the 10/374,780 US patent application
  misc_feature: The sequence is a functional homolog of SEQ ID NO 68 in the 11/375,241 US patent application
  misc_feature: The sequence is a functional homolog of SEQ ID NO 864 in the 10/225,066 US patent application
  misc_feature: The sequence is a functional homolog of SEQ ID NO 1777 in the 11/479,226 US patent application
MKGDYHRYLAEFKTGAERKDAADSTLAAYQAAQDIAIKELPPTHPIRLGLALNFSVFYYEILNSPDRACSLAKQAFDEAISELDTLGEESYKDSTLIMQLLRDNLTLWTSDMQDDGGDEMRDASKPEDEQ

SEQ ID NO: 19513 - DNA, 1085 bp, Panicum virgatum
  misc_feature: Ceres CLONE 1805943
  misc_feature: Encodes the peptide sequence at SEQ ID NO. 19514
ttataaactgcaacaatatgatgggagtaatactcctatgattcccaagtatttaagtctctgatgatcctcaggatcatcagcggcaatggcgatggcgtcgtcgagcgggctccggagctgcagcgccgtcggcgtgcccagcctgctggcgccgtcgtcgtcgcgcgccgggcggctgccgttctgcgccagcgccaccacctccggccgcgtcatcatgtcggccgagtggatgcccggccagccccgccccgcccacctcgacggctcctcccccggggacttcggcttcgaccccctcggcctcgccaccgtgccggagaacttcgagcggttcaaggagtcggaggtgtaccactgccgctgggccatgctcgccgtgcccgggatcttggtgccggaggcgctggggctcggcaactgggtgaaggcgcaggagtgggcggcggtgcccggcgggcaggccacgtacctgggcaacccggtgccgtggggcacgctgcccaccatcctggtgatcgagttcgtggccatcgccttcgcggagcaccagcgcaccatggagaaggaccccgagaagaagaagtaccccggcggcgccttcgacccgctcggcttctccaaggaccccgtcaagttcgaggagtacaagctcaaggagatcaagaacggccggctggcgatgctggcgttcgtggggttctgcgtgcagcagtcggcgtacccgggcacggggccgctggagaacctggccacccacctcgccgacccgtggcacaacaacatcggcgacatcatcatccccagaacgatctacccttgagctgatgagaccacggcggcggcgaagaacggcgatgagacgagacgacgggcggacggaaagtgtgtactggatagatcaatggtgttttctgtgtgtggattactgctgggcactgcctgcgtgcgtgcagcaactgtacaaccaacgacggcggcggcgactttccggccgtcggccgggaacccattgtccttgtgtaatgtaaagcttacttgttattaaggagtagcggctactcggtcttgtgaatccacgc

SEQ ID NO: 19514 - protein, 245 aa, Panicum virgatum; identical to SEQ ID NO: 11916
  misc_feature: Ceres CLONE 1805943
  misc_feature (54)..(211): Pfam Name: Chloroa_b-bind Pfam Description: Chlorophyll A-B binding protein

SEQ ID NO: 19515 - DNA, 1148 bp, Panicum virgatum
  misc_feature: Ceres CLONE 1805949
  misc_feature: Encodes the peptide sequence at SEQ ID NO. 19516
atcgcagccagcaacagagcagctcgcaagctctaagccgaagtagaaggaagacccaccctcggcgctcatcaatggcggcttccaccatgtcgctctcctctcctgctctcgccggcaaggcggcgaagatcgccccctccagcgtgttcggcgagggccgcgtcacgatgcgcaagacggccgccaaggccaagcccgccgcggcgtccggcagcccgtggtacggcccggaccgcgtcctctacctcggcccgctatccggcgagccgccgtcctacctcaccggcgagttcccgggggactacggctgggacaccgctgggctctcggccgaccccgagacgttcgccaagaacagggagcttgaggtgatccactgccggtgggccatgctcggcgcgctcggctgcgtcttccccgagctcctcgcccggaacggcgtcaagttcggcgaggccgtctggttcaaggccggcgcccagatcttcagcgagggcggcctcgactacctgggcaaccccagcctcgtgcacgcgcagagcatcctcgccatctgggcatgccaggttgtcttgatgggggccgtggagggttacagggtggctggcgggccgctcggcgaggtggtcgacccgttgtaccctggagggagcttcgatccgctggggctcgccgacgacccggagaagttcgcggagctgaaggtgaaggagatcaagaacggccggctcgccatgttctccatgttcgggttcttcgtgcaggccatcgtcactggcaaggggaccctggagaacctggccgaccacatcgccgaccccgttggcaacaacgcctgggcgtacgccaccaacttcgtccccggcaactgatgatgatccattgagggctctattcgaggcggttcccactgcgaatgcgaacgtggcgccttgatcccattcgcttcaaagttgagagtgctcgtacaagagcaatcggacaatgaggccgtgctgcgatgagcagcgctagctgcaccttagcgcgcaccctgtattttgttcgtttggatcgtgtcatgtatattacttgattggttcatgaaaaaaaaagggccgatggattgaaattgaaaaaacctcagctagctctttgtgccgttc

SEQ ID NO: 19516 - protein, 266 aa, Panicum virgatum
  misc_feature: Ceres CLONE 1805949
  misc_feature (65)..(233): Pfam Name: Chloroa_b-bind Pfam Description: Chlorophyll A-B binding protein
MAASTMSLSSPALAGKAAKIAPSSVFGEGRVTMRKTAAKAKPAAASGSPWYGPDRVLYLGPLSGEPPSYLTGEFPGDYGWDTAGLSADPETFAKNRELEVIHCRWAMLGALGCVFPELLARNGVKFGEAVWFKAGAQIFSEGGLDYLGNPSLVHAQSILAIWACQVVLMGAVEGYRVAGGPLGEVVDPLYPGGSFDPLGLADDPEKFAELKVKEIKNGRLAMFSMFGFFVQAIVTGKGTLENLADHIADPVGNNAWAYATNFVPGN

SEQ ID NO: 19517 - DNA, 740 bp, Panicum virgatum
  misc_feature: Ceres CLONE 1805956
  misc_feature: Encodes the peptide sequence at SEQ ID NO. 19518
atcgccacaagttcgcaatctctcgatttcccaaatcgccgagaagacccgagcagagaagttccctccgatcgccttgccaagatgcagatctttgtgaagacactcactggcaagactatcacccttgaggtggagtcttctgacacaattgacaatgtcaaggcaaagatccaggacaaggaagggattcctccagaccagcagcgccttatcttcgctggcaagcagcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccatcgacaatgtgaaggcaaagattcaggacaaggagggcatcccccckgaccagcagcgcctcatctttgcmggcaagcagytagaggacgggcgtaccctggcggattacaacatccagaaggagtccaccctccaccttgtcctgcgcctccgtggtggtttctgagcctagtgctcctgagttgccttttgtcgttatggtcaacccctggtttaagtcgtgtgaactctctgcattgcgttgctagtgtctggttgtggttgtaataagaacatgttgctgtggatcacatgactttcatggctgctttaaagttcctgaaatctgaactcggaacccctttttaagctttgaactgc

SEQ ID NO: 19518 - protein, 153 aa, Panicum virgatum
  misc_feature: Ceres CLONE 1805956
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 19519 - DNA, 1230 bp, Panicum virgatum
  misc_feature: Ceres CLONE 1805961
  misc_feature: Encodes the peptide sequence at SEQ ID NO. 19520
atcccccatcgaaaaccgtcaacaaagaaaccccaccgtgcccaagccccccaaaacctcaaaccaccagcccgcccgccatggcgttccggctgagcaacaacctcatcggcgtcctcaacttcgtcaccttcctgctctccgtcccgatcctgggcgccggcatctggctgggccaccgcgccgacggcaccgagtgcgagcgctacctctccgcgcccgtcatcgccttcggggccttcctcctcgccgtctccctcgcgggcctcgtcggcgcctgctgccgcgtcacctggctgctctgggtctacctcctcgccatgttcgccctcatcgtcgccctcttctgcctcaccgtcttcgccttcgccgtcaccaaccgcggcgccggggaggccgtctccggccgcggctacaaggagtaccgcctcggggactactccaactggctgcagaagcgcgtcgagagcaccaagaactggaacaggatcaggagctgcctccaggactccaaggtctgcaagagcttgcaggacagcagggagacgttcgcggacttcatacgctccgacctctcacccatccagtccgggtgctgcaagccccccacgagctgcaacttcacctacgtgagcggcacggagtggaccaagacgacgacccccgccggcgcggcggcggacccggactgcggcacctggagcaacgaggcgctctgctacgactgccagtcctgcaaggccggcgtggtggccaccttcaagcgcgactggaagcgcgtcgccgtcgtcaacatcgtcttccttgtcttcatcatcatcgtctactccgtcggctgctgcgccttccggaacaaccgcagggacaacgccgcctaccgcggcggctggaagcagggcggctacgcctgatcgcccggccggcctcgccggaggagccggccggagagccactgctagctgctgctccatcgattggttgccgtcgtcgtgcacgatcagcgctctgctctctctctgtcgctgcccgcctgccccccggtcgctgtcgtcctatatatgtgtctaggctcgatctagctctgtacaggcgagattatattactacggattcttgtcgtctgatagttactttattatagtttattatatgatctctgatcagcagtaggttttgtacatgctgttcgttgattcgacacaccgctatatattcgcatatgcatgtctt

SEQ ID NO: 19520 - protein, 276 aa, Panicum virgatum
  misc_feature: Ceres CLONE 1805961
  misc_feature (5)..(245): Pfam Name: Tetraspannin Pfam Description: Tetraspanin family
  misc_feature: Functional homolog of the protein sequence given in SEQ ID NO 50853
  misc_feature: Useful for making plants with modulated nitrogen use efficiency
MAFRLSNNLIGVLNFVTFLLSVPILGAGIWLGHRADGTECERYLSAPVIAFGAFLLAVSLAGLVGACCRVTWLLWVYLLAMFALIVALFCLTVFAFAVTNRGAGEAVSGRGYKEYRLGDYSNWLQKRVESTKNWNRIRSCLQDSKVCKSLQDSRETFADFIRSDLSPIQSGCCKPPTSCNFTYVSGTEWTKTTTPAGAAADPDCGTWSNEALCYDCQSCKAGVVATFKRDWKRVAVVNIVFLVFIIIVYSVGCCAFRNNRRDNAAYRGGWKQGGYA

SEQ ID NO: 19521 - DNA, 1412 bp, Panicum virgatum
  misc_feature: Ceres CLONE 1805966
  misc_feature: Encodes the peptide sequence at SEQ ID NO. 19522
ggccggccctccccgtcgcttctactctcccacttcagccgcttggccgccgtgcgccaccggagtctggtcgccttcgccgggatggccggagtccccgccactctgtccgcctccgcggctcagatcgggggccttctctcgaggaagccttacgcgccgccgtcctgggccacgcacctctcccccatgccttcccataccttctcgctcggccattttccaacaccgatccacaagtggaatctccccagtttgccggaaggcacggaagtatggatcaagcgagacgatttatccggcatgcagttgagtggaaacaaggtacgaaagctggagtttctgatggcagatgctttagcgcaaggcgcagactgcgttatcactgttggtggtatccaaagcaaccattgccgtgccacagcagtggctgctaagtatctcaatcttgattgctacctgatactacgtacctcgaagcttctcgtggataaagaccctggtttggttggcaatctcctagttgagagactggtgggtgcgcacattgatcttgtatcaaaagaagagtatggaaaaattggcagtgtggctttagctgacttgctgaagaaaaagctgtcgatagaagggaggaaaccatatgtgattcctgtcggcggatcaaactcactgggaacatggggatatattgaggcgataagggagatcgagcagcaaattcagcaatctgctgatgctcagtttgatgatattgttgttgcgtgtggcagtggtggaacaattgctggtcttgctttaggatcaagattgagcaacttaaaggcaaaagtccatgcattctctgtttgtgatgatcctgaatacttctatgactatgttcaaggcctgattgatggacttcaatctggtttggactcacatgatatagtcagcatcgaaaatgctaaaggattaggttatgccatgaacacagccgaggagcttaagtttgtcaaagacatagctgcagcgacaggcattgtccttgatccagtctacagtgggaaggcggcttatggattgctaaaagacatagctggcaatccagtcaagtggaaggggcggaaaattttgtttgttcatacaggtggtctccttgggttgtatgataaggctgatcagttgtcacctctggctgggagctggcgcagaatggatcttgaagatactataccacacaaagatggcactggtaagatgttctgataaatatggtccaaaagcttccatgatggtttagtcttctggacaccatgttcatcatagaaaatatttactcttacatttgtgcaataaaatacagaatagacggttcgcatggtgtatagcattgatgcaacttaagaataaagcacatctttctgctattt

SEQ ID NO: 19522 - protein, 387 aa, Panicum virgatum
  misc_feature: Ceres CLONE 1805966
  misc_feature: SWISSPROT Homolog: EC 4.4.1.15 D-cysteine desulfhydrase
MAGVPATLSASAAQIGGLLSRKPYAPPSWATHLSPMPSHTFSLGHFPTPIHKWNLPSLPEGTEVWIKRDDLSGMQLSGNKVRKLEFLMADALAQGADCVITVGGIQSNHCRATAVAAKYLNLDCYLILRTSKLLVDKDPGLVGNLLVERLVGAHIDLVSKEEYGKIGSVALADLLKKKLSIEGRKPYVIPVGGSNSLGTWGYIEAIREIEQQIQQSADAQFDDIVVACGSGGTIAGLALGSRLSNLKAKVHAFSVCDDPEYFYDYVQGLIDGLQSGLDSHDIVSIENAKGLGYAMNTAEELKFVKDIAAATGIVLDPVYSGKAAYGLLKDIAGNPVKWKGRKILFVHTGGLLGLYDKADQLSPLAGSWRRMDLEDTIPHKDGTGKMF

SEQ ID NO: 19523 - DNA, 1007 bp, Panicum virgatum
  misc_feature: Ceres CLONE 1805971
  misc_feature: Encodes the peptide sequence at SEQ ID NO. 19524
cgtgctctctcagaggtgggttggcttctccccctcttaccaagtcctcggttctagggttttagttggaaggggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcaaccgagcagtcgatgctcgacgccaccgtatccgccaccgccaccgtcgtagccgccgccaccgtacccgccctcacggcgaccgccgccgccaccgtacccgccgccgccgccgtagcctccctggcgaccgccgccgtaaccgccgccgccgccgccgccgctccgctcttcttctccggctccctccctcccggatcaaggatgaagtttgttgctgcctatctgcttgctgtcctcgctggcaaccccagcccctctgcaaaggatctatcgtctattctggaatcagttggctgtgaaattgacaatgaaaagatggagctgctgctgtcccaactgagtggcaaggacattaccgagctcattgctgccggcagggagaagtttgcttcggttccatgcggtggtggtggtgtggctgtggcagcagctgcccctgctgctggtggagctgctcctgcagctgaggccaagaaagaagagaaggtcgaggagaaggaagagagtgatgatgacatgggcttcagcctcttcgactaagctgtgtggtcatcagagttgtctttttggcaggaaaaccagagtcgccatgttttgacttttactttgttttatgttgcgaagcacctgaaaagattgctactgccttgatatgtagtatttcagccgtaggttgctaggctggttggtgtttactggtgaaccagagtttatgcatcatatattgagaatcggttacccaattcattgctgttc

SEQ ID NO: 19524 - protein, 237 aa, Panicum virgatum
  misc_feature: Ceres CLONE 1805971
  misc_feature (142)..(236): Pfam Name: Ribosomal_60s Pfam Description: 60s Acidic ribosomal protein
  misc_feature (10)..(81): Pfam Name: RRM_1 Pfam Description: RNA recognition motif. (a.k.a. RRM, RBD, or RNP domain)
  misc_feature: Functional homolog of the protein sequence given in SEQ ID NO 50285
  misc_feature: Useful for making plants with altered oil content
  misc_feature: Useful for making plants with modulated biomass
  misc_feature: Functional homolog of the protein sequence given in SEQ ID NO 50578
  misc_feature: Useful for making plants with altered lignin content
  misc_feature: Functional homolog of the protein sequence given in SEQ ID NO 50452
  misc_feature: Useful for making plants with altered carbohydrate content
MAAADVEYRCFVGGLAWATDNASLQQAFASYGDVLDSKVITDRETGRSRGFGFVTFSTEQSMLDATVSATATVVAAATVPALTATAAATVPAAAAVASLATAAVTAAAAAAAPLFFSGSLPPGSRMKFVAAYLLAVLAGNPSPSAKDLSSILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 19525 - DNA, 1071 bp, Panicum virgatum
  misc_feature: Ceres CLONE 1805973
  misc_feature: Encodes the peptide sequence at SEQ ID NO. 19526
gagcctgctgccctgcctgccatctcgaaacagcacggcagctgcgggctgcggcagcttgacagctgcctgcctctccaacggctggctcgcgagaatccaagccattttctgcacgcgctcccaggttctagctccggcgccatcagggcaggggggagagcgatagttctgtgctactggaaggggagggggaggaggaggttgcgagatggggtccggatctttcctcaaggtgctggccaagaacttcgacgtgctcgccgggccaataatatcacttgcttatcctctgtatgcttctgttagagcaatagagacgaaaaatcctgtagatgatcagcaatggctcacttactgggtgctgtactcgtttatcactttgtttgagctaacttttgctccaattattgagtggcttcccttttggtcatatgcaaagctgttcttcaactgctggttggtcttaccttggtttaacggtgctgcttatgtttacgaccattttgtgcggccaatttttgtgaaccgccaaatagtaaacatatggtatgtcccaagaaatgagaagtcaagtaaacctgatgatgtactgtcagctgcagagagatatattgaacaaaatggacctgaagcatttgagaagctcatcagcaagtctacaaagtcttcaaaatcaaggaccacaaggcgttcgatcttggaggaggctgaggctgaaagagaatcctggggtgaaaatcctttctacgacaaaaatttccgacactgaactacttcaagtccactcagcagccttgctgcgccacacagcctggagacgaccttcatgtattcctgacttgaggactgtaccttgttgcatccactgctaaactacgatcagttctagagcaattgtggactactgtaaatggaggtagatgctagcgttgctcgtttatgtgagctgttggccggtgtaatatcaacaacaacgcctgtgttactaaacctttaggaggatacaagcctagattttcagtttccatttcgttctgagcatatatatagtcggcttgttgcatttct

SEQ ID NO: 19526 - protein, 186 aa, Panicum virgatum
  misc_feature: Ceres CLONE 1805973
  misc_feature (7)..(104): Pfam Name: TB2_DP1_HVA22 Pfam Description: TB2/DP1, HVA22 family
MGSGSFLKVLAKNFDVLAGPIISLAYPLYASVRAIETKNPVDDQQWLTYWVLYSFITLFELTFAPIIEWLPFWSYAKLFFNCWLVLPWFNGAAYVYDHFVRPIFVNRQIVNIWYVPRNEKSSKPDDVLSAAERYIEQNGPEAFEKLISKSTKSSKSRTTRRSILEEAEAERESWGENPFYDKNFRH

SEQ ID NO: 19527 - DNA, 664 bp, Panicum virgatum
  misc_feature: Ceres CLONE 1805992
  misc_feature: Encodes the peptide sequence at SEQ ID NO. 19528
gttgccatcacctgccgctaactggccgggcgcctgcccgcagcagtagtcgtcaagaaactgatcgctcagctcgctcgtcccggccaagggcacaacggtcgggccggcgcctgaggcaggatcgaagacgtcgccgtctcggtccacccgccgatcgatatggggcgcgaggcggcggcggcggcgaggcccaagctgcggaggggcctctggtcgccggaggaggacgagaagctctacaaccacatcatccggtacggcgtcggctgctggagctcagtcccaaagctcgcaggcttggagagatgcggcaagagctgcaggctgagatggatcaactacctgaggcctgatctcaagaggggcagcttctcccagcaggaggaggacctcatcatcagcctccacaagatcctaggcaacaggtggtcccagatcgcgtcacagctgcccggccggacggacaacgagatcaagaacttctggaactcgtgcatcaagaagaagctccggcagcggggcatcgacccggccacccacaagccgctcgaggacgacgccgccgccgccgccgccaacagtggggaggcgccacgggacgactgcaacaagctgctcccggcgacagccgacgaccactgcggcttcgccatgggcggca

SEQ ID NO: 19528 - protein, 167 aa, Panicum virgatum
  misc_feature: Ceres CLONE 1805992
  misc_feature (15)..(62): Pfam Name: Myb_DNA-binding Pfam Description: Myb-like DNA-binding domain
  misc_feature (68)..(113): Pfam Name: Myb_DNA-binding Pfam Description: Myb-like DNA-binding domain
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50235
  misc_feature: Useful for biocontainment applications
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1002 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: Functional homolog of the protein sequence given in SEQ ID NO 50232
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 1073 in the 10/374,780 US patent application
  misc_feature: The sequence is a functional homolog of SEQ ID NO 442 in the 10/412,699 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 1010 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1004 in the 11/435,388 US patent application
  misc_feature: The sequence is a functional homolog of SEQ ID NO 836 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 1917 in the 10/374,780 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 824 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 58 in the 10/666,642 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 271 in the 11/479,226 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 569 in the 10/374,780 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1681 in the 10/374,780 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: Functional homolog of the protein sequence given in SEQ ID NO 50480
  misc_feature: Useful for making plants with modulated low light sensitivity
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 794 in the 11/435,388 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1565 in the 10/374,780 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 1692 in the 11/479,226 US patent application
  misc_feature: The sequence is a functional homolog of SEQ ID NO 1564 in the 10/374,780 US patent application
  misc_feature: The sequence is a functional homolog of SEQ ID NO 1563 in the 10/374,780 US patent application
  misc_feature: The sequence is a functional homolog of SEQ ID NO 126 in the 10/412,699 US patent application
MGREAAAAARPKLRRGLWSPEEDEKLYNHIIRYGVGCWSSVPKLAGLERCGKSCRLRWINYLRPDLKRGSFSQQEEDLIISLHKILGNRWSQIASQLPGRTDNEIKNFWNSCIKKKLRQRGIDPATHKPLEDDAAAAAANSGEAPRDDCNKLLPATADDHCGFAMGG

SEQ ID NO: 19529 - DNA, 766 bp, Panicum virgatum
  misc_feature: Ceres CLONE 1806004
  misc_feature: Encodes the peptide sequence at SEQ ID NO. 19530
atccagtattccagtcctcaatccgtcgagaaattctcgcgagcgatcgaaatctacgcgaagcgaagaggcctccccagatcctctcaagatgcagatctttgtgaagaccctcaccggcaagaccatcacgttggaggtggagtcatctgacaccattgagaatgtgaagggcaagatccaggacaaggagggcatccccccggaccagcagcgtctgatcttcgctggctagcagctggaggatggccgcaccctggcggactacaacatccagaaggagtccaccctccacctggtgctccgcctgcgtggtggtatgcagatctttgtgaagaccctcaccggcaaaacyatcaccttggaggkggagtcttctgacaccatcgacaaygtgaaggcgaagatccaggacaaggagggcatcccgccggaccagcagsgtctgatsttcgccggcaagcagctggaggatggccgcaccctggcagactacaacatccagaaggagtccaccctccmcytggtgctccgtctccgtggtggacagtaagtccatggagctgctgttgtccgtgggttcacaagtctggtgccttgccttgtctctccaatggtgattgcctgcgtgtccttgtcatgcctgtctgatgtgagttttatgtcatctggttgtgttttgtgaacacttaactgctgctgtgcagcagtttggttgaactatgtaatgaataagtgagccctgaagttactatggtaatcttgc

SEQ ID NO: 19530 - protein, 47 aa, Panicum virgatum
  misc_feature: Ceres CLONE 1806004
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50597
  misc_feature: Useful for making plants with modulated cold sensitivity
  misc_feature: Functional homolog of the protein sequence given in SEQ ID NO 50134
  misc_feature: Useful for making plants with modulated flowering time
MQIFVKTLTGKTITLEVESSDTIENVKGKIQDKEGIPPDQQRLIFAG

SEQ ID NO: 19531 - DNA, 1172 bp, Panicum virgatum
  misc_feature: Ceres CLONE 1806006
  misc_feature: Encodes the peptide sequence at SEQ ID NO. 19532
atactctagccgagatcgctcgcccttcccctccccacttctcgtctccgcgcggcggcagcgaggaaatcgcgatggcctccacctacgggccgggcggcggcgccaagctgaggtgcgcggcgtcctcgtcggcggcagccccggcgcggcccgtcaaggcgccgcggttcatccagcacaagaaggaggccttctggttctaccgcttcatctccgtcgcctacgacaacgtcttcaacccgggccacttcactgagaacatgcgcgacgacgcgctcgagcccgccgacctctacagcagccacctcaaggtcgtcgacgtcggcggcggcacgggcttcaccacgctcgggatcgtcaagcacgtcgacccggagaaagtcacgctgctcgaccagtccccgcaccagctcgagaaggccaggcagaaagtggcgctcaagggggtcaccatcatggagggcgacgccgaggacctgcccttccccaccgacaccttcgaccgatacgtctccgccggcagcattgagtattggcctgatccacagagaggaatcaaggaggcatacagggtcctgaagtttggtgggacagcttgtgtgattggcccggtgtacccaaccttctggctgtcccgcttcttcgccgacatgtggatgcttttcccccaggaagaagagtatatcgagtggttcaagaaggctgggtttaaggatgtcaagctgaaaagaattggaccaaagtggtaccgtggtgtccggaggcatggcctgatcattggatgctctgtcacaggtgtgaagagagaacgtggagactcttctttggagcttggtccgaaagctgaggatgtcagcaaaccagtgaatccaatcaccttcctctttcgcttcctcataggaacaatatgtgctgcatactatgttctggtgcctatttacatgtggataaaaggacaagattgtgcccaaaggcatgccaatctgagtgaaggggacttagatgaaagcctgcaaggaagagagggtagccaatatctgaattaggcttctctatagtaggcgcttcctgtgtgttttgtattgtatttatctttcctcctgttatgtacttcttttactgttgttcctgtttgtgtgaatataattaatattattaatagtggcact

SEQ ID NO: 19532 - protein, 324 aa, Panicum virgatum
  misc_feature: Ceres CLONE 1806006
  misc_feature (82)..(177): Pfam Name: Methyltransf_11 Pfam Description: Methyltransferase domain
  misc_feature: SWISSPROT Homolog: EC 2.1.1.17 Phosphatidylethanolamine N-methyltransferase
  misc_feature: The sequence is a functional homolog of SEQ ID NO 16 in US patent 7262339
  misc_feature: Functional homolog of the protein sequence given in SEQ ID NO 50371
  misc_feature: Useful for making plants with altered tocopherol content
MASTYGPGGGAKLRCAASSSAAAPARPVKAPRFIQHKKEAFWFYRFISVAYDNVFNPGHFTENMRDDALEPADLYSSHLKVVDVGGGTGFTTLGIVKHVDPEKVTLLDQSPHQLEKARQKVALKGVTIMEGDAEDLPFPTDTFDRYVSAGSIEYWPDPQRGIKEAYRVLKFGGTACVIGPVYPTFWLSRFFADMWMLFPQEEEYIEWFKKAGFKDVKLKRIGPKWYRGVRRHGLIIGCSVTGVKRERGDSSLELGPKAEDVSKPVNPITFLFRFLIGTICAAYYVLVPIYMWIKGQDCAQRHANLSEGDLDESLQGREGSQYLN

SEQ ID NO: 19533 - DNA, 955 bp, Panicum virgatum
  misc_feature: Ceres CLONE 1806026
  misc_feature: Encodes the peptide sequence at SEQ ID NO. 19534
gcaccgcaccgcacgcagcagtgtcaccgaggtagacgacgaagcagtgggatctggggatctctccccgcagcagtgtcaccgagggtttggaggagaagaaatcctggatccatagagtccgttcgcgggggcaccatgagctcggcgcaagatccgttctacatcgtccgggaggagatccaggactcgattgataaactgcaaagcaccttccaccgctggcagcaaactgcttccaacacaggagaatatgttcacctcacaaaggagtttcttaccagctgtgaaagcattgagtggcaggtagatgagctggaaaaggcaatcactgttgcatcacgggatccagcatactatggacttgatgaggtcgagctttctagacgaaaaaactggactggttctgcccgtaatcaggttggtacagtcaggagagctgttgaaaaggggaagagcaattcagcaacttcaaaataccaggacacaaacaggactaacctctattctgcccaagacaatgatgacttcatttcttcagaatcagatagacagcagctactcatgaggcagcaggatgaagaacttgatgagctcagtgcgagtgtccagaggattggtggtgtagggctaaccatacacgaagagctgtctggacaggaaaggatcttaaacgacctaagcttggagatggagactacttccaaccgacttgattttgtgcagaaaagagtggccatggtgatgaagaaggctggcatcaaggggcagattatgttgattgcgttcctggtcgttctattcattattctcttcgttttggtgttcttgacatagccacaagggcaccagaggcatcagtttctcccatctgtggtatctgcttttgtgtaatgtgtggtgaaacctcagtatacgagctacgcatcctttataaatcaggtttttttcttgc

SEQ ID NO: 19534 - protein, 232 aa, Panicum virgatum
  misc_feature: Ceres CLONE 1806026
  misc_feature (6)..(99): Pfam Name: Syntaxin-6_N Pfam Description: Syntaxin 6, N-terminal
  misc_feature (145)..(207): Pfam Name: SNARE Pfam Description: SNARE domain
MSSAQDPFYIVREEIQDSIDKLQSTFHRWQQTASNTGEYVHLTKEFLTSCESIEWQVDELEKAITVASRDPAYYGLDEVELSRRKNWTGSARNQVGTVRRAVEKGKSNSATSKYQDTNRTNLYSAQDNDDFISSESDRQQLLMRQQDEELDELSASVQRIGGVGLTIHEELSGQERILNDLSLEMETTSNRLDFVQKRVAMVMKKAGIKGQIMLIAFLVVLFIILFVLVFLT

SEQ ID NO: 19535 - DNA, 1446 bp, Panicum virgatum
  misc_feature: Ceres CLONE 1806033
  misc_feature: Encodes the peptide sequence at SEQ ID NO. 19536
aacacgaacgaaaccaaacgtccggaatggccaccaccaccccatccctccgctcccgcctcctcatcctcccaccgccgccggcgtccaccaccgccgtctccctccgtttccgcccatgcgcctccgtactcccctcctcttcccggaggaggaacctccgcctcgcggcacgtgcggcgccgcccggcggcgcggtggcccctgcgtcgtcgtcgtcggcaccggcggcggaggaggagaaggatgggaacggcgggggcgaggggctgtcggcggccgacgcggagaggctgtgcgagttcctccgcgccgacctgccgcacctgttcgacgacgtgggcatcgaccggtccgcgtacgacgaccgcgtgcggttccgtgaccccatcacccggcacgacaccatcgacggctacctcctcaagctcctcttccgccccgacttctacctccacgccgtgaagcagacagggccgtacgagctcaccacgaagtggaccatggtgatgaagtttatgctcctgccgtggaagccggagctggtcttcaccgggctgtcgatcatgggcctcaacccgcagaatctcaagttcaacagccatgtggatctttgggattcgatcaaaaataatgaatacttctctttcgaaggattatgggatgttttcaagcagctacggttttacaagaccccggacatagaaacaccaaattaccttattctaaagaggacgacacattatgaggttagaagttattcaccattcttaatagttgaagcaaaaggagataaactgacaggatcttcaggattcaataatgtaactggatatatatttggcaagaatgcttcatctgaaaagattccgatgactacacctgtcttcactcaagcttctgatggcacactttcagatgtatccatccagatagttctgccgatgaacaaagacttgaacagtttaccagctccaaatacagaagcggttactttgcggaaggtagaaggaggcattgttgcagtaaaaaaattcagtggacgaccaaaagaagaaattgtgctccagaaggaaaaggatctacgctcccaattacttaaagatggattgaagcctcaacaaggctgtttgcttgcacgttataatgatcccaggacaaagagcttcctaatgaggaacgaggtgctgatacggctaaataagttcacactggagttgtaatcatcatagctggcaacagatttatgtaacactaggctttgggcttggatatttcagcgcatcattagaaagggcaaatcttgttaacgggtggatgtgctttatgtaaatgtgaaattctgaaaggtaataagctacatgataaaacaatagatcactctattatgtttatacaccagattttgaattgacagaaaaaagtattagaatgaaggtagatcag

SEQ ID NO: 19536 - protein, 398 aa, Panicum virgatum
  misc_feature: Ceres CLONE 1806033
  misc_feature (225)..(392): Pfam Name: SOUL Pfam Description: SOUL heme-binding protein
MATTTPSLRSRLLILPPPPASTTAVSLRFRPCASVLPSSSRRRNLRLAARAAPPGGAVAPASSSSAPAAEEEKDGNGGGEGLSAADAERLCEFLRADLPHLFDDVGIDRSAYDDRVRFRDPITRHDTIDGYLLKLLFRPDFYLHAVKQTGPYELTTKWTMVMKFMLLPWKPELVFTGLSIMGLNPQNLKFNSHVDLWDSIKNNEYFSFEGLWDVFKQLRFYKTPDIETPNYLILKRTTHYEVRSYSPFLIVEAKGDKLTGSSGFNNVTGYIFGKNASSEKIPMTTPVFTQASDGTLSDVSIQIVLPMNKDLNSLPAPNTEAVTLRKVEGGIVAVKKFSGRPKEEIVLQKEKDLRSQLLKDGLKPQQGCLLARYNDPRTKSFLMRNEVLIRLNKFTLEL

SEQ ID NO: 19537 - DNA, 1099 bp, Panicum virgatum
  misc_feature: Ceres CLONE 1806035
  misc_feature: Encodes the peptide sequence at SEQ ID NO. 19538
ctcccgcccgcccggccccatcgatcctgcctgccgatcgagaggtctggtttcttgctcggttgctccgtcatgactggacctgcggaggaggcgcccgccgccgcttcgccgccggcgccggcctcgccgccggacagcatcacggaggaggcgccggcggcgaggtcccgggggttctggctcctcggggaggacaagtccgtgcacagggccctcggtgggggtaaaactgctgatgtactgttgtggaaagacaagaagacctctgctgcagtagtcggtggtgcaactatcctttgggttctgttcgaagttgtcgaataccatctcctgactctggtatctcatgtgctgattgttgcactgacgatcttgttcctctgggctaatgcaactgtcttcatcaataagagtcctcctaatgttcctgaagtgcagatatctgaagagcttgctgtgaacattgcccttaggctgcgtgcagacatcaacaaagcgcttggcttgcttcgggagattgctatgggccatgacctgatgaagttcctaggagtgatcgttgcactctggattctctcggaagttggagagctctgtgatctcctgagactgatgtacattgtggtcctgattctccacacggtgccgatactgtaccacaagtaccaggaccaggtggacgatttcgctgcgaaggcacacgcggagctctgcaagcagtacaaggtcctggacgccaaggtcctgagcaagattcccagggctccactgaaagacaagaagcaaaactagaacgaggatcaaatcagtggacctggaggacgacacgcgacttgtctaggttctgatgggctgtacatattttctgtttggttagtatctattgtcttgtcaataattgtgtggtgagaatctgtagaaaatagtggtatgatatggatggtggtttggtttgatgggcgagtacacgagtgcatattttctgtttggttgatctcagatgttctaccagctagtatctaatctgactgtagttgtgaagatagatcgtatatataactatgttcgatgtgtcctggttacctccttcgatttc

SEQ ID NO: 19538 - protein, 240 aa, Panicum virgatum
  misc_feature: Ceres CLONE 1806035
  misc_feature (54)..(237): Pfam Name: Reticulon Pfam Description: Reticulon
MTGPAEEAPAAASPPAPASPPDSITEEAPAARSRGFWLLGEDKSVHRALGGGKTADVLLWKDKKTSAAVVGGATILWVLFEVVEYHLLTLVSHVLIVALTILFLWANATVFINKSPPNVPEVQISEELAVNIALRLRADINKALGLLREIAMGHDLMKFLGVIVALWILSEVGELCDLLRLMYIVVLILHTVPILYHKYQDQVDDFAAKAHAELCKQYKVLDAKVLSKIPRAPLKDKKQN

SEQ ID NO: 19539 - DNA, 965 bp, Panicum virgatum
  misc_feature: Ceres CLONE 1806040
  misc_feature: Encodes the peptide sequence at SEQ ID NO. 19540
ctctttctcgttttccggcggcggcggagatggcggcgaacctggaggacgtgccgtcgctggatctgatgcacgagctgctccgccgcatgaagtgcagctccaagcccgacaagcgcctcatcctcatcggaccacccggctctggaaagggaactcagtctccccttattaaggatgaatattgcctgtgccatttagccactggtgatatgctgagggctgcggtggctgcaaagactcctctaggaatcaaagctaaagaagctatggacaagggagagcttgtttccgatgacttggttgtggggatcattgatgaagccatgaagaaaccctcatgccagaaaggtttcatccttgatggcttccctagaactgtcactcaagcacagaagcttgatgagatgttggcaaagcaaggtgctaatgttgacaaggtcctgaacttcgcaattgatgatgctatattggaagaacggattactggtcgctggatccacccagcgagtggtaggacttaccatacaaaatttgcacctccaaaggctccgggagttgatgatgtcactggagagccattgattcagaggagagatgatacagctgaggtcttgaagtcaaggcttgaagccttccacagacaaactgagcctgtgattgattactactccaagaagggtttagtggcgaacttgcctgcggagaaaccaccaaaggaagtgactgttgaggtgcagaaagctctctcatgatgaagtatccgttcttgagcttaagcatgatgacatgtaccaaagtccctagttggggttccttcaaagtttatactgatgccgacatcctgcggtttccattttcaatttttcatttgtgcatctgcaccattttatcacagctttgacaagctcgggaattgtttgaataatttctgtttcaaatgagggaagctgttttttggaact

SEQ ID NO: 19540 - protein, 241 aa, Panicum virgatum
  misc_feature: Ceres CLONE 1806040
  misc_feature (33)..(219): Pfam Name: ADK Pfam Description: Adenylate kinase
  misc_feature (155)..(190): Pfam Name: ADK_lid Pfam Description: Adenylate kinase, active site lid
  misc_feature: SWISSPROT Homolog: EC 2.7.4.3 Adenylate kinase
MAANLEDVPSLDLMHELLRRMKCSSKPDKRLILIGPPGSGKGTQSPLIKDEYCLCHLATGDMLRAAVAAKTPLGIKAKEAMDKGELVSDDLVVGIIDEAMKKPSCQKGFILDGFPRTVTQAQKLDEMLAKQGANVDKVLNFAIDDAILEERITGRWIHPASGRTYHTKFAPPKAPGVDDVTGEPLIQRRDDTAEVLKSRLEAFHRQTEPVIDYYSKKGLVANLPAEKPPKEVTVEVQKALS

SEQ ID NO: 19541 - DNA, 1223 bp, Panicum virgatum
  misc_feature: Ceres CLONE 1806058
  misc_feature: Encodes the peptide sequence at SEQ ID NO. 19542
aaaaaccgtcaccgaacaaaccccaccgccgccgtgcccccgccccccgagccaggaaaccacccgcccgcccgccatggcgttccggctgagcaacaacctcatcggcatcctcaacttcgtcaccttcctgctctccatcccgatcctcggcgccggcatctggctgggccaccgcggcgacgacaccgagtgcgcgcgctacctcgccgcgcccgtcatcgcgctcggggtcttcctcctcgtcgtctccctcgcggggctcgtcggcgcctgctgccgcgtcacctggctgctctgggtctacctcctcgccatgttcgccctcatcctcgccctcttctgcctcaccgtcttcgccttcgtcgtcaccaaccgcggcgccggggaggccgtctccggccgcggctacaaggagtaccgcctcggggactactccagctggctgcagaagcgcgtggagagcaccaagaactggaacaggatcaggagctgcctccaggactccaaggtctgcaagagcttgcaggacaagagggagacgttcgccgacttcatccgctccgacctctcacccatccagtccggctgctgcaagccccccaccagctgcaacttcacctacgtgaacggcacggactggaccaagacccccacgatcagcccgacggcggacccggactgcagcacctggagcaacgaggcgctctgctacgactgccagtcctgcaaggccggcgtggtggccaccttgaagcgggactggaagcgcgttgccgtcgtcaacatcgtcttcctcgtcttcatcatcatcgtctactccgtcggctgctgcgcgttccggaacaaccgcagggacaacgcctaccgcagcggcggctggaagggcggctccgcctgatctcccggtctcgccggagccgagagccactgctgctgctcgactggttgccgtcgtcgtgcacgatgatcagcgctctgctagctctctctcgctgtcctgcggtcgttgtcgtcctattcgtctaagctcgatctagctctgtacaggcgagattactacggactcttgtcatctggtagttacctttattatgatctctgatcagcacagcaggtaggttttgtacatgctgttagttgattcattcgacacaccgctatatattcgtatatgcatgtctttattctacatatgttattttggttcagaagttttcctt

SEQ ID NO: 19542 - protein, 274 aa, Panicum virgatum
  misc_feature: Ceres CLONE 1806058
  misc_feature (5)..(244): Pfam Name: Tetraspannin Pfam Description: Tetraspanin family
  misc_feature: Functional homolog of the protein sequence given in SEQ ID NO 50853
  misc_feature: Useful for making plants with modulated nitrogen use efficiency
MAFRLSNNLIGILNFVTFLLSIPILGAGIWLGHRGDDTECARYLAAPVIALGVFLLVVSLAGLVGACCRVTWLLWVYLLAMFALILALFCLTVFAFVVTNRGAGEAVSGRGYKEYRLGDYSSWLQKRVESTKNWNRIRSCLQDSKVCKSLQDKRETFADFIRSDLSPIQSGCCKPPTSCNFTYVNGTDWTKTPTISPTADPDCSTWSNEALCYDCQSCKAGVVATLKRDWKRVAVVNIVFLVFIIIVYSVGCCAFRNNRRDNAYRSGGWKGGSA

SEQ ID NO: 19543 - DNA, 1247 bp, Panicum virgatum
  misc_feature: Ceres CLONE 1806059
  misc_feature: Encodes the peptide sequence at SEQ ID NO. 19544
aggcaaggcacgcactctgcctgcacacaagcgtctgctgctccgtcgtcttcctcgcctcttctccaaccgttcgaccccgcaaggtgccagaagtgatcgactgcaggtatgggcaacttgtgctgctgtgttcaagttgatcagtcaaccgtggccatcagggagcagtttggcaagtttgacagcgtgcttgagccaggatgccactgcttgccttggttcatcggcaagcgtgtagctggtcatctcacactcaggctgcagcaactggatgtgcgctgtgagaccaagactaaggacaatgtctttgtgaacgtcgtggcatctattcagtaccgtgctctggctggcaaagcaagtgatgcgttctacaaactgagcaacacaaggtcccagatccaagcatacgtctttgatgttatccgagcaagcgttcccaagctcattttagatgacgctttcgagcagaaggatgagatcgcaaaggcagtggaggaggaactcgagaaggccatgtcagcttacggctttgagatcgtgcaaactctgattgtggacattgagccagatgagcacgtgaagcgcgcaatgaatgagatcaacgcagcggcgaggctgagggtggctgcgaacgagaaggccgaggcggagaagatcgtgcagatcaagcgcgcggagggtgaggcggaggccaagtacctgtccgggctgggcatcgcccgtcagcggcaagcaatcgtggatgggctgagggacagtgtgctgggcttctccgtgaacgtgcctggcaccaccgccaaggacgtgatggacatggtgctcatcacccagtacttcgacaccatgaaggagatcggcgcgtcatccaaggcctcatcggtgttcatcccgcatggccccggcgcagtgcgcgacatcgccacgcagatccgcgacggcctcctgcagggctcctccgtctcccaccactagtctgctggttctggagcagcgtggatgcggattcattcagtcgcagggaaggagattgcttagctatatgcttgccactcagtcagaccagtatgatgcctgtctatattgctcgtgtgtttctgcggagtatggagtgatttcagtgtggaaccataaattataacactcttcagtattacctgctactcctagggtgcttggggatcggagaaccttatctaaccttttataagtggtaatatgaacataaggcagcatgagtttgcagt

SEQ ID NO: 19544 - protein, 287 aa, Panicum virgatum
  misc_feature: Ceres CLONE 1806059
  misc_feature (8)..(182): Pfam Name: Band_7 Pfam Description: SPFH domain / Band 7 family
MGNLCCCVQVDQSTVAIREQFGKFDSVLEPGCHCLPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVSHH

SEQ ID NO: 19545 - DNA, 1127 bp, Panicum virgatum
  misc_feature: Ceres CLONE 1806062
  misc_feature: Encodes the peptide sequence at SEQ ID NO. 19546
acacggcgtctttgtgtgagcacaccgcgcggcgagcgaagaaagggggaagaagcagccaacgagctttttgcttttgggtttctcatccgagcagcggcggcggcgtcggcggagaagagagaagagcgggggcggcatggctgagcacaaggaggagtcggtgatggataagatctccgacaagttccacggcggggactcctcgtcgtccgactcggacgacgagaagaagaaggggtcctcgtcggcggcgccgtcggcggaggccgtgaaggccaagatctaccgcctcttcggccgcgagagacccgtccactccgtcctcggtggcggcaagcctgctgatcttgtcctatggaggaacaagaagatctctggcggtgtccttgctggtgccactaccatctggctcctgttcgaggtcatggagtaccatctcctcaccttggtgtgccactgcctcatcctctcgctggccatccttttcctgtggtccaatgcctccactttcatcaacaagtctccaccaaacattcctgaggtgaaaatcccagaggatgcggccgttaacgttgctctcacactgagatatgagatcaacaggggcttcgctaccttgagggagattggacatggccgtgatcttaagaaattcctaattgttatagcaggtctctggcttctttcagttcttgggagctgctgcaatttcctgacattatcttacattgtcttcatggtgctgtacactgtcccagtagtgtatgagaagtatgaggacaagattgatgcttttggtgagaaggctatgattgaacttaagaagtactatgccatcttcgacgagaaatgcctatcgaagattcctaagggtcctctgaaagataagaagcactagatttgtagtaaggctcttgctatgaatatgataaatgactaccaatcaccttctgttatggaaggatggcttttggtccaagtcagttgatagtatatatatctgtatgggcaactctagtgtgactgattgttgtgctgctgatatttgaagtcatgtcggctgaaaattgttcatcttgttttggtttcaattttcagcatagttgctctatctggaagcttgg

SEQ ID NO: 19546 - protein, 253 aa, Panicum virgatum
  misc_feature: Ceres CLONE 1806062
  misc_feature (68)..(251): Pfam Name: Reticulon Pfam Description: Reticulon
MAEHKEESVMDKISDKFHGGDSSSSDSDDEKKKGSSSAAPSAEAVKAKIYRLFGRERPVHSVLGGGKPADLVLWRNKKISGGVLAGATTIWLLFEVMEYHLLTLVCHCLILSLAILFLWSNASTFINKSPPNIPEVKIPEDAAVNVALTLRYEINRGFATLREIGHGRDLKKFLIVIAGLWLLSVLGSCCNFLTLSYIVFMVLYTVPVVYEKYEDKIDAFGEKAMIELKKYYAIFDEKCLSKIPKGPLKDKKH

SEQ ID NO: 19547 - DNA, 661 bp, Panicum virgatum
  misc_feature: Ceres CLONE 1806064-R
  misc_feature: Encodes the peptide sequence at SEQ ID NO. 19548
ccgtccaagtggacccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctggagagctcggcgccagtggtggacgggaagcagtactacagcgtgtccgtgctgaccaggacggcggacggcgacgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcataagcagtgcacgcatcatctgtgtgccggaatttgtttcttttggttcagggatgcttacgtagatagaggttgggcatgcgtgtgcgctccggcctttgattgtacatgagaacaaagaccaaggagagctccatttcgtccctgcaaggattgatttctgctctcacgatgtttaagaactcctagtact

SEQ ID NO: 19548 - protein, 156 aa, Panicum virgatum
  misc_feature: Ceres CLONE 1806064-R
  misc_feature (1)..(156): Pfam Name: PsbP Pfam Description: PsbP
  misc_feature: Functional homolog of the protein sequence given in SEQ ID NO 50254
  misc_feature: Useful for making plants with altered lignin content
  misc_feature: Useful for making plants with modulated nitrogen use efficiency
PSKWTPSKEREFPGQVLRYEDNFDANSNVSVIVQPTTKKTITDYGSPEEFLAQVDYLLGKQAYAGKTDSEGGFETDAVATANILESSAPVVDGKQYYSVSVLTRTADGDEGGKHQLITATVSDGKLYICKAQAGDKRWFKGARKGVEKAASSFSVA

SEQ ID NO: 19549 - DNA, 426 bp, Panicum virgatum
  misc_feature: Ceres CLONE 1806064
gtctagactctagaggagacagtcgcaggaggccaggagaagcagccggcgagcagcaagccatggcgtccaccacctgcttcctccaccagtccaccgcccgcttcggcgccgccgccgcctcggcgcgcccccaggggccgcgggcccagcacctcgggtgcagggcgcataatccgccggacgccgccgccgagggcgacgccgcgatcgcccgacgcgccccactctcgctactcggaggcgccgccgccggcggaccccaggtgaacccagccgccggctcctattgatacgcagccaactgtgttcgggaagcccaataggaacccggaattcctcgcctaccggcgacacgggttgcagctgctgacctcgaccaactgctaaccccagcaaggaacgagtgttctccgggcggttgct

SEQ ID NO: 19550 - DNA, 1119 bp, Panicum virgatum
  misc_feature: Ceres CLONE 1806074
  misc_feature: Encodes the peptide sequence at SEQ ID NO. 19551
gctcttcgctctagcttggttccgtgctgatctttactagtagtggttgcctggtgtcgagaggaagcccccggagcacgggaggccggggagcttctcgaggagcgaggggcgcggccatgaggatccagtgcgacgcgtgcgagggcgcggcggccacagtggtgtgctgcgcggacgaggcggcgctgtgcgcgcgctgcgacgtcgagatccacgccgccaacaagctcgccggcaagcaccagcgcctcccgctcggcggcggcgccggcgccggcggggacgtcccgcgctgcgacgtctgccaggagaagccggccttcatcttctgcgtcgaggacagggcgctcttctgccgagactgcgacgagcccatccacgtccccggcacgctctcggggaaccaccagcgctacctcgccaccggcatccgcgtcggcttcagctccgtctgcggcgccggcgccggcgccgacgtccttccgccgcctaagggcagctcaaagcccgcggctgccgccgggtccgctaaggcgccggccagtaagcccgcgcagccgcaggaggtgccgtcgtcgccgttcctgccgccgtccgggtgggccgtcgaggacctcctgcagctctccgactacgaatccagcgacaagaaggactcgcctctcgagttcaaggagctggagtggttcgcggacatcgacctgttccacggccacgcgccggccaaggccacgacggccgaggtccccgagctcctcgccacgccgcagccggcgagcaacgcggggttctacaagacgagcggtgcgcgccagagcaagaagccgcgggtggagctgcccgacgacgaggacgacttcttcatcgttcctgatcttggctgagacgtaaaagtcttctcatggttcccctcatcccctgtcatgtgatgtgtatgtatgcaaagtatgtgtgtatgcactgatcgcttacgctgggcttatgtaattataaggcagtttggggccggtactttcagcctgaaaattgagatgggtttgatgtctgagatgaactcacttggagcagatgttcttatgttcgagtacgactctatcagatccttaccagttatat

SEQ ID NO: 19551 - protein, 255 aa, Panicum virgatum
  misc_feature: Ceres CLONE 1806074
  misc_feature (1)..(47): Pfam Name: zf-B_box Pfam Description: B-box zinc finger
  misc_feature (55)..(102): Pfam Name: zf-B_box Pfam Description: B-box zinc finger
  misc_feature: The sequence is a functional homolog of SEQ ID NO 465 in the 11/479,226 US patent application
MRIQCDACEGAAATVVCCADEAALCARCDVEIHAANKLAGKHQRLPLGGGAGAGGDVPRCDVCQEKPAFIFCVEDRALFCRDCDEPIHVPGTLSGNHQRYLATGIRVGFSSVCGAGAGADVLPPPKGSSKPAAAAGSAKAPASKPAQPQEVPSSPFLPPSGWAVEDLLQLSDYESSDKKDSPLEFKELEWFADIDLFHGHAPAKATTAEVPELLATPQPASNAGFYKTSGARQSKKPRVELPDDEDDFFIVPDLG

SEQ ID NO: 19552 - DNA, 891 bp, Panicum virgatum
  misc_feature: Ceres CLONE 1806081
  misc_feature: Encodes the peptide sequence at SEQ ID NO. 19553
aatccccccgccccccccccccccccgactcgccccgcgccctttggatttcgccggattcgatgaagaagatcttcggcgccaagaagaacaaggacccgccgcccaccatcgaggacgcaaccgaacgaatcaccaagcgcggcgacaccgtcgatgagaagatcaagaagctcgatgccgagctcgcgcgctacaaggagcagatcaagaagacgcgcccgggccccgcgcaggaggccgtcaaggcacgggccatgagggtcctcaagcagcggaggatgtatgaaggacagcgtgacatgctgtacaaccaaacatataatcttgaccaagttgcttttgcagcggagggacttaaagatgctcaacaaactatgactgcaatgaaggctgccaacaaagagctgaaaggaatgatgaaaactgtcaagctcgaagatatagatagcatgcaagatgagatgatggatcttatggacgtgagcaatgagatacaagaaactcttggtagaagctacaacgtccctgatgatattgacgaggaagaacttatgggtgaacttgatgctctggaagctgatatggactttgaatcagagtcagtcccatcttaccttcaaccggatcaagaatctgaactcaacttacctgctgcaccaactggccatgcagcagccccaccacaccagcagcaggaggatgaactgggattgcctacagttccccaagcatccattcgtacataggcacggatcttgatcaggattgaatgaatatccacagttgaatgtaactttttttttgttatgtaccgctatgatttgtggatggtgtaaatttgattgaattggattcgtcgggacataataagcaatagcatcctcgtgt

SEQ ID NO: 19553 - protein, 228 aa, Panicum virgatum
  misc_feature: Ceres CLONE 1806081
  misc_feature (12)..(204): Pfam Name: Snf7 Pfam Description: Snf7
MKKIFGAKKNKDPPPTIEDATERITKRGDTVDEKIKKLDAELARYKEQIKKTRPGPAQEAVKARAMRVLKQRRMYEGQRDMLYNQTYNLDQVAFAAEGLKDAQQTMTAMKAANKELKGMMKTVKLEDIDSMQDEMMDLMDVSNEIQETLGRSYNVPDDIDEEELMGELDALEADMDFESESVPSYLQPDQESELNLPAAPTGHAAAPPHQQQEDELGLPTVPQASIRT

SEQ ID NO: 19554 - DNA, 945 bp, Panicum virgatum
  misc_feature: Ceres CLONE 1806090
  misc_feature: Encodes the peptide sequence at SEQ ID NO. 19555
ctcgattagtccttgctttgcttgctgctgcttgtatatatcctcgtccggcttgcttcaactctcatcttcccactcttattagctccttcttcgatccattgctgggataacgcaagctaaggtgacccgggaggaatgtcgtcggcccagatcgcgccgccgccggagcatgtgtgctacgtgcactgcaatttctgcaacacaattctcgcggtcagtgtcccgagcaatagcatgctgaacatcgtgacagtccgttgtgggcattgcactagcctgctgtcagtgaacttgataggactgatccaatcacttcctgtccagaatcactcacagttggtgcaggagaatttcaaggttcacaatattcacaatatcagctttactgaaaactactctgagtatgctccttcgtcttcaaaattccggatgccaatgatgttctcagcaaaaggagatcaggatcatatgctgcacgtgcgtgctctagagaagcggcaacgtgttccatcagcatacaatagatttattaaggaagagatacggaggattaaagcaagcaaccctgccataagtcatagagaagcattcagcactgcagcaaagaattgggcacattttccaaacatacattttggcctagggacccatgaaagcagcaagaagcttgatgaggccattggtgcggcaggtggtccccagaaagtccaagatctctactagagacctgcaacacccatcttgattccgtgttgtaagtaattttagaaaagaaaactatcttaattccaaatccatttgcaagtggtgtacatatataggtaagtgatatcatggataaataaagaataagacatatatatgtacgagaacataatgctactggctctttcaccaggactgcatagggacctcatcatgttgttatttaatactggattg

SEQ ID NO: 19555 - protein, 195 aa, Panicum virgatum
  misc_feature: Ceres CLONE 1806090
  misc_feature (4)..(169): Pfam Name: YABBY Pfam Description: YABBY protein
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSSAQIAPPPEHVCYVHCNFCNTILAVSVPSNSMLNIVTVRCGHCTSLLSVNLIGLIQSLPVQNHSQLVQENFKVHNIHNISFTENYSEYAPSSSKFRMPMMFSAKGDQDHMLHVRALEKRQRVPSAYNRFIKEEIRRIKASNPAISHREAFSTAAKNWAHFPNIHFGLGTHESSKKLDEAIGAAGGPQKVQDLY

SEQ ID NO: 19556 - DNA, 1070 bp, Panicum virgatum
  misc_feature: Ceres CLONE 1806099
  misc_feature: Encodes the peptide sequence at SEQ ID NO. 19557
gatccctctctcgcgagccctctaggtttccagccgcccgcggtgagaagaggggagggagtcgccatggcggacgacgagcaggtggagaggaaggaggaggtcgccgagcttgctccttttgatccgaccaagaaaaagaagaagaagaaggttgtgatccaagacccgtctgatgaagtggataagttggctgataagacagagagtttggcagtttctgagtctagtgagccaagctttgcaggaatgaaaaagaagaagaagaaacatgtggaacttgatccttctcttactgaagttggagatggtgatgatcctggagatgatcaagctggagaggatgaagaaggagaagggattgtgcttggtggtgctgctgccaccagatacccttgggaaggaactgacagagattataaatatgaagagctacttggcagagtattcaatattctgcgtgagaacaacccggatcttgccggtgatagaagaagaactgttatgaggccccctcaagtcctcagggaaggaacaaaaaagacagtttttgttaacttaatggacttgtgcaaaacaatgcataggcaaccagaacatgtgatgatgttcttgcttgctgagatgggaacaagtggatccctcgatgggcaacaaaggttggttatcaaaggaagatttgcgccaaaaaattttgaagcaatactcaggagatatatcaatgaatatgtcatatgcaatggatgcaagagtccggataccattctttctaaggagaacaggctgttcttcctccgttgtgagcagtgtggttcgtcgaggtcagttgctcccatcaaggctggattcgtcgcccaggttggccgtcgtaaggctggagcttaagttacctcgcaccgtctggatactctcttcccgaaacagctcaatgaaaactagtttgttggttgacaagaattgttccgttttccgttgtgcctacaccgtttactggttttcttctgttcaccatacttgggttgctgctgtgaattttataatttatatgagaggatttatgcttgcggctc

SEQ ID NO: 19557 - protein, 272 aa, Panicum virgatum
  misc_feature: Ceres CLONE 1806099
  misc_feature (126)..(253): Pfam Name: eIF-5_eIF-2B Pfam Description: Domain found in IF2B/IF5
MADDEQVERKEEVAELAPFDPTKKKKKKKVVIQDPSDEVDKLADKTESLAVSESSEPSFAGMKKKKKKHVELDPSLTEVGDGDDPGDDQAGEDEEGEGIVLGGAAATRYPWEGTDRDYKYEELLGRVFNILRENNPDLAGDRRRTVMRPPQVLREGTKKTVFVNLMDLCKTMHRQPEHVMMFLLAEMGTSGSLDGQQRLVIKGRFAPKNFEAILRRYINEYVICNGCKSPDTILSKENRLFFLRCEQCGSSRSVAPIKAGFVAQVGRRKAGA

SEQ ID NO: 19558 - DNA, 669 bp, Panicum virgatum
  misc_feature: Ceres CLONE 1806107
  misc_feature: Encodes the peptide sequence at SEQ ID NO. 19559
cttgcccttgaatcctcaagaacctcccggcgacggagtgcgccgccaccgagcttctggaaccttttggaaggaagatagagaaacagaggttggtagttcttcagcaaagcctgagttgcacaaagaataaaataaaagaagaacatgaagagttgtggccaactaactcgcccccatatttaaggagttgctttgctaccttcttagaagatttagctccctctgcttcctacgcctctaaaccagactgctttgctcatctgcttctgctttgctcttcattttcagagcgaacttggtctaacgattcagaagcaaaggctgctcgtccgagttctaaaactgagaggctagttcctgaggagctctttttcgtcaagggcttgaccaacggcgataaagatgaaggggatcttcaaagggctgaagataatctctcagatgtttgtgcataaagaacatgagatggagatcgggtacccaacagatgtaaagcatgtggctcacataggtctgggcaccagtgacacatctccaagctggatggctgaattcaagggaacagaggatttgtcagcaggccctctgagcacagccgggcagtcaaggcagacttcttgggcctctgcagactttgagcagccaagaagcatgatgcccattgag

SEQ ID NO: 19559 - protein, 87 aa, Panicum virgatum
  misc_feature: Ceres CLONE 1806107
  misc_feature (23)..(68): Pfam Name: PBD Pfam Description: P21-Rho-binding domain
MKGIFKGLKIISQMFVHKEHEMEIGYPTDVKHVAHIGLGTSDTSPSWMAEFKGTEDLSAGPLSTAGQSRQTSWASADFEQPRSMMPI

SEQ ID NO: 19560 - DNA, 686 bp, Panicum virgatum
  misc_feature: Ceres CLONE 1806110
  misc_feature: Encodes the peptide sequence at SEQ ID NO. 19561
aagcatagtagtgtgcgactgcaacaagagctcactcactcttctgtgatctgtactgaaagtcctgaacgtgacaagctaagcagcgagaacgatggcggaagagtacggccgccgccgccatccgccatccgccggcgagatggcgctgtacctgctgttcgagtctgcctccggctacggcctcttccacgcgtacggcatcgatgagatcggccagagcgtggaagccgtgcggtcctccgtcctggacctcgaacgcttcggcaaggccgtcaagctcactgccttcaaccccttctcctccgccgtcgacgcgctcaaccagtgcaacgccatctccgaagggatcatgaccgatgagctgaggagcttcttggagttgaatctgcccaagcccaaggaggggaagaaggccaagtacagcctcggcgtcgtcgagccaaaggtcggctcccatatcgccgaggtcaccggcatcccctgccagagcaacgagttcgtccaggagctgctccgcggcgtccgtctccacttcgaccgcttcatcgaggagctcaaggagtcggacttagagaaggcccaactcggcctggggcatagctacagcagggccaaggtgaaagtcaatgtgaaccgtgttgacaacatggtgattcaggcaatctttctgttggatacacttg

SEQ ID NO: 19561 - protein, 197 aa, Panicum virgatum
  misc_feature: Ceres CLONE 1806110
  misc_feature (19)..(85): Pfam Name: NOP5NT Pfam Description: NOP5NT (NUC127) domain
MAEEYGRRRHPPSAGEMALYLLFESASGYGLFHAYGIDEIGQSVEAVRSSVLDLERFGKAVKLTAFNPFSSAVDALNQCNAISEGIMTDELRSFLELNLPKPKEGKKAKYSLGVVEPKVGSHIAEVTGIPCQSNEFVQELLRGVRLHFDRFIEELKESDLEKAQLGLGHSYSRAKVKVNVNRVDNMVIQAIFLLDTL

SEQ ID NO: 19562 - DNA, 673 bp, Panicum virgatum
  misc_feature: Ceres CLONE 1806110-R
  misc_feature: Encodes the peptide sequence at SEQ ID NO. 19563
caccagttgatttgattaatgtccagcaatttgcccaaaggggttatgaatctgtctgaataccgtaaaaacctttatgaatatcttgttactaagatgaatgatattgcaccaaatctgacgtcattgattggtgaagttgttggagctcgtctaatctctcattctggcagtctttcaaatcttgccaagtgtcctgcctccactctccaaattcttggtgctgagaaggcactcttcagagcactgaaaactcgagggaacacacctaagtatggccttatattccactcctccttcattggtcgtgcttcaaccaagaacaagggcagaatggctcgttaccttgcaaacaaatgctcgattgcgtcacgcattgattgttactcagaggcaagtacatctgtctttggccaaaaattgcgtgagcaagttgaggagagactggacttctatgacaagggtattgcgcctcgtaaaaaccttgatgttatgaaagctgctattaacagtatggtcaatggagcctcaattgatgatgatgataatgagaggactgatgcatctgccaagaaaagcaagaaaaagaagtccaaaactgaggctgatggcgatgcaatggaactggataagccttccaatactgatgacggtgaagccgagcctggaaccg

SEQ ID NO: 19563 - protein, 218 aa, Panicum virgatum
  misc_feature: Ceres CLONE 1806110-R
  misc_feature (1)..(149): Pfam Name: Nop Pfam Description: Putative snoRNA binding domain
MSSNLPKGVMNLSEYRKNLYEYLVTKMNDIAPNLTSLIGEVVGARLISHSGSLSNLAKCPASTLQILGAEKALFRALKTRGNTPKYGLIFHSSFIGRASTKNKGRMARYLANKCSIASRIDCYSEASTSVFGQKLREQVEERLDFYDKGIAPRKNLDVMKAAINSMVNGASIDDDDNERTDASAKKSKKKKSKTEADGDAMELDKPSNTDDGEAEPGT

SEQ ID NO: 19564 - DNA, 1503 bp, Panicum virgatum
  misc_feature: Ceres CLONE 1806123
  misc_feature: Encodes the peptide sequence at SEQ ID NO. 19565
ctctctcccctcaacccagcgcaacctcccgccgccgctagggtttctcctccccgccgctagggtttctcctcgcctcgccgcctcccccaaaatctccccaccggagcttctagagcctcgcgcggcccctccagcagccatgagcgacggcaaggactccctcgacctctccggcctcggcgccgccatccccaactcgaacgagctcagcgcggaggataaggctaacctcgtggcctcgatcaagaacacgctcgagggattggcgtcgcggcatatggacgtgctcgaaggcctcgaccccaaggtcaggaagcgtgtcgagaagctcagggagatccagggacaacacgatgaacttgaggcaaagtttttcgaggagagagctgcacttgaagctaagtatcagaagttgtatgaaccactttactcaaagcgttacgaaattgtcaatggtgtgatcgaggttgaggcagaaagtgcaggtgaaacccctgcagagcaaaaaagtggaggtgaaactccttctgagcaaaaagaagaaaaaggtgtgccagctttctggcttaatgcaatgaagaaccacgaaatcctggccgaggagatccaggagagggatgaggaagctctcaagtacctcaaggacatcaagtggtacaggatcagcgaacctaagggttttaagcttgagtttcactttgataccaatccattcttcaagaattcagtgctcacaaaaacatatcacatgattgatgaggatgaaccaattctagagaaagccattggtactgatattgaatggtatgctgggaagtgcttgacacaaaaggtgctaaaaaagaagccaaggaaggggtcaaagaacactaaacctatcacaaaaactgaagactgtgatagcttcttcaacttcttcagtccacctcaagtccctgatgatgaggaggaaattgatgaggatacagctgaacagttgcagaaccaaatggagcaagattatgatatcggatctaccatcagagacaagattataccacatgctgtctcatggttcactggagaggctgctcaagatgatgactttgagggccttatagatggtgatgaggacgattatgaagaagatgaagatgaagatgatgaggatgaggaaagtgaagatgatcatgatacaaagaagaccaagggagctgctggaggggatgggcagcagggtgaacgacctgcagagtgcaagcagcagtgaggcgctgcacattgaatttatgcatacagcgggttctggaatgatgaaagtttggttctgcttgatgcaatgtcattgagttggttgtggagcccttggaggggcgtgtgttggttttgtggaatcggtggggggattcttctgggacttggtatcgttttcatatgttggtagttttgtcacttatgtattgggtttcagatattatgtgctctgcttatgctttgagtggtcattgttgccagtctagt

SEQ ID NO: 19565 - protein, 369 aa, Panicum virgatum
  misc_feature: Ceres CLONE 1806123
  misc_feature (58)..(312): Pfam Name: NAP Pfam Description: Nucleosome assembly protein (NAP)
MSDGKDSLDLSGLGAAIPNSNELSAEDKANLVASIKNTLEGLASRHMDVLEGLDPKVRKRVEKLREIQGQHDELEAKFFEERAALEAKYQKLYEPLYSKRYEIVNGVIEVEAESAGETPAEQKSGGETPSEQKEEKGVPAFWLNAMKNHEILAEEIQERDEEALKYLKDIKWYRISEPKGFKLEFHFDTNPFFKNSVLTKTYHMIDEDEPILEKAIGTDIEWYAGKCLTQKVLKKKPRKGSKNTKPITKTEDCDSFFNFFSPPQVPDDEEEIDEDTAEQLQNQMEQDYDIGSTIRDKIIPHAVSWFTGEAAQDDDFEGLIDGDEDDYEEDEDEDDEDEESEDDHDTKKTKGAAGGDGQQGERPAECKQQ

SEQ ID NO: 19566 - DNA, 1243 bp, Panicum virgatum
  misc_feature: Ceres CLONE 1806137
  misc_feature: Encodes the peptide sequence at SEQ ID NO. 19567
actttccttcgccgcttccccaatcttcgattcgcttctcttctcctctcgagcgctgtggtttctccccatcgcgagctctctcttctccccccccttcccttcctcgagcgcggtttcggccatggcggcggcggcgcaggcggtcgcgaaggggagcgtggtgtcgccgagcggcaaccgggccgcgccggggctcctgggccggcggatggcgccatcggcggtgcggatcggggcgccctggaggaagaccgcgttcctcggcggcgggaggctggcggtcgggcccatgagatccaggtccgcgtcccggactctcgtcgcgtcgccggtgcagatgaacatgaaccttgcgattgggaaatccatgaggtggtgggagaaggggctgcagcccaacatgcgggaggtcgagtccgctcaggacctcgccgattcattggccaacgccggcgacaggctcgtcatcgtagacttcttctcccctggctgcggaggttgccgtgctcttcacccaaagatttgccagtttgcggagcagaatccggatgtgctgttcttgcaagtgaactatgaggagcacaagtctatgtgctacagcctccatgtccatgtcctacctttcttcaggttctacaggggagctcagggacgtctctgcagcttcagctgcaccaacgcaactatcaagaagttcaaggatgcccttgcaaagcacaaaccagatagatgtagcattggcccgactagggggctggaggaatcagagttattagcactggccgcaaacaaggacctgcagttcacctacaccaagaagccagaactgatccccagtggagatgctgctgcagaagtcattgctcccgagcctgtagagttcccagcggcaacaaagccgttcgtcaggctggggtccgaggagaggtccttggtctcatcaggaacataagatgcagggttatctttaggatgatcagatccttccattctgtacagttccgtggttgttcttgatgtgtacaggttgtagcatctcatgctagtagagcgcaggccatgatttttacatgtgaagcctgcccgcccgcctgtcctccggactccagtagtttagcaagtttgtattagcactttagcagtagcagactagcagagtggtgttgtggagcttctgcctcctgtaaggtagatgtgcgaatgaattcgtctgcatgctatttggttgcattttaaaatc

SEQ ID NO: 19567 - protein, 276 aa, Panicum virgatum
  misc_feature: Ceres CLONE 1806137
  misc_feature (96)..(199): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAAAQAVAKGSVVSPSGNRAAPGLLGRRMAPSAVRIGAPWRKTAFLGGGRLAVGPMRSRSASRTLVASPVQMNMNLAIGKSMRWWEKGLQPNMREVESAQDLADSLANAGDRLVIVDFFSPGCGGCRALHPKICQFAEQNPDVLFLQVNYEEHKSMCYSLHVHVLPFFRFYRGAQGRLCSFSCTNATIKKFKDALAKHKPDRCSIGPTRGLEESELLALAANKDLQFTYTKKPELIPSGDAAAEVIAPEPVEFPAATKPFVRLGSEERSLVSSGT

SEQ ID NO: 19568 - DNA, 1566 bp, Panicum virgatum
  misc_feature: Ceres CLONE 1806146
  misc_feature: Encodes the peptide sequence at SEQ ID NO. 19569
agagcagccaccgcgcccgcaccacctcgcacctggcatcaccaccagtagcagcagcagcagctagaacagcggcgatgaaccgcctgacgccggcgcaccagggggcgatgccgccgccgccgggggcggggcagctggcgcggtacggctccgcgccgggctcgctcctggcggccatcgcgaagtccgtcacccgcggcggggaccacgccccgccgcccttcacccggttctactccgccgagtcctccggcctcacctcctgcgagtccacctgccgcacggacgccggcgggggccgaccgcgcgcgctcgagcgggcctacggcggctccggcgagatccgcgtgccgccgcagcagcaccagtcgctcgcgcccccgggcccgccgcacgggctgctccgccacagcagctcccccgccgggctgctctcccgcctcacggccgacccgcacggcatggctccggcgagcgggatgggcagctactcgcaggcggacaccgacgccgcgatggcgcacggccacaggcagctcagctcgcagtggagcttctccaggcaggacctcccgcggatctcggagatggggatgatccccgccgacatcggggagagcatcgtcgccggcggcgggtgcaacagctccagcgacggcgccgcgcagtcctcctcctacctctccaggaacttctccgtcagctcctgggacgacaccaactccatcatgttctcgtcgtccccgaacaagaagcccaagctcgacgcggcagatgacatggtcaccagcttcagcaacatcgactcccagtttgggttgtcaaagtcgtcgctggagatgcccggcatggatgactacctgcagctgcagcaggactccgtcgcttgcagagttcgtgcaaagcgaggctgtgcgacacacccgcgaagcatcgctgagagggaaagaagaacaaggatcagcaagaggctcaagaagctgcaggatcttgtgcccaacatggacaagcaaacaaatacgtcagacatgttggatcttgctgtagagtacatcaaagagctgaagggccaagttgagaagctaaaacacgaccaagcaaactgcttttgctcaggcaatcagaacagctgacagtggagaagcagatggacaaggtcttatgtggcaccgatatgattgttgagctccagtttttgcttcagaataactggctgcagcaatgcttaacatgtcaagtcgcttccgtgacgcagcctccctttccatggttgtactacggatacctcaatgccttgaccttgaagactagaagatgacgcttaggttatcataatttactttttgtaaagcggtgtcttatgtgtaaaaaatcctccatttcagcacgaatgggattgctgttgaaaaaaattattgtaggaatatctcgtgtgctcttttgccattgagctcaattttgctgattactaaattggcactaaaattaatgagtactagacatgcataccaaggagaactctaaacgacaacttgagaattcagcttatcagccttttcgtag

SEQ ID NO: 19569 - protein, 352 aa, Panicum virgatum
  misc_feature: Ceres CLONE 1806146
  misc_feature (283)..(331): Pfam Name: HLH Pfam Description: Helix-loop-helix DNA-binding domain
  misc_feature: The sequence is a functional homolog of SEQ ID NO 1257 in the 10/412,699 US patent application
  misc_feature: The sequence is a functional homolog of SEQ ID NO 176 in the 10/714,887 US patent application
  misc_feature: The sequence is a functional homolog of SEQ ID NO 176 in the 11/435,388 US patent application
  misc_feature: The sequence is a functional homolog of SEQ ID NO 196 in the 10/714,887 US patent application
  misc_feature: The sequence is a functional homolog of SEQ ID NO 196 in the 11/435,388 US patent application
  misc_feature: The sequence is a functional homolog of SEQ ID NO 168 in the 10/714,887 US patent application
  misc_feature: The sequence is a functional homolog of SEQ ID NO 168 in the 11/435,388 US patent application
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
MNRLTPAHQGAMPPPPGAGQLARYGSAPGSLLAAIAKSVTRGGDHAPPPFTRFYSAESSGLTSCESTCRTDAGGGRPRALERAYGGSGEIRVPPQQHQSLAPPGPPHGLLRHSSSPAGLLSRLTADPHGMAPASGMGSYSQADTDAAMAHGHRQLSSQWSFSRQDLPRISEMGMIPADIGESIVAGGGCNSSSDGAAQSSSYLSRNFSVSSWDDTNSIMFSSSPNKKPKLDAADDMVTSFSNIDSQFGLSKSSLEMPGMDDYLQLQQDSVACRVRAKRGCATHPRSIAERERRTRISKRLKKLQDLVPNMDKQTNTSDMLDLAVEYIKELKGQVEKLKHDQANCFCSGNQNS

SEQ ID NO: 19570 - DNA, 730 bp, Panicum virgatum
  misc_feature: Ceres CLONE 1806149
  misc_feature: Encodes the peptide sequence at SEQ ID NO. 19571
atcgccacaagttcgcgatctctcgatttcacaaatcgccgagaagacccgagcagagaagttccctccgatcgccttgccaagatgcagatctttgtgaagacactcactggcaagactatcacccttgaggtggagtcttctgacacaattgacaatgtcaaggcaaagatccaggacaaggaagggattcctccagaccagcagcgccttatcttcgctggcaagcagcttgaggatggccgtacacttgcagattacaacattcagaaggagtccacactgcaccttgtcctcaggctgcgtggaggcatgcagattttcgtgaagaccctcactggcaagacgatcaccctggaggtggagtcatctgacaccatcgacaatgtgaaggcgaagattcaggacaaggagggcattccccckgaccagcagcgcctcatctttgcwggcaagcagctagaggacgggcgtaccctggcggattacaacatccagaaggagtccaccctccaccttgtcctgcgcctccgtggtggtttctgagcctagtgctcctgagttgccttttgtcgttatggtcaacctctggtttaagtcgtgtgaactctctgcattgcgttgctagtgtctggttgtggttgtaataagaacatgaagaacatgttgctgtggatcacatgactttttttttttgaaccggaagatcacatgactttcatggctttag

SEQ ID NO: 19571 - protein, 181 aa, Panicum virgatum
  misc_feature: Ceres CLONE 1806149
  misc_feature (34)..(102): Pfam Name: ubiquitin Pfam Description: Ubiquitin family
  misc_feature (110)..(178): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
IATSSRSLDFTNRREDPSREVPSDRLAKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 19572 - DNA, 2126 bp, Panicum virgatum
  misc_feature: Ceres CLONE 1806161
  misc_feature: Encodes the peptide sequence at SEQ ID NO. 19573
gtaccaaaataatcagcagcaagaaagtgtaggcttcctcctcctccctttcttcttcctcgtccgtctcagagcaaatttgttccagtaggattgttattggttgtttcattcttactagctcttggagttgaggatagaggtatgtgtactcatgtacgcatgcctgcctgcggcttacttcttcttgttgctagctaagtagttgactagcaagcaagcaggtaggcaagctcctccagcttcttgattcccctcttttttgtgttgtgcttgttgcgctcctcctcgattatattcttcagttgagaggattttgatacgatcgcacaagagtcagtgagtggtcgatcggatcggaattcatcaattcctgaagctgcaagctaataatcagccaatcagctgcagatcgaggcgaggcaattcatcgatccaaaagataagataataatggccatggagcctgcgttgaaggttgccctggggaccgccgcgttcggcatcttctgggttctggccgtgttcccggcggtgcccttcctcccgatcgggcgcacggcggggtcgctgctgggcgccatgctgatggtgctcctcggtgtgatgagcgccgacgaggcgtacgcggcggtggacctgccgatcctgggcctgctgttcggcaccatggtggtgagcgtgtacctggagcgcgccgacatgttccggcacctggggcggctgctgtcgtggcgcagccatggcgggcgcgacctgctggtgcgcacctgcgccgtgtcggcggtggcgtcggcgctcttcaccaacgacacctgctgcgtggtgctgaccgagttcatcctcaagatcgcgcggcagaacaacctgccgcccaagcccttcctcctggcgctcgcctccagcgccaacatcggctccgccgccacgcccatcggcaacccgcagaacctggtgatcgccgtgcagagcggcatctccttcgggcagttcgtcttcggcatcctcccggccacgctcgtggggtccgtcgtcaacgccgccatcctgctctgcctctactgggggcagctcgacggggggatgaagcccgccgccgaggaggtggtggccgtgcccaccgaggtggtggaggaggaggacgtgacgtcgcaccgcttctcgccggccaccatgtcgcacctgcgcctccggcaagcggccggcgaggtcaagccggcggcagcagatgccaacggccactacagcgagtacgacggcaagcaggccagcaacggcatccacaagaggcggcacaccaccttggtgcagtcggagcaggggaaggagcagtcggaggaagaggagtcgtcggaggacgagcaggaggagtggcagagccgcgtgtggaagacttgcgtgtacgcgatcaccggcggcatgctggtggcgctgctgctggggctcaacatgtcgtggagcgccatcaccgccgccctggcgctcatcgtgctcgacttcaaggacgcgcgcccctgcctggagaaggtctcctaccctctgctgctcttcttctgcgggatgttcatcaccgtcgacggcttcaacaagacgggcatccccagcgccttctgggagttcatggagccctacgcgcggatcgacacgcccaccggaaccgccattcttgcgctcgtcatcctgctgctctccaatgtcgcctccaatgtcccgaccgttctcctgctgggcgcccgcgttgctgcctccgccgccgccatctccccggccgcccagactaacgcgtggctcatcctggcctggaccagcacggtggccggcaacctctccctgctgggctccgccgccaacctcatcgtgtgcgagcaggcgcgccgctcccagcactacggctacacgctctccttcttgggccacctccagttcggcttcccggccaccatcatcgtcaccggcatcggcctcctgctcatcagaacctactgatgattgccgggccatgtgcagtgcagtgcattcgtcctactgctagtagctctacatacagcaaagtaattaagattattttagtatgttgattggttgcttgatacaacaagatggaagaagattgtacattttggatc

SEQ ID NO: 19573 - protein, 510 aa, Panicum virgatum
  misc_feature: Ceres CLONE 1806161
  misc_feature (16)..(456): Pfam Name: CitMHS Pfam Description: Citrate transporter
MAMEPALKVALGTAAFGIFWVLAVFPAVPFLPIGRTAGSLLGAMLMVLLGVMSADEAYAAVDLPILGLLFGTMVVSVYLERADMFRHLGRLLSWRSHGGRDLLVRTCAVSAVASALFTNDTCCVVLTEFILKIARQNNLPPKPFLLALASSANIGSAATPIGNPQNLVIAVQSGISFGQFVFGILPATLVGSVVNAAILLCLYWGQLDGGMKPAAEEVVAVPTEVVEEEDVTSHRFSPATMSHLRLRQAAGEVKPAAADANGHYSEYDGKQASNGIHKRRHTTLVQSEQGKEQSEEEESSEDEQEEWQSRVWKTCVYAITGGMLVALLLGLNMSWSAITAALALIVLDFKDARPCLEKVSYPLLLFFCGMFITVDGFNKTGIPSAFWEFMEPYARIDTPTGTAILALVILLLSNVASNVPTVLLLGARVAASAAAISPAAQTNAWLILAWTSTVAGNLSLLGSAANLIVCEQARRSQHYGYTLSFLGHLQFGFPATIIVTGIGLLLIRTY

SEQ ID NO: 19574 - DNA, 1465 bp, Panicum virgatum
  misc_feature: Ceres CLONE 1806162
  misc_feature: Encodes the peptide sequence at SEQ ID NO. 19575
atgcttccctcattccctcctcgatcccctgctttgccccaatgccactcctccagtaatgtattaacccctccggtcccgaccccgcgggcacggacagggacagggaggatcggagggaggacgagccatggacagagaggcgggaggccaccaccagggtgctcccggcgagctggaggcggcccacgagcacgggcacaggaagcagcggcaagtgccccggatccgggagcggcagcggcgcaagagctccggcctggtgtgggcgatggtgatcctgtgcacgctgctggccatcggcgtcatcgtggccggcgccaccgtgttcgccgtgtacctgctgtacaagcccaagatgccgtacctgctggtctcggacgcgcggctagagcgcctcgagtacgggcagtcgggcaccatcctggacctgctgctggcgctcaccatccaggccgagaacaccaactccaagacggacgccaccttctccggggtcagcctcgccgtcggcttccacggcgccgacgtcgccctgctgcgggcggggaccttctccgtggcgcgccgcagctccgtgccgctgcggtaccaggtggtgtcggcggggcggcagctcagccccgacgggatgcagtacatggatggcgcgctccgggccggcgtcgtgccgctcgacctcttcggcaaggcgcgcaccacctggaaggtgggcatcttcgcctcgctccagttctggacgcgcatctcctgccgcttcctcttcaactaccccggcaacggcaccgccatgcccatcgactgccgctccaagtcgccgtagcattcatcatccgttccgttcattcttccttccttcgttcattcattcgacagcaacaaattggcagatcaatgcgccacacttgtacaggcgaataatgctggtacatataatacgcagtgcaggaacacacacacatctgtaatctgtaattcattttcttcttcccatttcctgacactgactctgtttggctaagtatttttctcttacactaaattagcaccggtcatcagccacccgacagctagcccgcggtactttttactcgcaacaaatcagaccacatacagccggacagagtcggtgttctgtcttttttttttcgattactttgttctgtcttgttctgcttgtactgatgaggtttctcctatcttccgttgggctcgcccgttgggaccacacgtcgacaacgcggtgggctggacgcccaagcccggtcaaccaatcaatgagtcagccacacacacaggacggcggactcgcacacgggtcttcgtgtgtggccctgggagttcccaagaggagtggccggcacgcagcggcgaagcagcggccgacgcgagcccagatcatcgccgaggaattatctccgtcgccatctgccggccgtggggacgcgcgacacggcgcgggcag

SEQ ID NO: 19575 - protein, 230 aa, Panicum virgatum
  misc_feature: Ceres CLONE 1806162
  misc_feature (70)..(208): Pfam Name: Hin1 Pfam Description: Harpin-induced protein 1 (Hin1)
MDREAGGHHQGAPGELEAAHEHGHRKQRQVPRIRERQRRKSSGLVWAMVILCTLLAIGVIVAGATVFAVYLLYKPKMPYLLVSDARLERLEYGQSGTILDLLLALTIQAENTNSKTDATFSGVSLAVGFHGADVALLRAGTFSVARRSSVPLRYQVVSAGRQLSPDGMQYMDGALRAGVVPLDLFGKARTTWKVGIFASLQFWTRISCRFLFNYPGNGTAMPIDCRSKSP

SEQ ID NO: 19576 - DNA, 815 bp, Panicum virgatum
  misc_feature: Ceres CLONE 1806162-R
ggggtgttgttccgcccggtggggtttccccggacggaggacgcttggaagctggaggagcggatcgagaaggtcatcttcgcctgccgcttcatgaccttcctcggcatcggcggcttgctcgccggctccatcccttgcttcctcaagggatgggtttatgtgatggatgccttcgtcgagtactacttacacggcggtggaactgtcgtccgaatgctgcttgaagccattgacttgtttctcattggaacggtcatgtttgtcttcgggacgggcttgtacgagctgttcatcagtaatatggacatgtcttacggctccaacctctttggcttgttcagtcttccggaacgacccaagtggctggtaatgcagtcggtgaatgatcttaagacaaagctgggtcatgtcattgtcatgagtctactagttggcatcttcgagaagagcatgggggtgaccatcacatcatgtgctgacctctttttcttcgctgcatctattttcatctcctcaggttgcctctacctactttccaggcttaataaatagcatcaaaggagggagccatgcctgaaaaaagtgtctctgtacataagcaataggtctgttgtgttgctgtgcagcatctcaggttatgtttggacagtcaaaaaatagggagtgggagggtccctttatgtactcatgtgggtcggcagttgcagtgaggcactaccactctacatagtaggataatgagatagtatcatcatgtatatgtaacctgatgtatatcgtctatgcaattaataatagagattctctgggac

SEQ ID NO: 19577 - DNA, 2578 bp, Panicum virgatum
  misc_feature: Ceres CLONE 1806177
  misc_feature: Encodes the peptide sequence at SEQ ID NO. 19578
acccattcttcccttcacaaaccgcacaagagagagaccaccacgagtccacgacacaagaggaggtagagagagaaagggccggccgtgtagctaactagctgctgcctgctggtagtacgagagcgtactgatgagttcttggactctacaccgaggggacgttgtctgaagcgagaggagaagaaacacccgtaggacaagacgtgtcgggaggaggaggaggaggaggaagagaggcaaggagcagcaccatcgccattccttggtctggttgctgttatgaggtgttggattggatgagaggaatgctctttgctggtagcgcacgagaggggcacgcggggacactgctactgctgcaacagcaacaacaacaggggctcgccgccggcaaggtctccggcgtcggcggcctctgggagcccacctcggtgctcgaccaaaggcacagccccagcccgagcccgcccacctcggcttccacgctgtcgtcgcccctgggcgccgcgaccgccggcgtggcggccctcgccggtgctaacgccaagaacgtctccccgccgccacaggcggcggcatggccggggggagcggccgcggaggaggctgcggtggggggcaaggaggagtggcagctcacgccgcttgacatgggccttggcgccggcgaggggtgggacgccgccggctctgtgctgtccgacggcgcggcgccgccggggcttgcccccgaccacaccttcctaaggtggatcattgggggcgaggacgcgtccgtgggcatgggcgccgtcatggacccgccggtccttgagctcgaccacgccccgtccatgatgtcgccggcgttcgggtccaacatgcctttcgcgccggccatggaggacaccaaggctccgcctttcggccacgcgtccaacctcctcctgcaccaccaccagcaccacccccagccccacgcggcgttcttcggctctcacccatccttcgacgcggcgccgccgacgcctaagcggcaccacccgatggcccccgcgccggcgccaaagctgcagtcgttgcctggccctgccgccccggcgggcaggttcgtgccggccatgaagcccaaggcggaggcagcgaacgatgaggcggccgctgcggtggagcagctcgccgaggcggccaagcttgccgaggccggcgacgccttcggcgcccgcgagatattggcgcggctcaattaccggctccccgccgcccccgcggccgggacgccactgctccgctcagccttctacttcaaggaggctttgcgccttgcgctgtccccaaccggcgaggccccggcaccgccggtgtccacgccgtacgacgtggtcctcaagctcggcgcgtacaaggccttctccgaggtctcccccgtgctccagttcgcgcacctcacctgcgtccaggcggtgctggacgagatcggcggcgccgggcgcatccacgtgctcgacttcgacatcggcatgggggagcagtgggcgtcgctgatgcaggagctcgcgcagcgatgccccgcggcgacgctcaaggtcaccgcattggtgtccccggcgacgcaccacccgctggagctgcagctgatccacgagaacctcgctggcttcgccgccgagctcggcgtcttcctccagctggcggtcttcaacatcgacaccctggaccccgcggagctggtggccattaccagcggcgacgctgtcgccgtccacctccccgtgggctcggcccacgtggccgcaatgccggccgtcctccgcctcgtgaagcggctcggcgccaaggtggtgatctcggtggaccacggcggcgaccgcacggagctccccttcgccgcgcacctgttccaggcgttccagtcgtgcgtgtccctgctcgagtccgtcgacgccgtgcgcccggacgccgacgcggtcgccaagatggagcggttcctggtccagcccggcgtggagcgtcgcgtggtggcgcgccaccgcgcggcggccatggacaagccgccgctgccgtggcggaccgtgctcgcgtcggcggggttcgtgccggtgcaggccagcaccttcgccgagtcgcaggccgaggccctgctcaagcggatggccctgatggggttccgcgtggagaagcgcggcggcgcgctctgcctctactggcagcgcggcgagctggtctccgtgtcggcgtggcggtgctgaccaccggccacgccgccgcaccccgacgcgaatctaccaccacccagcccggttttagctaggactaatgatcctactgcgagcaaacaaaaacgtatttttcaccgtcgtcgttgtaaacttgtaatggttgttcgatctgatcgcctgcttatttagtgtcctaaaatttggagtgcgtcgtctgtcgcctggctttgcagccggtctgctcgcgtcgatcagcagagtagattgtgtttggaatagcaggttgtaaaaggtaggtgcggtgcggtaaccagtgcattctaccacccgtgttgttattgctgtgaaatcaatcaatggttatggcgttttaagcc

SEQ ID NO: 19578 - protein, 643 aa, Panicum virgatum
  misc_feature: Ceres CLONE 1806177
  misc_feature (257)..(553): Pfam Name: GRAS Pfam Description: GRAS family transcription factor
MRGMLFAGSAREGHAGTLLLLQQQQQQGLAAGKVSGVGGLWEPTSVLDQRHSPSPSPPTSASTLSSPLGAATAGVAALAGANAKNVSPPPQAAAWPGGAAAEEAAVGGKEEWQLTPLDMGLGAGEGWDAAGSVLSDGAAPPGLAPDHTFLRWIIGGEDASVGMGAVMDPPVLELDHAPSMMSPAFGSNMPFAPAMEDTKAPPFGHASNLLLHHHQHHPQPHAAFFGSHPSFDAAPPTPKRHHPMAPAPAPKLQSLPGPAAPAGRFVPAMKPKAEAANDEAAAAVEQLAEAAKLAEAGDAFGAREILARLNYRLPAAPAAGTPLLRSAFYFKEALRLALSPTGEAPAPPVSTPYDVVLKLGAYKAFSEVSPVLQFAHLTCVQAVLDEIGGAGRIHVLDFDIGMGEQWASLMQELAQRCPAATLKVTALVSPATHHPLELQLIHENLAGFAAELGVFLQLAVFNIDTLDPAELVAITSGDAVAVHLPVGSAHVAAMPAVLRLVKRLGAKVVISVDHGGDRTELPFAAHLFQAFQSCVSLLESVDAVRPDADAVAKMERFLVQPGVERRVVARHRAAAMDKPPLPWRTVLASAGFVPVQASTFAESQAEALLKRMALMGFRVEKRGGALCLYWQRGELVSVSAWRC

SEQ ID NO: 19579 - DNA, 2485 bp, Panicum virgatum
  misc_feature: Ceres CLONE 1806188
  misc_feature: Encodes the peptide sequence at SEQ ID NO. 19580
ctcccgacctcccccttcctcctcgtctcgtctccccccatcccgcccgcaaccaccaccagtccacctccaccaccccgaagccgcgtggagccctactccagatcggagccagctcgccgggcaatgccgctccggctgcgggagtagcacgtctttgcccgcccaccgacctcacgagcgatggcggaggacggcgaggagaagctgctcgccacggtgcagcacatcgtgcagacgctggggagcagcgacaccatgacggaggacatcctcaaggtcttctccaactacgacggccgcctctcgctcgacaagctctacgccgcgcgcgccgccgcggcggcggccgcgtccggcggcggcggaggaggaggagcggggggaatcggaggggagcactcgatgcccgcgtccccgccgctgcccccgcctcccgcggcggcggccccggtgtcggccgcgggggcgaggccgccggtgacgtccatggagcgcaccgtgcgcacgctggaccgccagatctcgcagttcgtggccatggaccggctgatttgggcggactccgccgacgcggacgcgttcctggaggcggtcgacgacctcatcggcaccgtgcaggagctcgacgccgcggggaccaaccgcgcgctgctcgaccgcgcggacgagctgctcagccggtgcatggcgcggctggaggacgagttccgggcgctcatagagcgccccgacgccgccgcccccgtggtgcccggcgggttcgggtcggatgggagcgacgaggaggacgacttcggcggcggggacggctacggcgacgagccgattccgatcgccaagccggtgacggactacgacgtcgtcatcgacgctctctcgccgggctccatcgccaacgtgcaccagatcgccaagaggatggtggacgccggcttcggccgtgagtgcgccgaggcatacgccgaggcgcgccgcagcttcgtcgacgagagcgttgcgcgcctcggcatccgcccccgcaccgccgaggaggtccatgcctcaccctgggaggagctcgagttcgacatcgctcgctggatcccggccttcaacatggtgttccgcatcctgattcccagcgagcgccgcctctgtgaccgcgttttcgacggcctcgcccccttcggggacctggccttcattgctgccgtgcgcacccaggcgttgcagctcatatcgttcggcgacgctatctcttcatcaagccgcgctccggagcgcctgttccgcgtcgttgacatgtacgaggctgtgcgtaacatccttcctgaccttgatcctgtgttctccgacccgtactctgctacactccgcgcggaggtctcgacgatgtgcaacacactggggtcctcgatcaaaggcatatttatggaattggaaaatctcatccgccgtgaccctgcccgagttgctgcccctggtggtggcatacacccgataactcggtatgttatgaactatctccgtgctgcgtgtgggtcgcggcagacattggaagaggtaatggaaggtgacttgggggttaatggaggagcgcctgtggctgttgaccctgaccgccccacctcatcccttgctgtacacatagcatggatcatggacgtccttcacaagaatttggatacaaagtctaagatttaccgtgatccgtcacttgcttctatcttcttgttgaacaacggcaagtacatcatacagaaggtgaatgacagtgagttaggtgttttacttggtgatgagtggatcaagcagatgacaactagagttcgccgctggagcgtggattatcagcggacaacatggggcaaggttacaactgtgctgcagactggtagtccaggcatcggaggactcccagccaaggcgatgctgcagaaactgcgtatgtttaacacatactttgaggagatctttgcgacacaatcagaatgggtgatagcagatgaacagctaagggtggacattagggcagcagtggaggattcagttatgccagtttatgcctctttaattgccaagttgaagtcttctcctgaaactgggcgtgatttgtacatcaaatacacaccggaagatgttgtagcccgcatccatcacttgtttgaaggagcagcgaagtgataaaattaattggtaacctgttatgctgcagcttctgctctattaaatttgcgaagatactatcatggattttgggttggtggttaatatctggtagtcacatatgatgatgctgttggctcaacttgccatgaagttatggagttcagcaaatgtaggtcttgtgtgtctgtatcaatcagtagcctaattatgttgtaacaatattagggctccatttctgtttcaaactctactttaatttaaccccattaagtattatgtgtgaaattcattaagtttgtgcgcaaccttttgaaattttaagttttccctgtcc

SEQ ID NO: 19580 - protein, 660 aa, Panicum virgatum
  misc_feature: Ceres CLONE 1806188
  misc_feature (95)..(656): Pfam Name: Exo70 Pfam Description: Exo70 exocyst complex subunit
MAEDGEEKLLATVQHIVQTLGSSDTMTEDILKVFSNYDGRLSLDKLYAARAAAAAAASGGGGGGGAGGIGGEHSMPASPPLPPPPAAAAPVSAAGARPPVTSMERTVRTLDRQISQFVAMDRLIWADSADADAFLEAVDDLIGTVQELDAAGTNRALLDRADELLSRCMARLEDEFRALIERPDAAAPVVPGGFGSDGSDEEDDFGGGDGYGDEPIPIAKPVTDYDVVIDALSPGSIANVHQIAKRMVDAGFGRECAEAYAEARRSFVDESVARLGIRPRTAEEVHASPWEELEFDIARWIPAFNMVFRILIPSERRLCDRVFDGLAPFGDLAFIAAVRTQALQLISFGDAISSSSRAPERLFRVVDMYEAVRNILPDLDPVFSDPYSATLRAEVSTMCNTLGSSIKGIFMELENLIRRDPARVAAPGGGIHPITRYVMNYLRAACGSRQTLEEVMEGDLGVNGGAPVAVDPDRPTSSLAVHIAWIMDVLHKNLDTKSKIYRDPSLASIFLLNNGKYIIQKVNDSELGVLLGDEWIKQMTTRVRRWSVDYQRTTWGKVTTVLQTGSPGIGGLPAKAMLQKLRMFNTYFEEIFATQSEWVIADEQLRVDIRAAVEDSVMPVYASLIAKLKSSPETGRDLYIKYTPEDVVARIHHLFEGAAK

SEQ ID NO: 19581 - DNA, 1319 bp, Panicum virgatum
  misc_feature: Ceres CLONE 1806190
  misc_feature: Encodes the peptide sequence at SEQ ID NO. 19582
agttgcgtctgcgtgcctgcggccctgcgcggccattctcagcctcggctcggcttcctccccatgaccccatccccacaccgcgacgcgtgcggaaaccctagccgccggtgatgtcggacccccgctacccgtactcccgaggcgctttgctaggcggcgacggcgagccgccaccgccgccgcggtactccgactttgaggtcgacctcatcgcggcccgttacgccgccgccccgccgcctccgccctacccctcctccgccgacgccagcgccttcgactcgcacgtcggcgccttcgactcgcacgtcggcgccttcgactcgctagtcggtgccttcaactcacccgtcggcgccttcgactcgcactttggcgctttcgactcgcacgccggtgcggggcgatccgcgggagctctctatcaccaatcttttatgggaagtcatagtactgttggccagaatgaggctttatattcatcaaatactatggctaaacgccctaggcttgaaagcagctttcctatgtatccacaacgaccgggggaaaaggactgtgccttctatatgaggaccagaacctgtaattatggagaggcctgcaaatttgaccatccacaatgggttccagagggtggagttccgaactggaaagagttccgtaacgttgaagattcttatcctgagcgaccaggggaaccagattgtccttatttagtgaagtctaatcgctgtagatttaaatcgaaatgcaagttcaaccatccaaaggaaaaggtgaatgcattatcggctggaacggacaacggacagtctctaattgccgatagtgccatcttaccagtgaggccttctgagcctgtttgttccttctatgtaaaaacaggcaaatgcaaatttggtgcaaaatgcaagttcaatcatcccaaagatgttgggatagcacctgtgattgcaaaggaaaccatatatacagcaacaactgatgcagcagcacacattggtacagcagatagttcagttccagcaaagacgcatgcaccaactgccccagctgaggcacataatgcaaaggggcttcctataagaccaggtgaagttgattgctcgttttatatgaagacaggcagctgcaaatatggttctatttgtcgcttcaaccatccttatcagccagttgtggatatagcatcgatggctccactggttcaagctactcttcctactccagaacccattacctctgcagcggtgttaaatccagttgcaaatattacgcaatgctttgatttttcatgcgactcatctcccgat

SEQ ID NO: 19582 - protein, 401 aa, Panicum virgatum
  misc_feature: Ceres CLONE 1806190
  misc_feature (328)..(354): Pfam Name: zf-CCCH Pfam Description: Zinc finger C-x8-C-x5-C-x3-H type (and similar)
  misc_feature (145)..(171): Pfam Name: zf-CCCH Pfam Description: Zinc finger C-x8-C-x5-C-x3-H type (and similar)
  misc_feature (248)..(274): Pfam Name: zf-CCCH Pfam Description: Zinc finger C-x8-C-x5-C-x3-H type (and similar)
MSDPRYPYSRGALLGGDGEPPPPPRYSDFEVDLIAARYAAAPPPPPYPSSADASAFDSHVGAFDSHVGAFDSLVGAFNSPVGAFDSHFGAFDSHAGAGRSAGALYHQSFMGSHSTVGQNEALYSSNTMAKRPRLESSFPMYPQRPGEKDCAFYMRTRTCNYGEACKFDHPQWVPEGGVPNWKEFRNVEDSYPERPGEPDCPYLVKSNRCRFKSKCKFNHPKEKVNALSAGTDNGQSLIADSAILPVRPSEPVCSFYVKTGKCKFGAKCKFNHPKDVGIAPVIAKETIYTATTDAAAHIGTADSSVPAKTHAPTAPAEAHNAKGLPIRPGEVDCSFYMKTGSCKYGSICRFNHPYQPVVDIASMAPLVQATLPTPEPITSAAVLNPVANITQCFDFSCDSSP

SEQ ID NO: 19583 - DNA, 680 bp, Panicum virgatum
  misc_feature: Ceres CLONE 1806190-R
  misc_feature: Encodes the peptide sequence at SEQ ID NO. 19584
ctgtgcctataatctatcctcagaggcctggagaaactgcttgtgatttttacatgaagacaggatcttgcaagtattctcagaagtgcaagtttcaccatcctatcaaccgctctgcacctgatgccaatgaaaatggggatcctcagcagcctgtgacacttactcttgctggccttccaaggagagaggatgctgagatctgtgcattctacatgaggtctggcacgtgcaggtatggcgcgctctgcaaattcgaccaccctcccccacaggaggctattgccaagctgcaggcaggtggaaaggaaggtgagaaggagaaggaaggcgaggagaaggagaagaaaggtgaagagaaggaagggctgagcgtcgtcctgcgctaggccgtgatgctgcatcctgtcagctgcctcattagattgtaatgcgctaatcgcgctggtggttaaaggttttgtccgggttgtggtgggcgtccgattagtgaagttgagttacccccgctacagtttattggaacagtgctggtactagcgagttttttttaagcatgcgggtactagccagttatatcttcgtttgttgccgtagatgacagtagtctggctgtggtaggatgtcatgttgacatgccctggtgcctattgcagcagtactttcttggccgtgatacc

SEQ ID NO: 19584 - protein, 128 aa, Panicum virgatum
  misc_feature: Ceres CLONE 1806190-R
  misc_feature (63)..(89): Pfam Name: zf-CCCH Pfam Description: Zinc finger C-x8-C-x5-C-x3-H type (and similar)
  misc_feature (9)..(35): Pfam Name: zf-CCCH Pfam Description: Zinc finger C-x8-C-x5-C-x3-H type (and similar)
  misc_feature: Functional homolog of the protein sequence given in SEQ ID NO 50868
  misc_feature: Useful for making plants with modulated flowering time
VPIIYPQRPGETACDFYMKTGSCKYSQKCKFHHPINRSAPDANENGDPQQPVTLTLAGLPRREDAEICAFYMRSGTCRYGALCKFDHPPPQEAIAKLQAGGKEGEKEKEGEEKEKKGEEKEGLSVVLR

SEQ ID NO: 19585 - DNA, 651 bp, Panicum virgatum
  misc_feature: Ceres CLONE 1806202
  misc_feature: Encodes the peptide sequence at SEQ ID NO. 19586
gtgctgaagcatatcgagtcccatctaacacccatacgttcatggaggtggttcaagaagtccttaagcatggctcagcaaatggcgtccgtgcagctatcagagctgacaaaaagagttacagccttgtccagcttattgcagcttccctggatgtccacaaaattttgtgcagcaaaaatatgacacggaatggaacacataattcttctttggaaggaatgaatggaacaggattccttcatggagctcgtgttggcattgtggctaaaccctctcctgaatttgttgctggggtatttggaacctggctttctggtggagttgcagttccccttgcacttagctatccagaagctgagcttcttcacgtcatgaacgattcggatatttcaatgattttaagcaccaaggagcatcatgaaatgatggagaacctttctatcaaatgttctgcttattgttctctccttccatctatcactagtataccttcagaaataaatccccaagaaccttcaagcaatgaggtgacttcatcagtctctagtttaataactgaggccaacagttcaaacaaaatcaaaggagatgatcatgctcttatcctttacacaagtggcacaactgggaaaccaaaaggagttgttc

SEQ ID NO: 19586 - protein, 203 aa, Panicum virgatum
  misc_feature: Ceres CLONE 1806202
  misc_feature: SWISSPROT Homolog: EC 6.3.2.26 N-(5-amino-5-carboxypentanoyl)-L-cysteinyl-D-valine synthase
MEVVQEVLKHGSANGVRAAIRADKKSYSLVQLIAASLDVHKILCSKNMTRNGTHNSSLEGMNGTGFLHGARVGIVAKPSPEFVAGVFGTWLSGGVAVPLALSYPEAELLHVMNDSDISMILSTKEHHEMMENLSIKCSAYCSLLPSITSIPSEINPQEPSSNEVTSSVSSLITEANSSNKIKGDDHALILYTSGTTGKPKGVV

SEQ ID NO: 19587 - DNA, 623 bp, Panicum virgatum
  misc_feature: Ceres CLONE 1806202-R
  misc_feature: Encodes the peptide sequence at SEQ ID NO. 19588
tactggaaaagaccagaggttacatcagaatccttcatcgatggtggattcttcaagacaggtgatacagtaactgtagatgaggagggatacttcataattttaggacgcacaaatgctgacattatgaaagttggcggttataagttgtcagcactagaaattgaggccgtgctgctagagcatgatgctgtattggaatgcgctgtccttggcttgcctgatgaagcctatggggaggtcatatgtgcaataattgtgcctaaggaggatgcgaagaaaatggtggagcaggactcaaagccagcactaaccttggaagcattgacaaattggtcgaaagataagcttgctccatacaagattccaacaagattgtacttgtgggattctcttcctcgcaatgccatgggaaaggttaataagaaggagctgaagaaattattaggagcttagctactgagtttatagatacatttatttgttcgtttcattaaagtttagtaaggtggactcgtcatagcgattagcaaatatgttatttcctcaccatgtaacaataattttccaaaactttcctccattcatattttattgtatttttcttcagtattaagatagcc

SEQ ID NO: 19588 - protein, 151 aa, Panicum virgatum
  misc_feature: Ceres CLONE 1806202-R
  misc_feature: SWISSPROT Homolog: EC 6.2.1.26 o-succinylbenzoate--CoA ligase
YWKRPEVTSESFIDGGFFKTGDTVTVDEEGYFIILGRTNADIMKVGGYKLSALEIEAVLLEHDAVLECAVLGLPDEAYGEVICAIIVPKEDAKKMVEQDSKPALTLEALTNWSKDKLAPYKIPTRLYLWDSLPRNAMGKVNKKELKKLLGA

SEQ ID NO: 19589 - DNA, 1673 bp, Panicum virgatum
  misc_feature: Ceres CLONE 1806203
  misc_feature: Encodes the peptide sequence at SEQ ID NO. 19590
gtccgtccggccaattcgcgtcgcgcccctccgctccgctccgcctcgcctcccctcccccacgctcgctccacccagatctcgccgcgatggcccgcgccgccgccgccgcaagcgtggccctcctcctcctcgccgtagccggggtcctaatccgtccggcggcggcggagatcaagcaggagttcttcaaggacgacccccgcggctccatcctcttcgagaagttcggcttcggcccccacggcatggtgtccgtctccgtcaccggcgccagggcctcccccgcgctcgccaagccggacccctcgcagctcggcttcttcctcctctccgacgaggcgctcttcgaggccatctacgagcagccgccgcccacggatctgaaccccaacccggagtcctcccccaactgcgtcctctccagcccctacgtcataccgctcttcaccttcgccgacgtcgaagccgccggcggccactacaagaagaccttccccatcacccaccccgacgagtacagcctcttcttcgccagctgcgcggcggagaccaaagtcaccatggaggtccgcaccgacatgtacaacaccaacccggacggcaccaaggactacctctccgtcggcatggcctccgtcccggcgatctacgccttcttcgccgtctgctacgtcgccttcctggccggctggctctacatcactctccaccgcaaccgcctctccgcgcaccgcatccaccacctcatgactggcctgctcgtcgcgcgtatgctctactgcatctcggcggccgaggaccagcactacatccgcaccgccgggacaccgcacggctgggacgtcatgttctacctgttccagctcgtgaagggtgtgatcttgttcgctgtgatcgcgctgatcgggaccgggtggtcgttcctcaagccattcctgcaggacaaggagaagaaggtgctcatggtggtgatcccgttgcaggtcgcagctaacatcgctgctgctgtggtcggcgagacagggccattcttgcagggatgggtgacatggaaccagatcttcctgttcgttgatgttgcctgctgctgcgctgtgctcttcccagttgtgtggtcgatgcgctcgctgcgggagtcatccaagacagacggcaaggcggccagaacccttgccaagctcacgctcttccgccagttctatgtcgtcgtgattggatacttgtacttcactaggatcattgtgtatgccctcaagacaatcaccaactacaagtacagatgggtgagtgttgcggctgaggaggtggccaccatggcattctacatgtttatgttctacatgttcaggccagcggagaggaaccagtactttgccctcgacgatgatgaggaggaagctgcagagatggcgctccgtgaggaggaatttgagctctagaagaccacggggagtgcccagtgacatgggaatacagtcatctcccattcaatttctcctcgatgtcatgttgatcatactatacagattcagggtttagcttatatatgtccatgtgtggtaaatcttgtttcactccttccttcggttcggaagctgccgacgagacttttgataacaagatttcttgtgttgcaaagtaaggggtaattcaaatactgttgtcatttc

SEQ ID NO: 19590 - protein, 450 aa, Panicum virgatum
  misc_feature: Ceres CLONE 1806203
  misc_feature (144)..(427): Pfam Name: Lung_7-TM_R Pfam Description: Lung seven transmembrane receptor
MARAAAAASVALLLLAVAGVLIRPAAAEIKQEFFKDDPRGSILFEKFGFGPHGMVSVSVTGARASPALAKPDPSQLGFFLLSDEALFEAIYEQPPPTDLNPNPESSPNCVLSSPYVIPLFTFADVEAAGGHYKKTFPITHPDEYSLFFASCAAETKVTMEVRTDMYNTNPDGTKDYLSVGMASVPAIYAFFAVCYVAFLAGWLYITLHRNRLSAHRIHHLMTGLLVARMLYCISAAEDQHYIRTAGTPHGWDVMFYLFQLVKGVILFAVIALIGTGWSFLKPFLQDKEKKVLMVVIPLQVAANIAAAVVGETGPFLQGWVTWNQIFLFVDVACCCAVLFPVVWSMRSLRESSKTDGKAARTLAKLTLFRQFYVVVIGYLYFTRIIVYALKTITNYKYRWVSVAAEEVATMAFYMFMFYMFRPAERNQYFALDDDEEEAAEMALREEEFEL

SEQ ID NO: 19591 - DNA, 693 bp, Panicum virgatum
  misc_feature: Ceres CLONE 1806217
  misc_feature: Encodes the peptide sequence at SEQ ID NO. 19592
gctttcacctcaccactccccccactccactctctctccttcctctctctttctccccacacacacacggaaacagccactcacctcccccaccctccggttcatgtcctgctgctccccatgtcgcccccactcgagctcgactacataggactctcgccgccggaggtcgccgccgccgcagatgccgccgacgacctgaagggcaccgagctccgcctcggcctgccggggtccgagtcgccggagcgccgcgtcgcggctgccaccgcgaccaccctggacctgctcccagccaagggcgccaagcgcgggttcttcgacgaggtgccgccgccgtcgcccgccgccgctgcgggcaagggcaagaaggtggcggacgaggaggacgacgacaagaaggtggcagcgaccccgcagccggccgccaaggctcaggtggtgggatggccaccaatccgcagttaccgcaagaacacgatggctactacccagcagaagggcagcaaggaggatgctgaggccaagcagggccaagggttcctctacgtgaaggtcagcatggatggcgccccgtacctcaggaagattgacctcaagacatacaagaactacaaggatctctccactgcacttgagaagatgttcagtggctttagtaatggtgagatgtctcgggttattctccacttt

SEQ ID NO: 19592 - protein, 190 aa, Panicum virgatum
  misc_feature: Ceres CLONE 1806217
  misc_feature (26)..(187): Pfam Name: AUX_IAA Pfam Description: AUX/IAA family
MSPPLELDYIGLSPPEVAAAADAADDLKGTELRLGLPGSESPERRVAAATATTLDLLPAKGAKRGFFDEVPPPSPAAAAGKGKKVADEEDDDKKVAATPQPAAKAQVVGWPPIRSYRKNTMATTQQKGSKEDAEAKQGQGFLYVKVSMDGAPYLRKIDLKTYKNYKDLSTALEKMFSGFSNGEMSRVILH

SEQ ID NO: 19593 - DNA, 668 bp, Panicum virgatum
  misc_feature: Ceres CLONE 1806217-R
taaggtccaagtcttttcagtagaaattttagtacaagaagaggttctcttctgtttttctttttattggtcttacaggttagtatgggtgtaatgccatatcaggcaaggacggcttatctgagtaccacaaggatggtgaatatgttctgacttatgaagacaaggatggagattggatgctcgtcggcgacgtgccatgggagatgtttgctgactcttgccgtaggctcaggatcatgaaaggttcagatgcaattggacttgctccaagggcagctgataagtccaagaaccgcaactagaatggttgctactacagtccagagcaagagggagatccaatgactgtagggccctttatgaaaatcgaaaagtcagttttaagacgaattctgccttatggtctgtactacatggtttgctgttacgcgagtaaagaactccatgtctgttatgttagtttcgcaaaatcgtctatggaccaaacctctatccgattgtggttagggctttgtatgggtgttattcgtatcagtgtaaatggtttggttcattgtgtgctgctactttgattgagcagtcctacctagtttgcaaaatggtgtccatgaactgtttgtcggtcctctatataatgttcaatgaagctcgtgaatgtattgtcc

SEQ ID NO: 19594 - DNA, 1725 bp, Panicum virgatum
  misc_feature: Ceres CLONE 1806218
  misc_feature: Encodes the peptide sequence at SEQ ID NO. 19595
atcgagtcgagtcgccttgttgtcctcatccatccaaatcgcgagaaatccccgtccccatgaagctccggttgcgatcgatggaggcgcgcggcggcgccgccgccgtcgagacccaccgcgtggatctgccgcccacggccacgctgcccgacgtgaaggccctcctcgccgccaagctctccgcggcgcagcccgtccccgccgagtccgtccgcctctccctcaaccgcaccgaggagctcgtctcgcccgaccccgccgccacgctccccgccctcggcctcgcgtccggcgacctcgtcttcttcgccctctctcctctcacagccctcgcgccgcctgcgcgggcgctgcccccgaaccctagcccggggtccgcctctgttccgaccgcgatggccgtcgacgccggtaaagggtcggagcagcctggcaccggtggttcctcgctgcaggtgcgaacggtggccgtggaccctatcgctcctgccgcacccggtccggcggatgtggtgatggcggaggccgtcgatgccacaaagggctggtcgagttttgtgcttagggatctcaagagagagatgcggaacgtcggtgccgcagagggaaccgctgccgatcgcctggttgcggccctgcatgcagctctgcttgaggctggcttcctcaccactgatccgatggggtcacacctctcgctgccacatgattggccgtcggttgcttcaaagccactggccatcaagtataccataccagagctttcaccaatgtcacctgcggccgaggagggaaaggtggcagtgctcaacttctccttgatgggaaatttcgtgatggtatacgggtatgtgcctggggtgcagtctgaggtgtgccgattctgcttggagttgccaaggcttgagcctttgctgtatctggatagcgatcagctgagcgaagtgcaggagagggggattcttgatatgtggaaagtgctgaaggatgatatgtccttgccactgatgatatctttatgccagctgaatggtttgcgcttgcccccatgcttgatggctctgcctgctgagctgaagactaagatcttggatcttttacctggggatgatcttgcaagggttgagtgcacttgcagggaaatgagggatcttgcagcagatggtagtctttggaagaagtttatagtgaggttcaaaagttatggtgagggttctagaggggctatgagcgcgaaggccatgtttggagaagcttggttggccaataagaggcggcagaagaggccccatccaaccttttggaactatggctggggaaacaatccttatagccgcccactctggcagcctttgatcggtggggactcagacagactgccgtttattggtaatcacggttctgttgggcgtaactttggaaatcaacgaaggaacatcgtgccgaactgcattccgaactgcatgcttgatggtcaccaccataacttcctttgaagtttctttgggttttctcatatgctaagagtattttgtaagaaggggtgcatagacggataggccgtcttgttaatatcttcatgctgcacacttatgcatgcgcagagcactcttatccttatatatccttttagtatcttagatcctgtcttttctgtttttgtttttatgataccgatgtaacccatgctctagtaataaagtacccttgtactgttctcag

SEQ ID NO: 19595 - protein, 479 aa, Panicum virgatum
  misc_feature: Ceres CLONE 1806218
  misc_feature (331)..(378): Pfam Name: F-box Pfam Description: F-box domain
MKLRLRSMEARGGAAAVETHRVDLPPTATLPDVKALLAAKLSAAQPVPAESVRLSLNRTEELVSPDPAATLPALGLASGDLVFFALSPLTALAPPARALPPNPSPGSASVPTAMAVDAGKGSEQPGTGGSSLQVRTVAVDPIAPAAPGPADVVMAEAVDATKGWSSFVLRDLKREMRNVGAAEGTAADRLVAALHAALLEAGFLTTDPMGSHLSLPHDWPSVASKPLAIKYTIPELSPMSPAAEEGKVAVLNFSLMGNFVMVYGYVPGVQSEVCRFCLELPRLEPLLYLDSDQLSEVQERGILDMWKVLKDDMSLPLMISLCQLNGLRLPPCLMALPAELKTKILDLLPGDDLARVECTCREMRDLAADGSLWKKFIVRFKSYGEGSRGAMSAKAMFGEAWLANKRRQKRPHPTFWNYGWGNNPYSRPLWQPLIGGDSDRLPFIGNHGSVGRNFGNQRRNIVPNCIPNCMLDGHHHNFL

SEQ ID NO: 19596 - DNA, 2086 bp, Panicum virgatum
  misc_feature: Ceres CLONE 1806223
  misc_feature: Encodes the peptide sequence at SEQ ID NO. 19597
acaccccgccacgcccgccgccgccgctgccgctgccggagatggaggacatcgaggacgtgctgggcccggccggcctctccggaggcggagcgcctccggggctccgcctcccgctggccgccgtcgcggtcaagcccaagcgccggtcgtcaagggttgcgcagacgccgacgcagcccgaggcgcggatccccggctcgcagacgatatatgtcaagacgttcgggtgctcacataaccagagtgacagtgagtacatgtcgggacagctatcggcatttggatatgctattactgaagaacccgaaggagcagatttatggctaattaacacatgcacagtgaaaaatcctagtcaatctgcaatgacaaccctcatatcgaaatgcaagaacgcaaacaaaccactagtagtcgctggatgtgtaccacaaggaagccagggtctcaaggagcttgaaggtattagtataattggagtgcaacagatagaccgggttgttgaagtggttgaggaaaccttaaaaggccatgaggttcggttactgagtcggaaaacactgccctcacttgatttacctaaggtaagaaagaacaagtttatcgagattcttcctattaatgtggggtgtttaggcgcctgcacttactgtaagacaaagcatgctcgtggtcatttgggaagctatactattgacagcttggtggatcgtgtgaaaactgttgtgtctgaaggtgtccgagagatatggttgagcagtgaagatactggtgcttatggcagggacatcagtacaaatcttccaaatctgttaaatgcaattgtccaagagcttcctgttgaccgaagcacaatgctccgcataggcatgacaaaccctcctttcatactagagcatctgaaggagatagctgccgttttgcgtcatccttgtgtttattctttcctccatgtgcctgtgcagtctggaagtgatgctgttttaacggccatgaatcgtgaatacactgttggtgagttcaggaaggtagttgacactctgtgggaacttgtccctgaaatgcaaattgctactgatattatatgtggctttcctggtgagactgatgaagattttgctgagactgttaatctcgtaaaggaatatcaatttcctcaagtccacatatcacagttttaccccagaccagggacacctgctgctaggatgaagaaagtgccaagcaatgatgtgaagaagcggagtcgtgaactgacttctgtttttgaatcattttcaccctacaaaggaatggaaggcaaggtagagcgaatctggatcactgagatagctaccgatggtgttcacttggttggacataccaagggatatatccaggtgctggtcattgccccagatagcatgctagggacatcggcgaatgtgaagatcacatcagttgggcgatggtctgtgttcggtgaggtgatagaaggatctgtggttgcaggggaagcacctaagcaaaccagcagtgaaccacagaaggaacacatacagaatcaggcggatgctggttgttgtgccaccgactcttgtggcgcctgtgcgtgctccgacgtcgcacaacactgcggccctgaacgatgcgaggatatacctgatgcaccccagaccagtggtaacgttaatcatcagggggcagtccagtctacgcttgtcaggagaaacgtggagggatcgacgaaagcaagtgaaagcaatgcagcactgtcggtagggaaggaacagcaggtgaacgttgtaactaggagaggcgtaaacgttgacacgattttgtggtgcggtttggccgtgagcttcgctgcaactgtagcgcttcttgtactccttaccggcaggatttcgtcgacatcctcctactagtctaggcggtgattgtaacttgtaacaattgttcttgagcgtttactgatcaattttggcggttttctttagttgatctgccatgtatgtcattgcaaagttgtggcaccacaaatacatgtatgcaaacaggttttgtcattatcgctccagaacggaacaaggtttggtggtgt

SEQ ID NO: 19597 - protein, 622 aa, Panicum virgatum
  misc_feature: Ceres CLONE 1806223
  misc_feature (192)..(367): Pfam Name: Radical_SAM Pfam Description: Radical SAM superfamily
MEDIEDVLGPAGLSGGGAPPGLRLPLAAVAVKPKRRSSRVAQTPTQPEARIPGSQTIYVKTFGCSHNQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDISTNLPNLLNAIVQELPVDRSTMLRIGMTNPPFILEHLKEIAAVLRHPCVYSFLHVPVQSGSDAVLTAMNREYTVGEFRKVVDTLWELVPEMQIATDIICGFPGETDEDFAETVNLVKEYQFPQVHISQFYPRPGTPAARMKKVPSNDVKKRSRELTSVFESFSPYKGMEGKVERIWITEIATDGVHLVGHTKGYIQVLVIAPDSMLGTSANVKITSVGRWSVFGEVIEGSVVAGEAPKQTSSEPQKEHIQNQADAGCCATDSCGACACSDVAQHCGPERCEDIPDAPQTSGNVNHQGAVQSTLVRRNVEGSTKASESNAALSVGKEQQVNVVTRRGVNVDTILWCGLAVSFAATVALLVLLTGRISSTSSY

SEQ ID NO: 19598 - DNA, 3917 bp, Panicum virgatum
  misc_feature: Ceres CLONE 1806226
  misc_feature: Encodes the peptide sequence at SEQ ID NO. 19599
actgctgcttactgtgtgctctctctctctctcctctccccatccccttctcgagcggcacgaagcttccgacgcccgtaatggtggaatcgccagccgatcggagtccaatctgaacctgagcgctcccgaatcgtggtttcccgtcccgatcttccagaatcccgaagaaatcggtggtggaatggcggcctgcgtaccgatcgggctggtgccgctcgattcgatggtgctttggcctggcggctcgagagagcttcatctcctgtgactgcgcccttcttctcgtgctagttggtgctgggttggatcgtgcagagcgccgcctttacgccgcgaggagggttggtcggataatgagcgccagcgccgtggcgttgcgtgcggagatgggaggcggctgtggggagaaagagctggaggacgagcttgacgcgctgcttagttccggagccggtggtcagaggcggcgcccggtggacgcgggcgagagggagagggagcgggaactcagcatgttcaggagcgggtcggcgccgccgaccatagagggttccctgaatgccatcagcggcctgctccgcagcgacggggaggtggcagtgacggctgccccgattcctgatgctgaggcgttgaacgggcatggtgggctcctctcagaggaggagctccgagccgacccagcctacctgtcgtactactactctcacggaaatctgaacccgcggctgccaccgccggtcctgtccaaggaagattggcggtcaacccagcgcctgaaagctggggtggttggggggattggggacaggaggaaggcggggcaagaggacgcgggacatggtacggggattgcaggggagaggtctctgttcttaaagcatcctggttctgagcaggaggacgaaaccaggagtgacggaggtggcgctgcagagtgggttgatggtggaggagatgggctcattggtttatagcttgggcgtcagcgtagctttgcagatatgctgcaggataatattggccgcagaacacctatttcggagcacccctcccgtgcagccagtcgcaattcttttattgacaatcaagaacctgtgaactctgctgagaaccaatattctatgcatactgatattttggacgtgcatcatcctgctgggaatctgcaaaatgtcagtggtcttcatagccttaatgcatccacatctcaaacatttgcatctattctgggttcatctgtttctagaaatgctactccagatcctcattatgttgcaaggattcctagccctggccttccacctgttggtgttaggattacttccaatgagaagaaactgaattgctcctcatcaccattcaatactgtatcttcaaaagcagttggggctgatgatattttatctgcattatcaagtttgaacttatcaaaaagcggtacttcaaatggcaataacaatatcagtcgatcaaattttcagagagagacaagtgaccagcagaaattttcgctcgactcgcaaactgctcatgtcaataataagcagcacccggtgatgatagaaactgacgatgaatatttgggtatgccatcgatgtcacaaccatccaattcttcatttggtgacgttaataacggtgtggctggtctagcagagttaagaaatagtaccaacacaaggttagatgggcatttggaaatgcaaagatcttctactttatcttctcgttcatatcagaagtccccatcatcttctaatggaagccaaggtggttctcctgctcaacatcagaattttgatgctataaattcagcctttttgaactatgggctcactggatatccactcagcccaggtttgccttctatgatgccccctttgtttgaaagtgccgccgccgcctctgctatagcttcacttggtgcagattcaagaaaccttggaaatagtattttatcttcacctacattgagcctaactgatatgcataacctcggtcgaggtggtaatcaagctcccacaggtcttcagtctcctctttctgacccgttttatgcgcagtacatgaaggcaactcagtatgcagcacagggatctggcagctatggtgatccttctttggaaagaggttatgtgggtagctcatatgctaatttaaatgcagttcaaaaagcttatattgaagctttgcttcagcagcagaaacaatatgaagtgccacttctaggcaagtcagctgtttcaaatcatgggtactatggcaatttaccttttggcatgggcatggcgtacccaggaagcccattgggtagtcctgtcgcttctccatctggtccgggcagtccacttaggcttggtgagcggaatatgaggtttccgtctaacttaagaaacttgggtggctggaattctgatccaagtgcctatattaacgagaactttccatcctcacttttggatgagtttaaaagtaataaggccagaagttttgagcttgctgagatcgcggggcatgtggttgagtttagtgctgaccaatatggaagccgtttcatacagcaaaaacttgaaactgcaacagtcgaggaaaagaacatggtctttgaggagatcatgcctcatgcactatcattgatgactgatgtatttggaaattatgttgtacagaagttttttgagcatgggagtgcagagcagcggagggagttagctgataaactatttggacatgtattagctctcagtcttcagatgtatggatgccgagttatccaaaaggcaatagaggtggttgatctagaccagaaaactaagatggttactgagcttgatggtcatatcatgaaatgcgtacgcgatcaaaatggaaaccatgtgatccagaaatgtattgaatgtgtcccagaagattctattcagtttataatatcgacattctatggtcacgttgttccattatccacccacccttatggctgcagagtcatacagagagtacttgaacactgtgctgatccaaaaacacagcaaattgtcatggatgagatattgcaagctatatgcatgttggcacaggatcaatatggaaactacgttgtccagcatgttttggagcatgggaagcctcatgagagatccatcattatagaaaaattagctggacagatcattcagatgagccaacagaaatttgcctccaatgttgttgaaaagtgtctaacatttggcggacctgcagagcgagaagttctcataaatgaaatgcttggaaccactgatgagaatgagcctctacaggccatgatgaaggatcagtttggtaactatgttgtacagaaagtacttgagacatgtgatgaccagcaacgtgagttgatcctgtcacgggtgaaggtccacttaaatgccctgaagaaatatacatatgggaagcacatagttgctcgtgtagaaaaacttgttgctgctggtgagaggaggattggacttcaatcgcaaaatccttcttgatggcgtaaaaatgaccatgtacagctaaccatggctagacagatgtaccttctgccttctgctttgggctgctacaagccgagcttaaaaataaacatgtaccaagaattctgtacattttgtagtttgagcttatagttatgccaagatgaggctcagacagattaatcttacctgatgctgctgcggagaataggcgttctgtacaagttttaggtgtaaagagaggaggaaagtctatattttgcgacgagactgtacaaatctgcgatcctgcaagaggtagcgtctgcttaggataaggttttcattgtcctccgtgtttatcactaatgggtttgtaatactgaataactgatgtaacagttccagcttctaaagccagatgcgtgtttttgc

SEQ ID NO: 19599 - protein, 207 aa, Panicum virgatum
  misc_feature: Ceres CLONE 1806226
  misc_feature: The sequence is a functional homolog of SEQ ID NO 1232 in the 10/666,642 US patent application
MSASAVALRAEMGGGCGEKELEDELDALLSSGAGGQRRRPVDAGERERERELSMFRSGSAPPTIEGSLNAISGLLRSDGEVAVTAAPIPDAEALNGHGGLLSEEELRADPAYLSYYYSHGNLNPRLPPPVLSKEDWRSTQRLKAGVVGGIGDRRKAGQEDAGHGTGIAGERSLFLKHPGSEQEDETRSDGGGAAEWVDGGGDGLIGL

SEQ ID NO: 19600 - DNA, 1992 bp, Panicum virgatum
  misc_feature: Ceres CLONE 1806233
  misc_feature: Encodes the peptide sequence at SEQ ID NO. 19601
gagcagcccaaggagcgaggatagggtagggtcgacggtcgagcagccagcggcggccatggagggcggcgtgcacgagctcgacggctccaccttcaaggagtgcttctccctctcgtggaggaacccctacgtcctccgcctggccttctccgccggcatcggcggcctcctcttcggctacgacaccggtgttatttcgggtgctctgctttacatccgtgacgacttccgttcggtcgacaggaacacatggcttcaggaaatgatcgtgagcatggcggtggccggcgcgatcattggcgcggcgatcgggggctggaccacggaccggttcgggcggcggacgtcgatcctcgtggccgactttctcttcttcgcgggcgcggtggtgatggcgtcggccccgggccccgcgcagctcgtcgtgggccgcgtcttcgtcggcctcggcgtcggcatggcgtccatgacctccccgctctacatctccgaggcgtccccggccaggatccgcggcgcgctcgtcagcaccaacggcttcctcatcaccggcggccagttcctggcctacctcatcaacctcgccttcaccaaggccccggggacgtggaggtggatgctcggcgtcgccgcggtccccgccgtcgtccagttcggcctcatgctcttcctccccgaatccccgcgatggctctacagaaaggggcggccggaggaagcagaggcgatcctgcggcggatctactcggcggaggaggtggagcgggagatcgaggagctcaaggagtcggtggcggcggaggcgcgggagcgcggctcgtcggagaaggtgagcctggcggcgctgctgcggacggcgacggtgcggcggggcctggtcgccggcgtggggctgcaggtgttccagcagctggtgggcatcaacacggtgatgtactacagcccgacgatcgtgcagctcgccgggttcgcgtccaaccagacggcgctggcgctgtcgctggtcacctcggggctcaacgcgctcggctccatcgtcagcatctacttcatcgaccgcacgggccggaagaagctgctcgtcatcagcctcgtcggcgtcatcctctcgctcggcgtgctcaccgccgtgttccacgagaccacgtcccactcgccgcccgtcagcgccgccgagaccggccgcttcgacggctcgctcacgtgcccggactaccgcctgcagtcgtcggcgtcgagcggtggcttctgggactgcacccggtgcctcaaggccaggtcgacagagtgcgggttctgctcgtccggcgccggcaagctgctccccggcgcgtgcctggtgtcgaacgccacgacgcgcgacgcgtgccacggcgagggcgggcggctgtggtacacgcgcgggtgcccgagccggaacgggtggctggcgctagtggggctggcgctctacatcatcttcttctcccccgggatgggcaccgtgccgtggatcgtcaactcggagatctacccgctgcggttccgcggcgtgtgcggcggcgcggcggccacggcgaactgggtatccaacctcgccgtggcgcagtcgttcctgtcgctgacgcaggccatcggggtggcgtggacgttcctcatcttcgggggcctgtccgtggccgcgctggcgttcgtgctcgtctgcgtgccggagaccaaggggctccccatcgaggaggtggagaagatgctggagcgccgggagctcaggctcaggttctgggcgccgcgcgacgcggacggcaaggagactgccaagggcgctggcgtgtagtaattatccatcctgtggcgcgtgaaaaaccctgcgagcttctgggttaaattgttgttagtggtggcttgaggttgatcgatttctggtcgtttctaattttcattactagtctgtcaattaatgtaaaaataagatcaataattataattatccaactcacacccttttcatcc

SEQ ID NO: 19601 - protein, 585 aa, Panicum virgatum
  misc_feature: Ceres CLONE 1806233
  misc_feature (29)..(559): Pfam Name: Sugar_tr Pfam Description: Sugar (and other) transporter
MEGGVHELDGSTFKECFSLSWRNPYVLRLAFSAGIGGLLFGYDTGVISGALLYIRDDFRSVDRNTWLQEMIVSMAVAGAIIGAAIGGWTTDRFGRRTSILVADFLFFAGAVVMASAPGPAQLVVGRVFVGLGVGMASMTSPLYISEASPARIRGALVSTNGFLITGGQFLAYLINLAFTKAPGTWRWMLGVAAVPAVVQFGLMLFLPESPRWLYRKGRPEEAEAILRRIYSAEEVEREIEELKESVAAEARERGSSEKVSLAALLRTATVRRGLVAGVGLQVFQQLVGINTVMYYSPTIVQLAGFASNQTALALSLVTSGLNALGSIVSIYFIDRTGRKKLLVISLVGVILSLGVLTAVFHETTSHSPPVSAAETGRFDGSLTCPDYRLQSSASSGGFWDCTRCLKARSTECGFCSSGAGKLLPGACLVSNATTRDACHGEGGRLWYTRGCPSRNGWLALVGLALYIIFFSPGMGTVPWIVNSEIYPLRFRGVCGGAAATANWVSNLAVAQSFLSLTQAIGVAWTFLIFGGLSVAALAFVLVCVPETKGLPIEEVEKMLERRELRLRFWAPRDADGKETAKGAGV

SEQ ID NO: 19602 - DNA, 683 bp, Panicum virgatum
  misc_feature: Ceres CLONE 1806237
  misc_feature: Encodes the peptide sequence at SEQ ID NO. 19603
gtgctcttcttaggcggcttggtctctcctgccccgctttcttgtgcaggctttgacgaaaaaagctccgttttttccagcttcctcctcctccccggaaataaaattcgggggcccaaaaaattcgcaattttgggggcgctcgtggccgccgctccgcccgaattcgcgcgcctcccggagccgatcccgcgcgggccatggaaatgaagattcaattcctctctgtggttcaatgaggaactgtgcatacttaactcttgtccagttgttgctcttggggttcgttgctcccactcaaattagtctgtttgacaatcgaatccaaaggtgcagatgagtgaggagtgcaatatggatgaggccctgaaagccaaaggtgttgctgagaacaagttccgtgatcatgacatcaggggtgctcggaagtacgcaatcaaggctcagactctctgcccgtcgcttgaaggcatatctcagatggtgtccacactagaagttcatcttgcagctgagtccaagattgatggagagtgtgactggtaccggatattgtctctaggtgcctttgcagatgaagaggaagtgaagaagcagtatcggaagctagctctgctgttgcaccccgacaagaacaagtcaattggtgctgaggaggccttcaaactgatctctgaggcatg

SEQ ID NO: 19603 - protein, 115 aa, Panicum virgatum
  misc_feature: Ceres CLONE 1806237
  misc_feature (68)..(115): Pfam Name: DnaJ Pfam Description: DnaJ domain
  misc_feature: SWISSPROT Homolog: EC 2.7.11.1 Non-specific serine/threonine protein kinase
MSEECNMDEALKAKGVAENKFRDHDIRGARKYAIKAQTLCPSLEGISQMVSTLEVHLAAESKIDGECDWYRILSLGAFADEEEVKKQYRKLALLLHPDKNKSIGAEEAFKLISEA

SEQ ID NO: 19604 - DNA, 654 bp, Panicum virgatum
  misc_feature: Ceres CLONE 1806237-R
tggatcctgctgctactccggttgatcctcttaaggttattacagaggtcaaggaagatgcagcggcgcagactgctcaataggtggtggcaactctgaaaactgaagatagctagctggatgtctaaattgtcagatcacatttaattagtgacaacatgccagcacctgatggtctctacagctctactgtgtcatcttatttttggctggtgacttggacaatactgccaagacaagcagcttatgtgacggacttctgacccttttaattcttaggcatttctgacatttgattttatcactacacaaacgccacatagattaaatggtcactgggaggaggcctcttgcagcatcggtgaggcggttagtcggcagaaggtaggagcctcatgacttcggtgaaggcgttacttgtttgtgttgttactctgtaaggcgacggtatgtgctgcatacggagccgagtttgagtcttgagggaaagagctgctaggcttgcccatgtaccccgcattcgtgtgcgtgttttacttatgatgttgtattccctttaatcttatagtaattcatcgtcatgatgttggacctgataattgtagactctgattgaactcgggtaagcgattcggaaaatttagtaatatatat

SEQ ID NO: 19605 - DNA, 670 bp, Panicum virgatum
  misc_feature: Ceres CLONE 1806238
  misc_feature: Encodes the peptide sequence at SEQ ID NO. 19606
atgcttagctcccagcccggcacccatgggcgcctgcttctcctccgcctccgctgcccccgccggcgccgccgagcgccgcccctccaaggaggacaagaaggggcgccgcggcggcgcggcaaaggcggcggcggcggcggcggcccccgtgcgggtagagttcggctacgagagggacttcgaggcgcgcttcgaggtcggccgcctgctcggccacggccagttcggctacaccttcgccgccaccgaccgccagtccggggaccgcgtcgccgtcaagcgcatcgacaaggccaagatgacccgtcctgttgctgtggaggatgtgaaaagagaagtgaagattcttaaagcacttaaaggacatgagaatattgttcacttctataatgcatttgaggatgattcatacgtgtatattgtaatggaactatgtgagggtggtgaactattggaccggattttggcaaaaaaaaatagccgttacagtgagaaagatgctgctgtagtagtgcgccaaatgcttaaagtagctgccgagtgtcatctgcgtgggctagttcaccgagatatgaagcctgagaacttccttttcaaatcaaataaggaggactcaccgctaaaggcaacagattttggtttgtcagacttcataaaaccagggagg

SEQ ID NO: 19606 - protein, 214 aa, Panicum virgatum
  misc_feature: Ceres CLONE 1806238
  misc_feature (57)..(211): Pfam Name: Pkinase Pfam Description: Protein kinase domain
  misc_feature: SWISSPROT Homolog: EC 2.7.11.1 Non-specific serine/threonine protein kinase
MGACFSSASAAPAGAAERRPSKEDKKGRRGGAAKAAAAAAAPVRVEFGYERDFEARFEVGRLLGHGQFGYTFAATDRQSGDRVAVKRIDKAKMTRPVAVEDVKREVKILKALKGHENIVHFYNAFEDDSYVYIVMELCEGGELLDRILAKKNSRYSEKDAAVVVRQMLKVAAECHLRGLVHRDMKPENFLFKSNKEDSPLKATDFGLSDFIKPG

SEQ ID NO: 19607 - DNA, 647 bp, Panicum virgatum
  misc_feature: Ceres CLONE 1806238-R
  misc_feature: Encodes the peptide sequence at SEQ ID NO. 19608
atcttccttggagattgaagggtccccgtgtgcttgagattattcaagcaatcgacagcaacacagatggtcttgtggacttcaaagagttcgttgcagcaactctccatatacatcagatggccgagctggactctgaaaggtggggcattcggtgccaagctgctttcagcaaatttgatctggatggtgatggatacatcacgccagaggagcttagaatgcacactggcttaaagggatctattgagccgctgctggaggaggccgacatcaacaaagatgggagaataagcctgtctgaattccgcaagctcctgcgaactgcgagcatgagcaatgttcccagcccaagggggcctccaccaaatcctcaagctctgtgaactgcggtgaggccattagaggagcaaatttaggaagataccgtacagtagtcaatgtgttttttgtagcgtgccatgtgatgtttctgattttagcatccaggttatgtgtgcagcagtgagataagtttcaaagtaaatatttagctttttttttcacggagaagtatgagaggtcgagattgaaatgataaatgagactcagcagtcctctttctgtacagtactaaatatgtatgatttgattatactactggtctc

SEQ ID NO: 19608 - protein, 127 aa, Panicum virgatum
  misc_feature: Ceres CLONE 1806238-R
  misc_feature (51)..(79): Pfam Name: efhand Pfam Description: EF hand
  misc_feature (81)..(109): Pfam Name: efhand Pfam Description: EF hand
  misc_feature: SWISSPROT Homolog: EC 2.7.11.1 Non-specific serine/threonine protein kinase
LPWRLKGPRVLEIIQAIDSNTDGLVDFKEFVAATLHIHQMAELDSERWGIRCQAAFSKFDLDGDGYITPEELRMHTGLKGSIEPLLEEADINKDGRISLSEFRKLLRTASMSNVPSPRGPPPNPQAL

SEQ ID NO: 19609 - DNA, 556 bp, Panicum virgatum
  misc_feature: Ceres CLONE 1806247
  misc_feature: Encodes the peptide sequence at SEQ ID NO. 19610
acctccacatcgatcgtcttctgcctcgggtggggtccgccgctccttgccgcggggtcgagcgccgctgccgacgaggccgccagcaccgccgccccctatggccatggaggtcagccgcagagtcccgccgccgcacgggggggcggctcccgcggggcgccagccgcggcgccgggcggcggccgggggcgagggggagcgggagcgggtgcgggtgcacgccggggacgcgctgccgctcccgatccggcacacgaacctcttcttctcggccctcttcgccgcctcgctcgcgtacctgatgcggcgctggagggagaagatccgcgcctccacgccgctccacgtcgtctccctcgccgagatcttcgccatctgcggcctcgtcgcatctctcatctacctactgagtttcttcgggatcgcgttcgtccagtccgtcgtctccaacagcgacgacgaggaggactacctcatcgacgcccgccacgagccgtcgccggccccggccccggccccgtgcgcgctgctggggaaccccgccgccgcgccg

SEQ ID NO: 19610 - protein, 149 aa, Panicum virgatum
  misc_feature: Ceres CLONE 1806247
  misc_feature: SWISSPROT Homolog: EC 1.1.1.34 Hydroxymethylglutaryl-CoA reductase (NADPH)
MEVSRRVPPPHGGAAPAGRQPRRRAAAGGEGERERVRVHAGDALPLPIRHTNLFFSALFAASLAYLMRRWREKIRASTPLHVVSLAEIFAICGLVASLIYLLSFFGIAFVQSVVSNSDDEEDYLIDARHEPSPAPAPAPCALLGNPAAA

SEQ ID NO: 19611 - DNA, 659 bp, Panicum virgatum
  misc_feature: Ceres CLONE 1806247-R
gtttgatgccccttgggaaaatggaagagaaagggtttcgtaggtttgattccttgtggcatgcgcaggcccgcatgagggttaaaaggaagaaaacccttcaggtaaaagcgaagattcagtcgacttgtcatatatttaccaggccgtgaaagctctaggtgtcaaacacctcatggatcctggagtatgacgtatttgattattcgttggtgttgtagctgttcgtctcctgtcgttggcacttgatccctttccgccacccctcactcattcttagcatcttgttttgcccgtcccctgcgactttggagaatcagacctgaccaaggggtttgtcgtggaaccatcacagcaaggcagtcgcagccactggatacttcctccgctttggcgagaagttcgcgtcggcagaggtgcctgatgcctttgtattttcagctctgtaaatttacctttattctttttcttttaaaacttttgaaccgtagagtcgtcgtcggtgatgtgggttgtaaagaaaagatgtggtccggaacagtttttatatcttcttgtctccctcgctcgctcatctcaattgtatgttccagttgcctgcctgcccacggatcgggctttcttttttaacaataaagctgacacttcggcaaagcgcc

SEQ ID NO: 19612 - DNA, 668 bp, Panicum virgatum
  misc_feature: Ceres CLONE 1806248-R
  misc_feature: Encodes the peptide sequence at SEQ ID NO. 19613
tttcaaggagtacaagaaggtgcagcgagagaaatcagctgaccctgatattcagttgatttgtgatgattcaaacatattcaagtggactgctctcatcaagggaccctcggagactccttatgaaggtggtgtcttccagcttgcctttgctattccagagcaataccctctgctacctccccaagttcgcttcctgactaaaattttccatccaaatgttcatttcaagactggtgaaatttgcttggatatcttgaagaatgcatggagccctgcatggaccctccaatcagtttgtagagccataattgcactgatggctcatccggagccagacagcccacttaactgtgactcaggcaatctcctacgatctggcgacatcagaggttttcagtcaatggcaagaatgtacacaaagcttgctgcgatgtcaaagaaaaactaatgaatttgacatgatgtaaatggaacatgtggagcccatgggggcatgccttcatcatagctgtgattaggggtgataatgggccatgacccaaatgctttcttcacaatcctacttggtctttaattttttagctaaaaattgtataagattagagcctgacccttttagagccccgcttttaaattatctaggctaaaaattaaggcccttcacc

SEQ ID NO: 19613 - protein, 149 aa, Panicum virgatum
  misc_feature: Ceres CLONE 1806248-R
  misc_feature (2)..(140): Pfam Name: UQ_con Pfam Description: Ubiquitin-conjugating enzyme
  misc_feature: SWISSPROT Homolog: EC 6.3.2.19 Ubiquitin--protein ligase
FKEYKKVQREKSADPDIQLICDDSNIFKWTALIKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGFQSMARMYTKLAAMSKKN

SEQ ID NO: 19614 - DNA, 650 bp, Panicum virgatum
  misc_feature: Ceres CLONE 1806248
aacactccctgcctccgccttctcctttcctgctttcctcgtccccgtctcgatctgcccgcccgcccgctccacgcgccgacgcgcgaaatccgcaaaccggccctaccctccccgcaccgcctcgccgtccttcctctccctgattccccagccagatcggagctgcgaggtcgtcacggttgctgcggcccgtcaggttcgttcgttctttcctcccctaccgcttggtcgcgaggaatctggccgccccccccccccccccggctcggcaagggctcttaatcgggttggggatctggggcgccagtcgcttacttgcgattcgcatgtagagttttcggttggagtttggaactgctatccggcggatatggacctcgtgatgaatctattcgattgaatccagtttctttttattggcttgctcataaaaaaatggtggtggttggtttcctgcttgcggggttgcgaagtttctgaacacaacagatcacacatgatgtctaaatagcacactgtcaagaaaaaagactggttaattgataagtgtgtataagtgaagcagcagactagtaacacacaggttacagtgaacaggagtgatagattaacttttgatgatgtttgtttcaagctgtaagtgcagc

SEQ ID NO: 19615 - DNA, 671 bp, Panicum virgatum
  misc_feature: Ceres CLONE 1806255-R
  misc_feature: Encodes the peptide sequence at SEQ ID NO. 19616
gatcaccaggcactttagaatggatgggtggccagtattatctatacatggtgataaggctcaagctgaaagggattatgttcttgcagagtttaagagtggcaagagtcctataatggctgccacagatgtagcagcacgtggtcttgatgtgaaggacataaaatgtgtgataaattatgattttccaacaacacttgaagattatattcacaggataggtcgaactggccgtgctggtgccagtggaactgcatttacttttttcacacatgcaaatgcgaagttctcaaggaacctagtcaagattttgcgggaagctggccaagtcgtgaatcctgcactagaaaccatgtccaaatctgcaagttcgatgggaggaggcaatttccggtcgaggggcagaggtgggtttggtaaccggggtcatatgtctggatcaaatacctttccgttaggaggaagaaggccatactaatgggtgccaaggaactatgggacttctatttgtatactattaggcattaaatgcattcttcgggaaatttcagagaaattccctcaacttctataggacatcaaatcaatttgcttccgttacttattgcatctatgaagcttatgatcacatggaacatcaaattttatcataccatttgcattcaagtcag

SEQ ID NO: 19616 - protein, 158 aa, Panicum virgatum
  misc_feature: Ceres CLONE 1806255-R
  misc_feature (4)..(80): Pfam Name: Helicase_C Pfam Description: Helicase conserved C-terminal domain
ITRHFRMDGWPVLSIHGDKAQAERDYVLAEFKSGKSPIMAATDVAARGLDVKDIKCVINYDFPTTLEDYIHRIGRTGRAGASGTAFTFFTHANAKFSRNLVKILREAGQVVNPALETMSKSASSMGGGNFRSRGRGGFGNRGHMSGSNTFPLGGRRPY

SEQ ID NO: 19617 - DNA, 726 bp, Panicum virgatum
  misc_feature: Ceres CLONE 1806255
gccaccagcagatccatcccctcccctcacctttaccctcgagctcggcggcgacctcgacccgctcgctcgtcccgccaagctccttgcccctccggccaagcccgtgcccggcgccatgaacccatacgacctccgcttcgccgacccctcgtcgtaccacgacaggcgcagcgacctggccgtggctcctattgtcgctccgccggtcctcatgccggcggcgaacaatttcgccgccgcgtatccgcccgtgcctgcggcatccgctggcgtcgattacgcgcgctacgggcagggcggcagaggccgtggtggaggaggcagaggcggtggaggcggcagaggagggcgcggcagggacgggcttgacacgctcgcgctgcccaagcctgacttccggagcctgataccgtttgagaagaacttctacgtggagtctccctccgtgcaggctatgtcggatgcggaggtggcgcagtaccgccgcctacgggatatcaccgtcgagggccgggatgtgcccaagccagtccgatacttccaggaagccaacttcccagattactgcatgcaagcaattgccaaatctgggtttgtggagccgacacctatccaatctcaaggttggcctatggctctgaagggtagggatctgattggtatcgctcaaacaggctcagggaaaacattatcttatctgctacctgggttgggtcatgttgg

SEQ ID NO: 19618 - DNA, 1840 bp, Panicum virgatum
  misc_feature: Ceres CLONE 1806266
  misc_feature: Encodes the peptide sequence at SEQ ID NO. 19619
gatgctcctccaccgccgtcaccatggaggagaggagggggacgccaccgcagatgagtcgccgtcggcctccgcactccttcctttcgtttccctcgggcacgcagactccacaacggcttcgcccgagatttgaagccgggctgcggattccaagccgctaccataaataaaaaggtgaatagtaatttttttaggcttgtttgttgtggatttatatagtttgtaccagctgccgccgctgctgctgctattccaagcctgactgtgtttgttccggccgtcggattggttaccagtggagtggttgctcctgccaactagtagccccctggcctcaatgcaagtgatttgctcaagtgttgccctttaatctggactatggtatggtcctcacactttttggttcttgggctgatttgctcaagaattccaccatgtctatagtgtacctagcctactaatcatggacatattattgtgtgggtgcttagtgagttaattgctatacttgtgcacatctcacctactccctccatattgtaaaggaagtcattttttttaaaaaaaaaaggtgttcgtttatttttagcctttactgccaaaattataaatgaaaattacaggatgcagcaacatgaaacggaatccactggccaactgatggccttgggggtaaatccttccttcttatcaaggaaatcatatcattgaggcgttttactttggtagttgtaatatccttattgatttgccatttctggcatatggtttagctgtggcaattcactgattccaaactcttgcagcatcagacgtccatcgcgtaaatgttgccacttgcaaatcgtcagtgggtggcctcaaattgtcatatccttgtactgttcgtgaggctttgagtgctgcttctccacaaaatggggggcacaccttctaagcttgaagatgacaaggtccttgtgttatgccaggagaggaagcgttttgttagagaagcactagatacaagatgtgcacttgcagcttctcactaggcttatattctgtctttcagagaaactgattctcttctaaggaaatgctttgaagagtcaataacaaatgtgtcaccatctcgtttgcacctcaatcatatgaatgcaggtaggaatatgaaagctactgagcaagtgtcagttcctgctcaatcttcatttccaggtgttagagcgggcagtcaggattttaaaaatgctgatgatgttaggcgccgtcgacaagagcaagtgatccctgagctcgaagagggaaagaatagtccaacaaatggggatggtggttttgcagagtcagaagatgattttgacaatccatccactgaaactttggtgcgggcgttcaagaaccggaatgatgtgcttttgatactactcactcagactcacgacattctttaggaaacattgcttcacaaaatactgattcttgcaatcaaagcagcaaaaagaagaggacaatgattggcagatcttcactggacgttcttcctgtggatggcgaattgaagaaaccttatactgattcccaatgattcttgaggaagataaagtcaagttccgtcctctactagctgaagaaatagcacgtggattaaagccatcgagttttctagcagcattgttttcttgctgcatggaggacacatcttttcctgaatgtgagttaattttgtctgaaacgatgtgtttgcctcctttttttatcctttggagcagttttttgatatttctgtgttacaaatacaattacaaacttcttttactgagcaatcgtaatgccatactcaggtaaattgttt

SEQ ID NO: 19619 - protein, 38 aa, Panicum virgatum
  misc_feature: Ceres CLONE 1806266
  misc_feature: The sequence is a functional homolog of SEQ ID NO 1526 in the 11/479,226 US patent application
  misc_feature: The sequence is a functional homolog of SEQ ID NO 1522 in the 11/479,226 US patent application
  misc_feature: The sequence is a functional homolog of SEQ ID NO 174 in the 10/666,642 US patent application
MGGTPSKLEDDKVLVLCQERKRFVREALDTRCALAASH

SEQ ID NO: 19620 - DNA, 660 bp, Panicum virgatum
  misc_feature: Ceres CLONE 1806271-R
  misc_feature: Encodes the peptide sequence at SEQ ID NO. 19621
caagaatccttgggagaaagaaagaggtcctgcaaatgttcccagggcatctctgcccccgcaagggctgcaagcacaagcagcaggaccaggaagagttaatggctcagtgatgaattcagggtatccttcccatcagcaaatcccacaagcgtacggttaccatcaaatgcctgcaagattggacagtaccaaccaatcacaagccatgggtggttatacactgcattcgcaggcccaagcttgtgcaaacagcaaaggcacggccgatgttgctgtaaacatgagagcgcccccattccatgttccagctggccccaagaataacccgctagatagaataacatcagggactgacatatacacacgatctcttaacggcattgttgctgccgcagcagcatcagttggcactggtactggtactcacagaaatgttggtgttgtgccctccggcatgtcaaggatgtattagcttgctgcagtggttgcaaatcttagctatatgggtcacagcttcatcaggactagcctggaagaagtggcatatgctataagcaattcataagaggtgacccctagagtcttggactcctgttctcttttacccgttgttggtaagccatctaatcaggcggaaaatggtgcccatttgcgcac

SEQ ID NO: 19621 - protein, 157 aa, Panicum virgatum
  misc_feature: Ceres CLONE 1806271-R
  misc_feature: SWISSPROT Homolog: EC 2.7.11.24 Mitogen-activated protein kinase
KNPWEKERGPANVPRASLPPQGLQAQAAGPGRVNGSVMNSGYPSHQQIPQAYGYHQMPARLDSTNQSQAMGGYTLHSQAQACANSKGTADVAVNMRAPPFHVPAGPKNNPLDRITSGTDIYTRSLNGIVAAAAASVGTGTGTHRNVGVVPSGMSRMY

SEQ ID NO: 19622 - DNA, 666 bp, Panicum virgatum
  misc_feature: Ceres CLONE 1806271
ccccctttccgcatctttctttccccgacccccgtctccgcttctcttctcgagagcgcccgccgcacgcgagatcgggaggaggagccgcggcggaggagccagcaccccgcatccctgacccgtccccgccgggtgctgttgcggccgctcccccacccgcgtcggcggcgcggcctcgcggacgcagcgcccccccttgaccccctcggccccgcgcgcggcttctttggtggggcagcgaatgccgtgtgctgccgcgtagggtccggtggttgcgagggctggtgttgagtgctgcagaagggagggaagcggttcttgggccgttgggcggcggttcggtgggagatccggtgagcggggatgcagcaggtgcagcggaagaaggtgggtgcgggggttccagcgattcctgcctctttgatgtttgttcatgaatttccgggttatcttgtgttcctgggcaccgcgttgatgcttgatgtcgattccagttctaggctgctaataagcgtgagccgtcgattgctaatgttcggatcaacttttttttttaattttcctgtttgtttttgtatgttttgacgggactcgttgatgttcacaccatttgcggaatctgaatttgatctgggtactgctgtgacgcaagaggtcaaatgc

SEQ ID NO: 19623 - DNA, 2218 bp, Panicum virgatum
  misc_feature: Ceres CLONE 1806274
  misc_feature: Encodes the peptide sequence at SEQ ID NO. 19624
aggaaaaaggagatggcgaggtgtggtccgccgatgcctcatgcctgcaacaactgtgaagatttcagggagcattagggaattatactgttgggagggctgcgttgcaactctgttgaagtgcaagttagaccgtggagaagctctacaacacaagtcttgcctggaagggagaaattttgaaggtttttagcaaggagaaatgttaaggagatgggcaagaaaggaaactggtttactgcactcaagaaggccttcacctccatccccaaggagaagccatcaaatgtgcatcagctggtagcgcagtacccgccgccgcacgggcacgcgagggagaagaagcgatggggcggattcgggcggtcgcggccctacgcggagccggcgtcgccggcggcgggcgcgctgatcaacatcccactgtaccgcgagccgagcagcatcgagaagatcctcggcgacgaggagatggatcagcagcgcccgtactacgccgccaccagggcgcagtaccagatcacggccgccagacccgccgccgccgccgtagccgttagcgctgcttcagctgccgcgccgctgccacagccggtggcaacggcgcgtgagcgcgagcgcgagcgccgcagagacgacaagccggccgccgtggtgctcccgctgcccccgccgtccccgccgccgctgatcaggaggttcgaccacgacagagagcagcagcagaagctgcagcagctccaacagcacagcagggccgagacggagtggcgccatcagcagccgccgaggcggcaccgcgcggcgaggcagcgcgccgcgccgccggaccgcgcgcgcgccgcggccgtggcgatccagtccgcgttccggggctacatggcgcggcggaactaccagtcgctgcgcgggctgatccggctgcagggcgtgatgaggggcgccagcgtgcggcggcagacggcgcatgcgatgcggtgcgtgcagacgctggtgcgcgtgcaggcgcaggtgcgcgccagccgcgtcgaggccatggagcggcgcaaccggcagcaccacggcgccatgctcagggacggcggcaggtggcgcaccggctcgcaggacggcggcatctgggacgacagccggctgacgccggaggaggcggacgcgcggacgaagcggaaggtggaggccgtgatcaagcgcgagagagccctcgcctacgcctactcgcatcagctgctgaaggcgacgccgatggcggcccacgcgatcctggcggacctgcagtcgggccggagcccctggtggtggacgcccatcgagcgccgccacgagccggaggcggcctaccgccccgtcaatcccgccagcaagccccggccggctctcgccaccgcccaccgcgggatgatgacgccgacggcgatgacgacggcggcggcgacgccggcccggtcggtggtctcggcctactccaactccaagccgcggtccacgaggcccgcgcccgccaagggggcggggagcgtgagcatccgcgacgacgagagcctgacgagctgcccggcgttcggcggcgtgcccaactacatgacgccgacgctgtcggcctccgccaaggcgcgggcgcgggcgcagctcctgctccagcagcagcagcagcagcagcagcagcagaaggcggcccaggagaagcccaggttctcgttcgggctgggccagggcatcgggagctgggccaagagcccgttctggaaggcgccgtcgtcgcgggtcggcacgccggcggcgtcggtggccggcgggcgccaccggccgacgcggtcgatcagcgggctcagcgtcgactccaccgtgtccatgccggccgggatcggcaggaggcccttcaagtagatacgtgtccaagtccaaccgtgggttgcattcttcttcttcttcctccagcttctctcggacttgggatttgtaacgtgattggtggtgtgctttggtgtgggtttccaacacgtttggtggtggttcgttgtgctttacgagcaggctgctcgtaacgctggctcctttgtctcgagcccctcgcgtgtgtttgaggggccagtgagctgttgtggcatgtaaaaactcggagactccaccgaacaatcgttccgtgcgtcaagttcgttcgtgcattgctttgtcagtgagcctctttcacctaggcttcgtacagagaaattcttac

SEQ ID NO: 19624 - protein, 557 aa, Panicum virgatum
  misc_feature: Ceres CLONE 1806274
  misc_feature (209)..(229): Pfam Name: IQ Pfam Description: IQ calmodulin-binding motif
MGKKGNWFTALKKAFTSIPKEKPSNVHQLVAQYPPPHGHAREKKRWGGFGRSRPYAEPASPAAGALINIPLYREPSSIEKILGDEEMDQQRPYYAATRAQYQITAARPAAAAVAVSAASAAAPLPQPVATARERERERRRDDKPAAVVLPLPPPSPPPLIRRFDHDREQQQKLQQLQQHSRAETEWRHQQPPRRHRAARQRAAPPDRARAAAVAIQSAFRGYMARRNYQSLRGLIRLQGVMRGASVRRQTAHAMRCVQTLVRVQAQVRASRVEAMERRNRQHHGAMLRDGGRWRTGSQDGGIWDDSRLTPEEADARTKRKVEAVIKRERALAYAYSHQLLKATPMAAHAILADLQSGRSPWWWTPIERRHEPEAAYRPVNPASKPRPALATAHRGMMTPTAMTTAAATPARSVVSAYSNSKPRSTRPAPAKGAGSVSIRDDESLTSCPAFGGVPNYMTPTLSASAKARARAQLLLQQQQQQQQQQKAAQEKPRFSFGLGQGIGSWAKSPFWKAPSSRVGTPAASVAGGRHRPTRSISGLSVDSTVSMPAGIGRRPFK

SEQ ID NO: 19625 - DNA, 526 bp, Panicum virgatum
  misc_feature: Ceres CLONE 1806285
  misc_feature: Encodes the peptide sequence at SEQ ID NO. 19626
aaacgctgcgaggatcaggtgatgcggtgttagctgacgtcacacggttcgctagtgttatgctagcctgatgcggctttgtcgacgatggatagagcaaacgactcgcggcggcttccggcgctcggcttggcgtaccagacatacaactcggccgcggccgcgtcacctacccccgacaaccacagcgccttcatcgcccctggccgccccccgctggtgagcacacctggggggaagagcaacgggatccccgtgctgctcgaccgggacgacccgctcgcgcttcaaacctacctgaacatcactctgacgaactcggcggggcattcgatcagcctgaagatggatgtcaccggagcttacttcaccgcctacgtggcggggaagtactcgtgcctgctcaaacgatccggccgggcattctcgtcggcgatctgctattccgatgatccatggtcgagctccgctgccattgctgcggcgctgcagtactccgccggcgtccggagaggcggcggcggcg

SEQ ID NO: 19626 - protein, 146 aa, Panicum virgatum
  misc_feature: Ceres CLONE 1806285
  misc_feature: SWISSPROT Homolog: EC 3.2.2.22 rRNA N-glycosylase
MDRANDSRRLPALGLAYQTYNSAAAASPTPDNHSAFIAPGRPPLVSTPGGKSNGIPVLLDRDDPLALQTYLNITLTNSAGHSISLKMDVTGAYFTAYVAGKYSCLLKRSGRAFSSAICYSDDPWSSSAAIAAALQYSAGVRRGGGG

SEQ ID NO: 19627 - DNA, 538 bp, Panicum virgatum
  misc_feature: Ceres CLONE 1806285-R
  misc_feature: Encodes the peptide sequence at SEQ ID NO. 19628
tgttccccgacgggtccgagcggccgcgggggtgggtggttctccagtggaggtgccaggcggcggacgccggcgggcgggtggcggtgaggttctgcgacgggtccggctcggcctgcgagcgctgggtgttccgcagtgatggcaccgtgctcaacaccggcaccgggatggtgctggacgcgaggccgtcggccggcaagagcggccgctaggacgtcgtcgtgtcgccggccaccggcagcgccacccagcagtgggcactcatgctgtgagctctgatggcggatccgatccgtctgcaacagggctaggcagggggtcgtgttcaataaagtcgtggggggcatggttgccgaataaaggctagggccacaagtacattgccgcaagtcagcgattttgtcgctcgtcgccaaccagtcctcgaaagaccgtgggccaggtgatcggtcggccgaggccaaaccatcctcgaattagtgtgttaaacgcactatgtatctcttctatgtacacttaatagcttgctattatc

SEQ ID NO: 19628 - protein, 70 aa, Panicum virgatum
  misc_feature: Ceres CLONE 1806285-R
  misc_feature: SWISSPROT Homolog: EC 3.2.2.22 rRNA N-glycosylase
FPDGSERPRGWVVLQWRCQAADAGGRVAVRFCDGSGSACERWVFRSDGTVLNTGTGMVLDARPSAGKSGR

SEQ ID NO: 19629 - DNA, 683 bp, Panicum virgatum
  misc_feature: Ceres CLONE 1806286
  misc_feature: Encodes the peptide sequence at SEQ ID NO. 19630
aaaattaggtaagctcgtcagaccgtctccatgattgaggaagacgatgtgcaatttgctttagacaccgccccgtaaagttgttcgaagctatgcttcttatatgaacagatggccaaaattgcctttttgttcttgtgcaggatctgaacagtccgggccagctgatgtacggctcgccggtgtccaaggacctcaacctcccggtgcagccgccgatggcctcgtccgggctgctgaggtacagatcggcgcccagctcggtgctcggcgagctctgcgaggacttcctcccggccggggcccgcgccgccagccccgacgccggcgccgacggcgtcttcgccaggttcctggccgaccaccacatccgggacgacaagccggcgccggcgcctgccccggccgcgggccacttcgcgagtgaagcggacatggcctcccagcagcagcagcaaatgatgttccactcccagcaccagcaccaggagatggtggacgccaagtccgggctctaccgcaccgtcagctccggcatggaaaccgcgtccgctgcaggcgccggcgtcggttccagcaacctggctcggcggagcagctcccccgccggattcctcgatcatttgaacatggaaaacgggtacggtgccctgctggaggggcgggcatgagcatgggcttca

SEQ ID NO: 19630 - protein, 167 aa, Panicum virgatum
  misc_feature: Ceres CLONE 1806286
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
MYGSPVSKDLNLPVQPPMASSGLLRYRSAPSSVLGELCEDFLPAGARAASPDAGADGVFARFLADHHIRDDKPAPAPAPAAGHFASEADMASQQQQQMMFHSQHQHQEMVDAKSGLYRTVSSGMETASAAGAGVGSSNLARRSSSPAGFLDHLNMENGYGALLEGRA

SEQ ID NO: 19631 - DNA, 465 bp, Panicum virgatum
  misc_feature: Ceres CLONE 1806286-R
  misc_feature: Encodes the peptide sequence at SEQ ID NO. 19632
acatgctggatttggctgtcgactacatcaaggatctccagaagcaggttaaggtgttaaaggagagcaacgccaattgcacatgctcagctagcaagaatcagcagcactctgattgaagccccctaactctgcaatgtacactgtactatgcaagttcactcagcatacaaaagatgttaatgcagctcatgtttcttttgggggggtttgaatagcagcagttgggaggcttgtctacaatgctgtcactgagtatgagcaaaggggcatgaatcggtggcatcatcaagtattcaagtgatacagagatggggaagtgggaaacataggagaaagaattgtatagttcggttgtaacttcgctatatatactacccttttggtagaaagttattactttacccctactagtgcagctgtaaatgtgccgcagataaatagtagaaaaagttgaaggtgttc

SEQ ID NO: 19632 - protein, 38 aa, Panicum virgatum
  misc_feature: Ceres CLONE 1806286-R
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 180 in the 10/714,887 US patent application
  misc_feature: The sequence is a functional homolog of SEQ ID NO 180 in the 11/435,388 US patent application
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature: The sequence is a functional homolog of SEQ ID NO 188 in the 10/714,887 US patent application
  misc_feature: The sequence is a functional homolog of SEQ ID NO 188 in the 11/435,388 US patent application
  misc_feature: The sequence is a functional homolog of SEQ ID NO 190 in the 10/714,887 US patent application
  misc_feature: The sequence is a functional homolog of SEQ ID NO 190 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 192 in the 10/714,887 US patent application
  misc_feature: The sequence is a functional homolog of SEQ ID NO 192 in the 11/435,388 US patent application
  misc_feature: The sequence is a functional homolog of SEQ ID NO 16 in the 10/714,887 US patent application
  misc_feature: The sequence is a functional homolog of SEQ ID NO 16 in the 11/435,388 US patent application
  misc_feature: The sequence is a functional homolog of SEQ ID NO 662 in the 10/666,642 US patent application
  misc_feature: The sequence is a functional homolog of SEQ ID NO 26 in the 10/714,887 US patent application
  misc_feature: The sequence is a functional homolog of SEQ ID NO 26 in the 11/435,388 US patent application
  misc_feature: The sequence is a functional homolog of SEQ ID NO 392 in the 10/412,699 US patent application
  misc_feature: The sequence is a functional homolog of SEQ ID NO 913 in the 11/479,226 US patent application
  misc_feature: The sequence is a functional homolog of SEQ ID NO 184 in the 10/714,887 US patent application
  misc_feature: The sequence is a functional homolog of SEQ ID NO 184 in the 11/435,388 US patent application
  misc_feature: The sequence is a functional homolog of SEQ ID NO 182 in the 10/714,887 US patent application
  misc_feature: The sequence is a functional homolog of SEQ ID NO 182 in the 11/435,388 US patent application
  misc_feature: The sequence is a functional homolog of SEQ ID NO 170 in the 10/714,887 US patent application
  misc_feature: The sequence is a functional homolog of SEQ ID NO 170 in the 11/435,388 US patent application
  misc_feature: The sequence is a functional homolog of SEQ ID NO 1257 in the 10/412,699 US patent application
  misc_feature: The sequence is a functional homolog of SEQ ID NO 176 in the 10/714,887 US patent application
  misc_feature: The sequence is a functional homolog of SEQ ID NO 176 in the 11/435,388 US patent application
  misc_feature: The sequence is a functional homolog of SEQ ID NO 198 in the 10/714,887 US patent application
  misc_feature: The sequence is a functional homolog of SEQ ID NO 198 in the 11/435,388 US patent application
  misc_feature: Functional homolog of the protein sequence given in SEQ ID NO 50869
  misc_feature: Useful for making plants with altered lignin content
  misc_feature: The sequence is a functional homolog of SEQ ID NO 42 in the 10/714,887 US patent application
  misc_feature: The sequence is a functional homolog of SEQ ID NO 42 in the 11/435,388 US patent application
  misc_feature: The sequence is a functional homolog of SEQ ID NO 168 in the 10/714,887 US patent application
  misc_feature: The sequence is a functional homolog of SEQ ID NO 168 in the 11/435,388 US patent application
  misc_feature: The sequence is a functional homolog of SEQ ID NO 196 in the 10/714,887 US patent application
  misc_feature: The sequence is a functional homolog of SEQ ID NO 196 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
MLDLAVDYIKDLQKQVKVLKESNANCTCSASKNQQHSD

SEQ ID NO: 19633 - DNA, 1959 bp, Panicum virgatum
  misc_feature: Ceres CLONE 1806289
  misc_feature: Encodes the peptide sequence at SEQ ID NO. 19634
agggaggggtcgaactgtcgaagcgaacaaaaacaccagaccacaccgcgagaagagagcgcagccttctcgcctccgctcctcagtcatggcagccggcggcgtcgtcgccgagcccaagaccaagtacgatcgccagctcaggatatggggtgatcaagggcaagcggcactagagaaggctagcatatgcttgcttaattgtggtcctactggaactgaagcactgaagaatctcgtgcttggaggaataggaagtgtcacagttgttgatggctccaaagttgaagcatctgatctggggaataactttttattggatgaaggatgtttggggcagccaagagctaaatccatatgctctttcctacaagagctgaatgatgctgttaaagccaagtttgttgaggagactccagcaactttgatagacactaatccttcattcttttcccagttcactgttgtcattgctactcagcttccggaaagttctttactgaagctagatgatatctgcagaaaagctgatatcgtgttggttgctgcacgttcttatggtctaactggcctggtcagggtcagcgtcaaggaacatagtgtcatagaatcaaaaccagaccatttcttggatgatttgcgccttcacaatccatgggctgaactcaagcagtttgcgaaatcaattgacataagtgataaagatcctgttgtgcacaagcatacaccatacattgttatcctcgtgaggcttgcagaaaaatgggcagattcacatgatggtaatttaccttcaactaggcaagagaaaagggagtttaaggacctgattagggcccatatgcttaatgtagatgaagaaaattacaaagaagctgtggagtcttcatataaagtatcagttactccaggaatcagtaatgagatccgtcagataattgatgataactccgcagaagtcaattcatcttcgtcagatttctggattttggtggctgctttgaaggaatttgttgcaaatgagggcaatggcgagctgcctctcgagggaacaattcctgacatgacttcacttactgagtattatgtaagcctacaaaagatttaccaagctaaggctgaagctgactgtcgtgccatggagcatcgcataaaggatatcttgaagcggattggtagacatccggatactatttcaagggcatatatcaaaacattttgtaaaaatgctagaaaactcagggtttgtagatatcgtagcatcgaggagtttagctctcccaatgtctctgaggttcaaaggtatttcaccgatgaagattacagttatgcaatgaacttctacattctactacgcgccgtggatcgattgtctgccaactataatagattgcctggaattttcgacagtgaaattgatgaggatatccctaggctgaagactgttgccgcttcagtgctaagtgagatgggcttgagcggagcatccttatctgaagatctgataactgagatgtgccggtttgggggcgcagagattcatacagtggctgcttttattggtggcgttgcttcccaagaagtaataaagttggtgaccaagcagtttgtgcccctgcggggaacatttatattcaacggaatcgacctcaaatcacaagttttggagctataacatgactgtggagcgttctgtcctattcgccgcatttgagttgccccagattttgtgccgtggcctcgcgctgcaatgaaatcagtttgcccgtgtacttagccaagatcagatctgaactgcatcattgtaccaacgagtagcttaattggcatgatattttgatgagtggcattcccaccatgtagcttcatataatctgctgctctatttccaccttttgggacacggaaaatgaatcctagaaaagtggtcaatatttatgaatgcattagatatctacc

SEQ ID NO: 19634 - protein, 528 aa, Panicum virgatum
  misc_feature: Ceres CLONE 1806289
  misc_feature (30)..(166): Pfam Name: ThiF Pfam Description: ThiF family
  misc_feature: Functional homolog of the protein sequence given in SEQ ID NO 50870
  misc_feature: Useful for making plants with modulated biomass
MAAGGVVAEPKTKYDRQLRIWGDQGQAALEKASICLLNCGPTGTEALKNLVLGGIGSVTVVDGSKVEASDLGNNFLLDEGCLGQPRAKSICSFLQELNDAVKAKFVEETPATLIDTNPSFFSQFTVVIATQLPESSLLKLDDICRKADIVLVAARSYGLTGLVRVSVKEHSVIESKPDHFLDDLRLHNPWAELKQFAKSIDISDKDPVVHKHTPYIVILVRLAEKWADSHDGNLPSTRQEKREFKDLIRAHMLNVDEENYKEAVESSYKVSVTPGISNEIRQIIDDNSAEVNSSSSDFWILVAALKEFVANEGNGELPLEGTIPDMTSLTEYYVSLQKIYQAKAEADCRAMEHRIKDILKRIGRHPDTISRAYIKTFCKNARKLRVCRYRSIEEFSSPNVSEVQRYFTDEDYSYAMNFYILLRAVDRLSANYNRLPGIFDSEIDEDIPRLKTVAASVLSEMGLSGASLSEDLITEMCRFGGAEIHTVAAFIGGVASQEVIKLVTKQFVPLRGTFIFNGIDLKSQVLEL

SEQ ID NO: 19635 - DNA, 2419 bp, Panicum virgatum
  misc_feature: Ceres CLONE 1806302
  misc_feature: Encodes the peptide sequence at SEQ ID NO. 19636
aacccgcccgccaagaacagcagaacgcaacagaacacagtaacgaacagggcagcaagcagagcaaggggaatggggatcctcctctccccctgctatttttcgcccctcgtgagatggcgccgcccggggggtgaaatgacctgatcgggcgcgccgggcctgaccccgctgctgctgctcggcgtcgtgcgtgacgggagcgggaggggggcggagccgcgacgccgttgcggctgcggttgcggcttcctccttctctcatccccccgcccggagccgcggcagcggaggacccgcacccgcacggcctcgagagtttgatcgtctcgtggcgcgccatgtcgtctaattcttcgaccagcccgccggcggctccgtcgccgacgaagagcagacttgctccttcggccgccccgccgccgtcagcggactcgccgtccccaccgtcgccgccggtggcttcgtcctcgccggctccaccagagcgaagcggctccttgccgccgccgccgccgccgaggtcccggggctctgcgatctcgccggccaagacccactctccatctccaccaccaccaccaccagagcaatcgtctagaggctcacatggcggtggcagtccgccgccgccaccggtttctacgcaccgtggcggtcccaccatggtggaagtcgttttcgccgctgccggcgccgcggcgctcctcgtcatcctcatcgccgcctgcgtctgctgctcgaggaggacggcgccgaggaggaggaagagaccccacaatcccatgcattactacgccgacacgtcatcagcgtataaagggagcagcacgtactacacaacgagtgggccgcagcagcaatggcagagcgacgctggccaggcgacgccgatgagcagcttcggcccgccggggggtggctggcacgcgccgccgcccgacatgacctccggtgtgtactccagctcgccgcggccgccgccttcaccacacgaggcgctggggctcggcaagggcaccttcacctacgagcagctggcggcggccacagccaacttctcgccggcgaacctgctcgggcagggcgggttcgggtacgtgcacaagggcgtgctccccggcggcagggtggtggccgtgaagcagctcaagtccgggagcgggcaaggggagcgcgagttccagaccgaggtggacatcatcagccgggtgcaccaccggcacctcgtgtccctcgtcggctactgcatcgccggcgcgcggcgcatgctcgtctacgagttcgtgcccaacaggaccctcgagttccacctccacgggaaagggcagccggtgatggagtgtccgacgagactccgcatcgcgctgggggcggcgaaaggactcgcctacctgcacgaagactgccatcctcggatcattcaccgcgacatcaagtccgccaacattcttctcgacaacaacttcgaagcaatggtcgcggacttcgggctggccaagctgacctccgacagcagcacgcacgtctcgacccgcgtcatgggcacgttcgggtacctggcgccggagtacgcgtcgagcgggaagctgacggagaagtcggacgtcttctcctacggcgtgatgctgctggagctcctcacggggcggcggcccgtcgacggcggcaccgccgtcagctcgttcctcgaggacagcctcgtcgactgggcgaggccggccctgtcgcgcgcgctggccgacggcgactacgacggcgtcgcggacccgaggctgcacggcagctacgaccccgtggagatggcgcggctggtcgccagcgccgcggccgccgtgcgccactcggccaagaagcgccccaagatgagccagatcgtgagggcgctggagggggacatgtcgctggaggacctgaacgagggggtgcggcccgggcagagcatggcgttcggcacggcggcgtcagcgccctcgtacaaggccaacagggctcccgggcagtacacgtcggacatggagcggatcaggcaggcgccgatggcgatcggagagtccagtggcggcgcggtcaccgggttcggccgtccctcgccgatcgggatcgaggggcccttcgacgacgacgaattgagtccggtgaagggtccgccgcgccggtagcaggctagcagccgtgtacgccagtgctgtcggaccgttgcgattcatgctcgccgcgcctgttgttgattgcgcgatcgtcctgctctggcgtctgtgaatagcttgcctcttctttgccaccagtcgcttctgacgcagcctgcaagctgatgtacttatcaaaatcacacggcgaaagtgcagatgaacagggatacccatacgcttgtgttttaacaagcagagctgagcacgcaacaatggttggcatgcgc

SEQ ID NO: 19636 - protein, 606 aa, Panicum virgatum
  misc_feature: Ceres CLONE 1806302
  misc_feature (240)..(516): Pfam Name: Pkinase_Tyr Pfam Description: Protein tyrosine kinase
  misc_feature: SWISSPROT Homolog: EC 2.7.11.1 Non-specific serine/threonine protein kinase
MSSNSSTSPPAAPSPTKSRLAPSAAPPPSADSPSPPSPPVASSSPAPPERSGSLPPPPPPRSRGSAISPAKTHSPSPPPPPPEQSSRGSHGGGSPPPPPVSTHRGGPTMVEVVFAAAGAAALLVILIAACVCCSRRTAPRRRKRPHNPMHYYADTSSAYKGSSTYYTTSGPQQQWQSDAGQATPMSSFGPPGGGWHAPPPDMTSGVYSSSPRPPPSPHEALGLGKGTFTYEQLAAATANFSPANLLGQGGFGYVHKGVLPGGRVVAVKQLKSGSGQGEREFQTEVDIISRVHHRHLVSLVGYCIAGARRMLVYEFVPNRTLEFHLHGKGQPVMECPTRLRIALGAAKGLAYLHEDCHPRIIHRDIKSANILLDNNFEAMVADFGLAKLTSDSSTHVSTRVMGTFGYLAPEYASSGKLTEKSDVFSYGVMLLELLTGRRPVDGGTAVSSFLEDSLVDWARPALSRALADGDYDGVADPRLHGSYDPVEMARLVASAAAAVRHSAKKRPKMSQIVRALEGDMSLEDLNEGVRPGQSMAFGTAASAPSYKANRAPGQYTSDMERIRQAPMAIGESSGGAVTGFGRPSPIGIEGPFDDDELSPVKGPPRR

SEQ ID NO: 19637 - DNA, 691 bp, Panicum virgatum
  misc_feature: Ceres CLONE 1806307
  misc_feature: Encodes the peptide sequence at SEQ ID NO. 19638
ttttcgaaatcaaaccgaaacggcgaaacccccatcctccatcggagagagagagggagagagaggatagcccgagcagcggttgcggtttccctctccgtcgctctcgccgcccgccgccgccggtgtgtccggagcggaaggcacggggcggcggccagctccggtgctccggcccccttcacccccaaccggcggcccccctttgtcaggtcgccaatccacttcgccctcccacccttttgccccccgatcgatctcctttctcgctaagcaaaccctcttcttaaccccccgcccggcggcggtcggtaattgcggcggcagtggaggttcgggtgcgggaagtgagggatccgagattctttcctattctttgcgattctctttcccgtgcgacggctgaagcggaggtggcggcgggggagagcagccgccggttcccggccttggagggcccccggcccgtctatggaacttgctgccctggcgccatgccccagcccggaaccgaagtgcgcagcaaggcgctgcttgcctgcacctctcacgctgctggttcctgctgtggtagtctgctgcttggttcttgctccacgctgaggaattgtgggactgcgacgatggtgccgcggatgttgctgcttgtctgcttctgcctcctggcattcccgccacctggtccgctagc

SEQ ID NO: 19638 - protein, 65 aa, Panicum virgatum
  misc_feature: Ceres CLONE 1806307
  misc_feature: Functional homolog of the protein sequence given in SEQ ID NO 50871
  misc_feature: Useful for making plants with altered carbohydrate content
MPQPGTEVRSKALLACTSHAAGSCCGSLLLGSCSTLRNCGTATMVPRMLLLVCFCLLAFPPPGPL

SEQ ID NO: 19639 - DNA, 666 bp, Panicum virgatum
  misc_feature: Ceres CLONE 1806307-R
  misc_feature: Encodes the peptide sequence at SEQ ID NO. 19640
aatgttgatccaaataccagcctgcactatgacaacatgtttgatgctcagatagatgcagcttatgctgctctacatgccgcaggctatgattacatggaggttcgggtggcagagactggctgggcatctagtggagatcaaaatgaagcaggggcttcatctgagaatgcaaggacatataatttcaatctccgtaaaaggctcttccttaggaagggaactcctctgaagccaaaaagaccagtgaaagcttatatatttgctctgtttaatgagaatcagaagcctggacctagctccgagaggcactatgggctgttccttccagatggaaggatttcatatgacattggtgtctctggtctacttccttcatctgcatcctcatccatgctgtccgtgaagaaaattcgagctgggggttggattttacactatttggctatggttcttttatctattttcatttttgggccatagtgaattgaggaagggatagcaaatctgtagtaaaggtacaactgagcaagttagaatgttgggaatgggaaggtcacaatgaaaattcaaatactagtaccatgcccatgagttcttattcttgcaataactattatcctcatgctgatctgctttttgatgaaaaacatactcagtttatct

SEQ ID NO: 19640 - protein, 160 aa, Panicum virgatum
  misc_feature: Ceres CLONE 1806307-R
  misc_feature: SWISSPROT Homolog: EC 3.2.1.39 Glucan endo-1,3-beta-D-glucosidase
  misc_feature: Functional homolog of the protein sequence given in SEQ ID NO 50871
  misc_feature: Useful for making plants with altered carbohydrate content
  misc_feature: Functional homolog of the protein sequence given in SEQ ID NO 50872
  misc_feature: Useful for making plants with altered cell wall content and/or composition
NVDPNTSLHYDNMFDAQIDAAYAALHAAGYDYMEVRVAETGWASSGDQNEAGASSENARTYNFNLRKRLFLRKGTPLKPKRPVKAYIFALFNENQKPGPSSERHYGLFLPDGRISYDIGVSGLLPSSASSSMLSVKKIRAGGWILHYLAMVLLSIFIFGP

SEQ ID NO: 19641 - DNA, 2102 bp, Panicum virgatum
  misc_feature: Ceres CLONE 1806308
  misc_feature: Encodes the peptide sequence at SEQ ID NO. 19642
accgcacagtaatactagcagtactataattaacctaacctctaattaacctcgtagtagtatgagtatgcatctatatatcgtgtgtattattagtactaagtgatgagtacgtacgtactggtttgcgttggcaattacattaatagcaagcaatatactaattaattaattcatctgcagctagcagcagcagcaggcatatggattcgtcggcagcagcaacgacgacgatgccccggcctgtggtgcgacccaagaggaagaaggttctggtggactacctggtgacattccgatggatccccgccatcttcgtggcccttcccctctccgctctcatccacctctgcatctacatcggcggcgtgctggcctccatcaagtccgaggagcgccggcgcagggagcacgaggagaacgtcgccaaggtcgtgaggcgcctcaagcagagggatcccaagagggacggcctcgtctgcacggccaggaagccatgggtggtggtggggatgcgcaacgtcgactacaagcgcgcccgccgcttcgaggtcgacctctccgcgttccacaacatcctggagatcgacaccgagaggatggtcgccagggtggagcccctcgtcagcatgggccagctcaccaaggtcacctgccccatgaacctctccctcgccgtggcccccgagttcgacgacctcaccgtcggcggcctcatcaacagctacggcatctcggggagctcgcacatctacggcctcttctccgacacggtcgtggccatggaggtggtcctggcggatggccgggtcgtgagggccaccaaggacaacgagcactcggacctcttctacggcatgccatggtcgcagggcaccatcggcttcgtggtcgcggcggagatcaagctcattcgcatcaaggagtacatgaggctgacctacactccggtgagggggacgctcaaggagatagcgcaggcctacgcagactccttctccttctcgttcagcagcagcagcagagacgatgctgttggtgattccaaaaagcagcagcaggtccctgacttcgtggaaggcatggtgtactccccctccgaaggcgtgatgatgaccggcgtgtacgccacggcggaggaggccaagaagaagggcaaccggatcaaccgcgtgggctggtggttcaagccctggttctaccagtacgcccagacggctctgaagcggggcgagttcgtggagtacatccccacgagggagtactaccaccggcacaccaggtccctctactgggaggccaagctcatcatccctttcgccgaccagttctggttcaggttcctgctcggctggctcatgccgcccaagatcaccttgctcaagatcacccagggggaggccatcaggaactactaccatgacaaccatgtcatccaggacgtgctggtgccgctgcacaaagtcggagaagtgctcgaatttgggcaccgagaactggaggtctaccctgtttggctctgccctcatcgcctgttcaaggcccccgtgaaggcgatggtgcagccggaaccagggttcgagcagcatccccggcagggcgacagcagctacgcccagatgtacaccgacgtgggcttctactacgcccccggcgccgtgctgcgcggcgaggagttcgacggcgccgaggcggtgcggaagctggagcagtggctcatcagcaaccacgggtaccaggcgcagtacgccgtgtcggagctcagcgagaaggacttctggaggatgttcgacccctcccactacgaccactgccgccgcaagtacggcgccgtgggcaccttcatgagcaactactacaagtccaagaaggggaggaagacggacaaggaggtcagggaggcggaggcggaggccatcgtcgaagctgctgctgccgaggcagacgccgccgaatgatccagctccaactgcagtccagtccaataacgcatagcatgcttttagtttagtttaatgaatgaattgtagtaggctgccagtatgcatgcatgcatgcatccagatgaatgatgtgtgtccgttccgttgtttgtttcccag

SEQ ID NO: 19642 - protein, 574 aa, Panicum virgatum
  misc_feature: Ceres CLONE 1806308
  misc_feature (52)..(197): Pfam Name: FAD_binding_4 Pfam Description: FAD binding domain
  misc_feature: SWISSPROT Homolog: EC 1.1.3.8 L-gulonolactone oxidase
MPRPVVRPKRKKVLVDYLVTFRWIPAIFVALPLSALIHLCIYIGGVLASIKSEERRRREHEENVAKVVRRLKQRDPKRDGLVCTARKPWVVVGMRNVDYKRARRFEVDLSAFHNILEIDTERMVARVEPLVSMGQLTKVTCPMNLSLAVAPEFDDLTVGGLINSYGISGSSHIYGLFSDTVVAMEVVLADGRVVRATKDNEHSDLFYGMPWSQGTIGFVVAAEIKLIRIKEYMRLTYTPVRGTLKEIAQAYADSFSFSFSSSSRDDAVGDSKKQQQVPDFVEGMVYSPSEGVMMTGVYATAEEAKKKGNRINRVGWWFKPWFYQYAQTALKRGEFVEYIPTREYYHRHTRSLYWEAKLIIPFADQFWFRFLLGWLMPPKITLLKITQGEAIRNYYHDNHVIQDVLVPLHKVGEVLEFGHRELEVYPVWLCPHRLFKAPVKAMVQPEPGFEQHPRQGDSSYAQMYTDVGFYYAPGAVLRGEEFDGAEAVRKLEQWLISNHGYQAQYAVSELSEKDFWRMFDPSHYDHCRRKYGAVGTFMSNYYKSKKGRKTDKEVREAEAEAIVEAAAAEADAAE

SEQ ID NO: 19643 - DNA, 279 bp, Panicum virgatum
  misc_feature: Ceres CLONE 1806310
  misc_feature: Encodes the peptide sequence at SEQ ID NO. 19644
aagaacacaccataccattaacacactacatcctctgctttcttcgagccttttcgccttccttcctcgtctaaccatgtcgacctgcggcaactgcgactgcgctgacaagagccagtgcgtgaagaagggaaacagctacggcatcgatattgttgagaccgagaagagctacatcgacaaggtgatcgttgccgcagaagctgccgagcatgacaggaagcgccagcgaggcgccgtctgcgcctgcgacgacggccgaggtggccaccgacaagc

SEQ ID NO: 19644 - protein, 67 aa, Panicum virgatum
  misc_feature: Ceres CLONE 1806310
  misc_feature: Functional homolog of the protein sequence given in SEQ ID NO 50873
  misc_feature: Useful for making plants with modulated nitrogen use efficiency
MSTCGNCDCADKSQCVKKGNSYGIDIVETEKSYIDKVIVAAEAAEHDRKRQRGAVCACDDGRGGHRQ

SEQ ID NO: 19645 - DNA, 185 bp, Panicum virgatum
  misc_feature: Ceres CLONE 1806310-R
ataaacgtttgcaatgcataaaaaacaaaaggacaaaaaaaacggaaggaggtgtgggtatgtactttaataattcgggcaggctgataggttgtaagatgggataacgcagtatcatctgtgttatctctgtcctgtgttacaactctcctatctatcctagtcaatgaaatattattagtatg

SEQ ID NO: 19646 - DNA, 2267 bp, Panicum virgatum
  misc_feature: Ceres CLONE 1806315
  misc_feature: Encodes the peptide sequence at SEQ ID NO. 19647
aaacccaaccccagctccgcctccgatcctcactcgaggtcgccccaagctccaccgtcactactcacgtccgttccctctgctcttgctccgctcgatcagctggctccgtcgatcatccgaccccaattctcagttctcagctactcctgaccgatttgatcagcttcccccgaccggcaatggcgtcgtccgtcactgctcccccggcggctccggccgccgtgcaggcgccggccaagtccaagaagccgtcgcagctcaaccccggcactggcaaggccaggaccgcggcccccgcgcggccaatgcgcgccgctccaccggagcggcgcggcggcgaggcgggcagcgcctccgggcccaagtggaacccgctccagcgtctcgcggcggcggcgctggacgccgtggaggaggggctcgtggcggggctcctcgagcgcgcgcacccgctcccgcggacggcggacccggccgtgcagatcgcgggcaactacgcgcccgtcggggagcgcccgccccgccgcggcgagcagctccccgtcgccggccgcgtcccggcgtgcctggacggggtctacgtccgcaacggcgccaacccgctccacgcgccgcgcgccgggcaccacctcttcgacggcgacgggatgctgcacgccgtgcggctccgcggcggccgcgccgagtcctacgcgtgccggttcacggagacggcgcggctccggcaggagcgcgccatcggccgggcggtcttccccaaggccatcggcgagctccacggccactcgggcgtggcgcgcctgctcctcttcggggcccgctccctctgcggcgtgctcgacgcctcgcaggggatcggggtcgccaacgccggcctcgtctaccacaacaaccgcctcctcgccatgtccgaggacgacctcccgtaccacgtgcgcgtcaccgccgacggcgacctcgagaccgtcggccgctacgacttcggcggccagcttgacggcaccatgatcgcgcaccccaagctcgacccggccaccgacgagctcttcgcgctcagctacaatgtcgtctccaagccgtacctcaagtacttctacttcaccgccgacggccgcaagtcccccgacgtcgagatccccgtcgacgcgcccaccatgatgcacgacttcgccatcaccgagaaccacgccatcatcccggaccagcagatcgtcttcaagctccaggagatggtgctcggcggctccccggtggtgtacgacaggagcaagaccgcgcggttcggggtgctgccgaagcgcgccgccgacgcgttgcagctccggtgggtggaggtccccgactgcttctgcttccacctctggaacgcgtgggaggacgaggccaccggcgagatcgtggtgatcgggtcctgcatgacccccgccgacgccgtgttcaacgagtcctccggcggggaggagagcttccgcagcgtgctctcggagatccggctgaacccgcgcgccggcacgtcccggcggcgcgcggtgctgagcgacgccgaccaggtgaacctcgaggccggcatggtgaaccggcagctgctcgggcgccagacccgctacgcctacctcgccatcgccgagccgtggcccaaggtgtccggcttcgccaaggtggacctggaggccggcaccgtcgagaagttcatctacggcgagggccggtacggcggcgagccctgcttcgtgccgcgcccggacgccggcgccggcgccgccgaggacgacgggtacgtgctgtgctacgtgcacgacgaggcgcacggcgcgtcggagttgctcgtcgtgaacgcccgcgacatgcgggcggaggccgccgtcaagctgccggggcgcgtgccgtacgggctgcacggcacgttcatcgccggcgaggagctgcagcggcaggcctagcgggccggcggcgcgagctgcctcggcgatcacgaactcgaccacctcgcgtacatacagacttgttacagagcacacagtagctaccaggctgctagtgacgtggcaactaaattattcacagctagttgttgcttagcttagtacagggaattttttttcattagagcagtagataggatgctgattacggccgtgtggtacttatttttggggcagacgtacggcggccgtatatgtgtatagtacctagtatatatatagatgtatataggatttacaaaattgtagaattttctgagaaataaagggatttatgtacat

SEQ ID NO: 19647 - protein, 586 aa, Panicum virgatum
  misc_feature: Ceres CLONE 1806315
  misc_feature (82)..(579): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature: Functional homolog of the protein sequence given in SEQ ID NO 50874
  misc_feature: Useful for making plants with modulated water use efficiency
  misc_feature: The sequence is a functional homolog of SEQ ID NO 6 in US patent 7049487
  misc_feature: Functional homolog of the protein sequence given in SEQ ID NO 50875
  misc_feature: Useful for making plants with modulated drought sensitivity
MASSVTAPPAAPAAVQAPAKSKKPSQLNPGTGKARTAAPARPMRAAPPERRGGEAGSASGPKWNPLQRLAAAALDAVEEGLVAGLLERAHPLPRTADPAVQIAGNYAPVGERPPRRGEQLPVAGRVPACLDGVYVRNGANPLHAPRAGHHLFDGDGMLHAVRLRGGRAESYACRFTETARLRQERAIGRAVFPKAIGELHGHSGVARLLLFGARSLCGVLDASQGIGVANAGLVYHNNRLLAMSEDDLPYHVRVTADGDLETVGRYDFGGQLDGTMIAHPKLDPATDELFALSYNVVSKPYLKYFYFTADGRKSPDVEIPVDAPTMMHDFAITENHAIIPDQQIVFKLQEMVLGGSPVVYDRSKTARFGVLPKRAADALQLRWVEVPDCFCFHLWNAWEDEATGEIVVIGSCMTPADAVFNESSGGEESFRSVLSEIRLNPRAGTSRRRAVLSDADQVNLEAGMVNRQLLGRQTRYAYLAIAEPWPKVSGFAKVDLEAGTVEKFIYGEGRYGGEPCFVPRPDAGAGAAEDDGYVLCYVHDEAHGASELLVVNARDMRAEAAVKLPGRVPYGLHGTFIAGEELQRQA

SEQ ID NO: 19648 - DNA, 2374 bp, Panicum virgatum
  misc_feature: Ceres CLONE 1806322
  misc_feature: Encodes the peptide sequence at SEQ ID NO. 19649
gcgctctcttctctctcctcgcgacgccgccgttgggagccctgccctgaccccgggagagccccaacccttatcaaaccctaaaccagaaaacctaccccccaaaaaaatccgcaaaaaatcccagaaaaaatcaccaccacccgatcggagatggcggcgcaggggcagcaggcggcggcagcggcggctggatccgcgtccgagtccggcggcggctccccggcggctccggccgtggcggcggctgccggggcggcgttccccgcgacctcgctgtacgtgggcgacctgcacgagagcgtgcaggacgcgcagctgttcgacgtcttcagccaggtcggcggtgtcgtctccgtccgcgtctgcagggacataaactcccgcaagtcgctcgggtacgcctacgtcaactacaacaacccggccgacgctgcacgggcccttgaactgcttaacttcactcctatcaatggaaagcctatcaggatcatgtattctaaccgtgaccccagctcgcgcaaaagtggcacaggaaatatatttattaagaatcttgataaatcaatagacaacaaagctttgtatgacacgttctgtgcatttgggaacatcctttcatgtaaaattgctacagacccctcgggagaatcaaggggctatggctttgttcagtttgagagggatgaatctgctcagtctgctattgataagcttaatggaatgcttatcaatgacaagaaagtgtatgttggaccttttgttcgcaagcaggaccgtgaaaatgtctccagcaatgtcaagttcagcaatgtttatgtgaagaatctgtctgagactgtaactgatgatgagttgaaggagatgtttggaaaatatggaaccataactagtgctgttgttatgagggacactgatggaaaatccaggtgttttggatttgtcaattttgaaaatgctgatgatgctgctcaggctgttcaagagttgaatggcaaagtattcaatgaaaaggaattgtatgttggaagagcacagaagaagtcagaaagagagatggagttgaaggagaaatttgaaaagaatattcaagaagtaactgagaagttccaaaacactaacttgtatctgaaaaacttagaggacaatgttgatgatgagaagttgcgtgaactctttgctgactatggctccattacttcctgcaaggttatgcgggattcaaatggtgtcagcagagggtctggatttgttgctttcaaatccgcggatgatgctgcccgcgctctcactgaaatgaatggtaaaatggttggaagcaagcccctttatgtagctcttgcgcagcggaaagaagacaggaaggcaaagctacaggcacaattttcacaaatgcgtcctgttgcaatgggaccttccgttggtcctcgcatgcccatgtttccacctggtgttcctggagttggtcaacagctgttttatggtcagccacctccagccttcatcaaccctcaggctggatttgccttccagcaacctttgatgcctgggatgaggcctgggggtccaatgccaaactttatgatgccaatggttcagcaagggcagcaaccacagcgtcctgctggtaggcgtgctggtgctggtgctggtggaatgcagcaacccatgccaatggggggtcagcaacagatgttccctagaggtgggcgtgggtaccgctatcccactggacgtggaatgcctgatcctggcatgcatggtattggggctgtgatgccatctccatatgagatgggtgggatgccaattagagatgctggcgtgtcacaacctgttccaattggggcactagccactgcgcttgccaacgccccaccggatcagcagaggctgatgcttggtgagaacctgtatcctctagttgatcagctggagcatgagcaggctgccaaggtgactggcatgcttttggagatggaccagacggaggtcctgcacctgctggagtcaccagatgcgctcaaggccaaggttgctgaagccatggaggtcctccgctccgcccagcatctccagccgaccaatgcttcccccgagcagcagctggctaatctgtccctgaatgacggcgtcgtctccagctgaatgtgtccgatgacttgatagattggaggctgctggcaatttttgcttgatacctatcctatctagagtgcaatgacttggtttgcttggtttattggagttttagcttgctctataattagctgaactagggttggtctagatttgtcatggattggttgttttggttgtatggatatgttgtttcatcgaagatgtcgggttatcaccaaatttattactgttc

SEQ ID NO: 19649 - protein, 664 aa, Panicum virgatum
  misc_feature: Ceres CLONE 1806322
  misc_feature (221)..(291): Pfam Name: RRM_1 Pfam Description: RNA recognition motif. (a.k.a. RRM, RBD, or RNP domain)
  misc_feature (324)..(394): Pfam Name: RRM_1 Pfam Description: RNA recognition motif. (a.k.a. RRM, RBD, or RNP domain)
  misc_feature (42)..(113): Pfam Name: RRM_1 Pfam Description: RNA recognition motif. (a.k.a. RRM, RBD, or RNP domain)
  misc_feature (130)..(200): Pfam Name: RRM_1 Pfam Description: RNA recognition motif. (a.k.a. RRM, RBD, or RNP domain)
  misc_feature (564)..(635): Pfam Name: PABP Pfam Description: Poly-adenylate binding protein, unique domain
  misc_feature: SWISSPROT Homolog: EC 5.2.1.8 Peptidylprolyl isomerase
MAAQGQQAAAAAAGSASESGGGSPAAPAVAAAAGAAFPATSLYVGDLHESVQDAQLFDVFSQVGGVVSVRVCRDINSRKSLGYAYVNYNNPADAARALELLNFTPINGKPIRIMYSNRDPSSRKSGTGNIFIKNLDKSIDNKALYDTFCAFGNILSCKIATDPSGESRGYGFVQFERDESAQSAIDKLNGMLINDKKVYVGPFVRKQDRENVSSNVKFSNVYVKNLSETVTDDELKEMFGKYGTITSAVVMRDTDGKSRCFGFVNFENADDAAQAVQELNGKVFNEKELYVGRAQKKSEREMELKEKFEKNIQEVTEKFQNTNLYLKNLEDNVDDEKLRELFADYGSITSCKVMRDSNGVSRGSGFVAFKSADDAARALTEMNGKMVGSKPLYVALAQRKEDRKAKLQAQFSQMRPVAMGPSVGPRMPMFPPGVPGVGQQLFYGQPPPAFINPQAGFAFQQPLMPGMRPGGPMPNFMMPMVQQGQQPQRPAGRRAGAGAGGMQQPMPMGGQQQMFPRGGRGYRYPTGRGMPDPGMHGIGAVMPSPYEMGGMPIRDAGVSQPVPIGALATALANAPPDQQRLMLGENLYPLVDQLEHEQAAKVTGMLLEMDQTEVLHLLESPDALKAKVAEAMEVLRSAQHLQPTNASPEQQLANLSLNDGVVSS

SEQ ID NO: 19650 - DNA, 2497 bp, Panicum virgatum
  misc_feature: Ceres CLONE 1806331
  misc_feature: Encodes the peptide sequence at SEQ ID NO. 19651
agtcctctggtcctctctcgtcctgggccctgccattctgttcccggcgacggtgagtgaggcagcggacgccgccaccggtcccggttccctaacccactccttcccttctccgtttccgcagcccggttggctcttagcctcaccgcaccgccgggcgcttccaccgctcccacccagaattatattgtactagtagcgctcctccgcctctctacttttttcgagcaagctccgcttctccagtggctgccctggcgtggagtggagatccgcccggacttggattgctttcttctttcgctgttgatatcatcatgctgagcattttgtggtagacggcaagatcatctctttgggttccagcttatacctccttcctacaaggcactagaaaatatgtcgacacaagcctctaaccggtcgtacggatatccggacaatacccaaataccatactacgatggcaatctagtgccagttgggggcaatggtacttactatatgccaaaaaatcatgatgatggtcaccacatttcctctgatgatggattgcagaccagtaattctagagctcaaggttttcaagcacagtactgcaccctagactcatcctcagcaaattgtgtttatcctgcacatagctctacctcttctcagagccaaagcgggagtccccagtctcagcaggagagccactcagatcatgcatatggttcctctccaagtgcatcatgtgttactcacgttcccagttggacacttaaggatctagaaaatgtaatgcttggacctgattctgacataggcagccctgacagctccttactatctggcactgctttgcatgaaaacaactggagagaacttttgggaattaaaaccggggatttgaggcaggtaattatagcatgtggtaaggctgttgatgagaatgcttggtatatggacgcactgatgtctgagttaaggcaaatggtttctgtgtctggtgaaccgatgcaacgactgggagcttatatgttggaaggtctcattgcgaggctttctttcactggacatgccctatataaatctctgaagtgcaaagaacctgtggctacgagttctgagctcatgtcctatatgcatcttctttacgacatctgtccattctttaagtttggttacatgtctgccaatggtgccatagctgaagctgttaagggtgaaaactttattcacatcatcgatttccaaatcgctcaggggagtcagtggatgactatgattcaggcccttgcttcaaggcctgggagacgaccgttcctaagaatcactggcatagatgactcaaattctgctcatgcccgaggtggtggattggatatagttggacagaggttgcacagcattgcccagtcatgtggtatgccctttgagttcaatcctgttccagcagctagtcatgaagttatgtatgaacatctttgtataagacctggggaggcaattgttgtcaattttgcttatcagctgcatcatactcctgatgagagcgtgggcatagaaaaccatcgtgataggatattaagaatggtcaagagcctctctccaagggtggtgactcttgtagagcaggaggcaaatacgaacacggcacctttctttcttagatacctggagactcttgattattacacagcgatgtttgaggcaatagacgttgctcgccccagagatgataagaagcgcatcagcgctgagcagcactgtgttgcaagagatattgtcaatttagttgcttgcgaaggtgcagaaagaatagagaggcatgaacctttcggaaaatggagggcaaggcttgccatggctggatttagaccatacccattaagtccagtggtgaacagtaccatcaaaacactgctggatagttaccacagctattacaggcttgaggagaaggatggtgtcctttatcttggctggaagaacagaaagctggttgtatcttctgcctggtgctgacatttccaattttggaagaaactttgtttaggttctttcatggctttgtgttcagcacttgaatccaaggtggaacctaaacttctcaatgcggacttcataataaaagccaacttggttgcttcattgctgactgttgttggccagctttcaaacagtcccatgctcaccatcttttggactcaatggttgtcgctggtatactcaccatgactctcgcttccatccttatctaggagccaagcaaacagtggttgccccaccttcaactggtattaatattgcatgttggtagaaatctggtatcagcttccgaatctggattgctaaaaccgtgcatgttgcatttaggttgacttgtacaatgctatgcgagtctgaaacttatgccgggttttcggtagtaggcacaagaagtgccattagtctgtatgtacaacctgctgcagctcgtgtattgtacttccatagtgtgggtgatttaccc

SEQ ID NO: 19651 - protein, 536 aa, Panicum virgatum
  misc_feature: Ceres CLONE 1806331
  misc_feature (139)..(446): Pfam Name: GRAS Pfam Description: GRAS family transcription factor
  misc_feature: Functional homolog of the protein sequence given in SEQ ID NO 50759
  misc_feature: Useful for making plants with modulated low light sensitivity
  misc_feature: The sequence is a functional homolog of SEQ ID NO 474 in the 10/666,642 US patent application
  misc_feature: Functional homolog of the protein sequence given in SEQ ID NO 50758
  misc_feature: Useful for making plants with modulated light quality sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MSTQASNRSYGYPDNTQIPYYDGNLVPVGGNGTYYMPKNHDDGHHISSDDGLQTSNSRAQGFQAQYCTLDSSSANCVYPAHSSTSSQSQSGSPQSQQESHSDHAYGSSPSASCVTHVPSWTLKDLENVMLGPDSDIGSPDSSLLSGTALHENNWRELLGIKTGDLRQVIIACGKAVDENAWYMDALMSELRQMVSVSGEPMQRLGAYMLEGLIARLSFTGHALYKSLKCKEPVATSSELMSYMHLLYDICPFFKFGYMSANGAIAEAVKGENFIHIIDFQIAQGSQWMTMIQALASRPGRRPFLRITGIDDSNSAHARGGGLDIVGQRLHSIAQSCGMPFEFNPVPAASHEVMYEHLCIRPGEAIVVNFAYQLHHTPDESVGIENHRDRILRMVKSLSPRVVTLVEQEANTNTAPFFLRYLETLDYYTAMFEAIDVARPRDDKKRISAEQHCVARDIVNLVACEGAERIERHEPFGKWRARLAMAGFRPYPLSPVVNSTIKTLLDSYHSYYRLEEKDGVLYLGWKNRKLVVSSAWC

SEQ ID NO: 19652 - DNA, 660 bp, Panicum virgatum
  misc_feature: Ceres CLONE 1806334
  misc_feature: Encodes the peptide sequence at SEQ ID NO. 19653
tggctacggtggaggtgcaggggccaatagtgcggctcctgctgctcctcatccttgcccagatgagcctcaccggctccagccctccgccggatcccgtagcctgcgcccacggcacctccaactgcaccatcaacaacgcatatgcctccttcccggaccgcagaccctgccacgccgcccgggccgcctacccacgcagcgagcatgagctcgtcgcggccgtggcggccgcggtggctgccaagcgtaaggtgaaggtcgccaccaggtactcccacagcttcaccaagctggcctgccccggcggcagcgacggcgccatcatcagcacgcggtggctcaaccggaccgtgcgggtcgacgccaagaatcggctcatcacggtggagagcggcgtgctcctcagggagctcatccgtgccgccgcctcggctgggctctcgctgccatacacgccgtactggttcggcctcaccgtcggcggcctcctggcgaccggcgcgcacggcagctcgatgtggggcaaggggggcgccgtgcacgagtccgtggtggcgctgaggatcgtgacgccggcgccggcgagccggggcttcgccatggtgagggagctcggcaccggccacccggacctcgacgcggccaaagtatctctcg

SEQ ID NO: 19653 - protein, 219 aa, Panicum virgatum
  misc_feature: Ceres CLONE 1806334
  misc_feature (59)..(206): Pfam Name: FAD_binding_4 Pfam Description: FAD binding domain
  misc_feature: Functional homolog of the protein sequence given in SEQ ID NO 50472
  misc_feature: Useful for making plants with modulated nitrogen use efficiency
ATVEVQGPIVRLLLLLILAQMSLTGSSPPPDPVACAHGTSNCTINNAYASFPDRRPCHAARAAYPRSEHELVAAVAAAVAAKRKVKVATRYSHSFTKLACPGGSDGAIISTRWLNRTVRVDAKNRLITVESGVLLRELIRAAASAGLSLPYTPYWFGLTVGGLLATGAHGSSMWGKGGAVHESVVALRIVTPAPASRGFAMVRELGTGHPDLDAAKVSL

SEQ ID NO: 19654 - DNA, 670 bp, Panicum virgatum
  misc_feature: Ceres CLONE 1806334-R
  misc_feature: Encodes the peptide sequence at SEQ ID NO. 19655
cgttctcccgggcacccgcgttcgtcgccgacctcaagaggctgcgggaccgcaacccgcaggcgttctgcgagctcggcacctcgggcgtgctcatgcgctacgtcaaggcctccaccgcctacctcgggaagccggtggactcggtcaccgtcgacattgactacttccggagccgcacgcccggcacgccgcgggcgcacgccgacgtgatcgacgagctggagcagatggtgctgctcaagtacggcggcgtcccgcactggggcaagaaccgcaacttcgtcttcaacggcgccatcgccaagtatcccagggccggcaagttcctcgaggtgaagaagaggtacgatccggaggggacgttttcgagcgagtggagcgatcaggtgctgggcatcaagggaaacgcaaacatattggacaagggctgcgccatggaagggctttgtgtctgctccgatgacacgcactgcgcgccagagaaaggctaccactgccggccggggaaggtgtacgccggagcgagggtttgtgctcgttgacgtctcaagtctgaacctgtatgaaatcgggcaggagcagggctgctcgctgatcaacttatgtgcttgcattggcccttgttacaataaaccgtaccagcaggtccatcatgctggcgtctcct

SEQ ID NO: 19655 - protein, 180 aa, Panicum virgatum
  misc_feature: Ceres CLONE 1806334-R
  misc_feature: Functional homolog of the protein sequence given in SEQ ID NO 50472
  misc_feature: Useful for making plants with modulated nitrogen use efficiency
FSRAPAFVADLKRLRDRNPQAFCELGTSGVLMRYVKASTAYLGKPVDSVTVDIDYFRSRTPGTPRAHADVIDELEQMVLLKYGGVPHWGKNRNFVFNGAIAKYPRAGKFLEVKKRYDPEGTFSSEWSDQVLGIKGNANILDKGCAMEGLCVCSDDTHCAPEKGYHCRPGKVYAGARVCAR

SEQ ID NO: 19656 - DNA, 471 bp, Panicum virgatum
  misc_feature: Ceres CLONE 1806341
  misc_feature: Encodes the peptide sequence at SEQ ID NO. 19657
acggccgctcccccaccaccaccacggttgccggaccccgcacgcggacaaccgcccgggagccgccagccatggcgctctcgcacgcgagctccatcgcccgggacgacgccgtcgcctgcaccttcgcgtcgcgctacgtgcgcgagcgcctgccgcggtaccggatgccggagcggtcgatcccgcgggaggcggcgtaccagatcatcaacgacgagctgatgctggacggcaacccgcggctgaacctggcgtccttcgtcaccacctggatggagcccgagtgcgacaagctcatcatgggctccatcaacaagaactacgtcgacatggacgagtaccccgtcaccaccgagctccagaaccgttgcgtaaatatgatagctcacctgttcaacgcgccgattaaggaggatgagactgctgtcggagttggaacagtgggatcctcggaagcaattatgcttt

SEQ ID NO: 19657 - protein, 133 aa, Panicum virgatum
  misc_feature: Ceres CLONE 1806341
  misc_feature: SWISSPROT Homolog: EC 4.1.1.15 Glutamate decarboxylase
  misc_feature: Functional homolog of the protein sequence given in SEQ ID NO 50492
  misc_feature: Useful for making plants with modulated nitrogen use efficiency
MALSHASSIARDDAVACTFASRYVRERLPRYRMPERSIPREAAYQIINDELMLDGNPRLNLASFVTTWMEPECDKLIMGSINKNYVDMDEYPVTTELQNRCVNMIAHLFNAPIKEDETAVGVGTVGSSEAIML

SEQ ID NO: 19658 - DNA, 353 bp, Panicum virgatum
  misc_feature: Ceres CLONE 1806341-R
ccacccacgccgtgcgggtcgccaccgccaccgccgcggggcagtcgggcgacggcggcggcgtcgtggccaggaagagcatcctggagatcgagcgggaggtcgcctcgcgctggagggacgccgtgagcaagaagaagaccgggccgtgctgattgacgcgtggaggaggatggtttgtattgtacgtatgtgcttgtgtatctgtgcttgaagcttggatcattgtatgcgtagtcgaactccgtgtgttctttgctttggtggtcttgtcccgtatagcacgagatacttggctgtttgtgtttctggatggcaatgttcaggaacgaaccaagtaaataattgttttc

SEQ ID NO: 19659 - DNA, 2329 bp, Panicum virgatum
  misc_feature: Ceres CLONE 1806347
  misc_feature: Encodes the peptide sequence at SEQ ID NO. 19660
atccgccgcctccacacccagccttctcgcctccgacggcgccggcagcccgctgcgttgcctccccactcgcgcccggccgccggctccactcaaggatgcggcgccccctgcctggggtcgtgcgtctgccgccgcctcgctgcccgtacccgtgaagatcgaggagcccgggccgtctttggttcctccatcggcaacggctacgaggggccccggccgccgctcgctctccggcctcgcgggacgcgtcattgccgctcgccctgcgcctgcgcctcctcctcctccctgaccagtaagcagagcaggctgccgctcgcgcgcctcctccgtaacagagcctgtaaacgtttaagtttcatattccatatattccttatctgtccagtaactaagcaaatgcaccattggcagcaactttgtcagctctgggaaacccaggagttgaatcccaagtaattgatcttagaaaaacatcagtgaagttgaataaatcatggaacctggaagggatgagatcaatgatgaatgagtgattcagaacaacacagaaaggttattcttcttcgacgtgctggattcaggatccaaggcacaatttttttcctcaagataactgggttttcatctgaccggatgccccaagtgaaggctgcccctgcgctggtgaacgggctggtccccgcaccctcatcattgaatcgcagatcccttggactctacagtcacggccatttcccctcatcatctcgtattgcttgctcatcagagttatcggatagaggttctgccaaggagttggaagtgtccgagtacagtgacgagatatatgctgagaatgctgctgacagggatgaaggagagtgtttaggatggagcaaagaagagattgatgccatttctgcactcttcgatcgggcgatgcgtcagaagcccctgaagctgccaaaccccgcgaggccgcgggcgctcccattgccactaccgcacaagacgaggctgcctgtcactccggcacccaagcagcacgtccggcttgctgcaagagccgcactcttgtcccgcgcttccttcagcgatcaggtgcgcaagaacccagagttgctacttgggattgctcgcgagatcgctgggcttcctccagagcatggtgtctccacggtgctcgaccggtgggcaaggtttcttcgaaaaggttccttgtcactgaccatacgtgagctcgggcatatgggactccctgagcgcgcactgcaaacattgtgctgggctcagaggcagaaagccgttccattgttccctgatgaccgagttcttgcttccaccatcgaagttttggctcgctttggccagcttaaagtggagtctgcattggagcaatgcgtccccacggcgagccgtgccgttcttgaagccatggtgagtgggttcatcagggctgggaaagtaggccttgcgcgcaaactcctggaacttgcaagaatccataacaggacactgcatcccagcatctatgtgaagctgatgctggaagccacccggacacctgaaggctatgggcttgcctcggcattggttgatgagcttggtgagaggttggacatggaacttcgcccgcaagactgcacggctgtcatgaaagtctgcgtaaagcttcgacggtatgcagccgtggagagcctgttcagttggttcaggcaatccggtgggagccccaccttggttatgtacacaacagtgatccacagccgctgccgcgatggaatgcaccgcgaggcgctgtccctggtgtgggaaatggagcaggccggttgtttgctcgacctgcctgcctaccgggtcattatcaagctgtgtgtggtgtcgcgcgagccagagagagccctccggtatttatcgaggatgaaggaggctggctttgttccaacgagtgacatgtacaatgatctggttgaaggttattcagcggaggggagggtggccaagtgcctgcagctgatcagggaggctgagtcggttggcctgaaactggacaggaagctgctctcacgcttgtctgaaactggaaatgtccattcttgttggctttccgagtgttgttgacatctcacagaatagaacaggaacaagaatacccgcacttctgtgtaattgctccattgtgtaaaccttgttttcagatgaattgtcatctataatctttgtagtaaagataggagtcaagcaatcacgtttctgtggttgtttagcccctcgtgtatttttcactggtccatgttcattgagaaaatattaattggtgatcgcactgcagtgcagtgggttg

SEQ ID NO: 19660 - protein, 524 aa, Panicum virgatum
  misc_feature: Ceres CLONE 1806347
  misc_feature (399)..(433): Pfam Name: PPR Pfam Description: PPR repeat
  misc_feature (434)..(468): Pfam Name: PPR Pfam Description: PPR repeat
  misc_feature (469)..(503): Pfam Name: PPR Pfam Description: PPR repeat
MSDSEQHRKVILLRRAGFRIQGTIFFLKITGFSSDRMPQVKAAPALVNGLVPAPSSLNRRSLGLYSHGHFPSSSRIACSSELSDRGSAKELEVSEYSDEIYAENAADRDEGECLGWSKEEIDAISALFDRAMRQKPLKLPNPARPRALPLPLPHKTRLPVTPAPKQHVRLAARAALLSRASFSDQVRKNPELLLGIAREIAGLPPEHGVSTVLDRWARFLRKGSLSLTIRELGHMGLPERALQTLCWAQRQKAVPLFPDDRVLASTIEVLARFGQLKVESALEQCVPTASRAVLEAMVSGFIRAGKVGLARKLLELARIHNRTLHPSIYVKLMLEATRTPEGYGLASALVDELGERLDMELRPQDCTAVMKVCVKLRRYAAVESLFSWFRQSGGSPTLVMYTTVIHSRCRDGMHREALSLVWEMEQAGCLLDLPAYRVIIKLCVVSREPERALRYLSRMKEAGFVPTSDMYNDLVEGYSAEGRVAKCLQLIREAESVGLKLDRKLLSRLSETGNVHSCWLSECC

SEQ ID NO: 19661 - DNA, 1856 bp, Panicum virgatum
  misc_feature: Ceres CLONE 1806366
  misc_feature: Encodes the peptide sequence at SEQ ID NO. 19662
agcgcgaggttttccttcctcccatcgatctgtacgccctcccccaccggccgccggtcgcgcgcctccgcctacctcccctccccgcccgtcgccgtccgtctccgtctccgcccccccaaaccctactgcccctgccgccttcgcagctctccgcccgctatggccaccaacggcagctccccgagggttcgggacacggagaacagcctggagaaggtgaagcgccagctgtcgtcgggttccgggaggtacctgctgcagggccccctgctcaagcgatctgagacgctgcggaaatggaatgaacggtgggtcatattggaccccacatctggaaagatggaatacaaactccggaggaatgaaactgccataaaggggaccattctatttgacacctcaagcaccattactttgtctcctgtgaactttcaagggatgccgaagtatgatggttgctgcttctacatcggaactcctcaaaagaaggattactttctttgcgctgaaactcctggtgctgcgaaagcttgggtatctacattacacgcaactcagttagtactccgagctcataaagaggcagtgaattccttggctgggaatggctctccagctacattaggcactgttgctactgcagttgctaatgctaatgcaacaaccatggaggctaccaaagagatagaagctgcaatgaaggtctcgatgagggcagctcttggtttgggcacaaataactccaatcagggccaactagatgacctaacaatcatgaaggagactctccgagtgaaagatgaggaattgcagcatttggctaaggatattcgttctcgtgatgctacaataaaggaaatagcagacaagttaactgaaactgcagaggctgcagaagctgctgcttcggcggcacatacaatggatgaacagagacgacttttatgtttggagattgagcgtctaaaaaatgccttggaaaggcaaatagaacaatcaatgcataagctaagacaatctgaagagaaggttattagcctgagcaaagagaaggaccagttgatgaaggaaaaagatgctgcatttcaagaggctcatatgtggcgcactgaactaggaaaagctagagagcaagcagtgattcaggaagcaactattgcccgagcggaggagaaggcaagggtttctgaagcagatgctgcagctcggataaaggaagctgctgaaaaactgcttgctgtggagaaagaaaaggaagagcttctagccctggttggtgttctccaatcacaagtccagagagaacagagcagcacaaagcaagtatgtgaggagaggtctgaatcatgctctggtgccgacgattcccctcccttaacaaagcacgttgatgcgtcagacgatgatgtagacaaagcctgtgtaagcgactctagatcagtcctggtttccagcgaaagcagaggtccaactcgctgtggatggggtggacatccgtcctattggcgatgcagagtggggcagtttccagcagtcagaggctctgatcgctgatgtgcgggaggtctccccagaggcggaaggcggcagcttggatattcctgtggtaaaccccccaccagtcaatgatcatatgcagggaggcgcaactcatccttgaatgcccggtttgctgctggcctgctgccaccttctgagattagtgtgatttctgagaaaccgatagggatttgaatcctggagagaattgctgttgcgggtgtttttgcatcgatgccggttgtatgtttattgtatttaagtatacaactgaataaaaagataagtagtgtttggttgtgggattgtaaatt

SEQ ID NO: 19662 - protein, 464 aa, Panicum virgatum
  misc_feature: Ceres CLONE 1806366
  misc_feature (31)..(134): Pfam Name: PH Pfam Description: PH domain
MATNGSSPRVRDTENSLEKVKRQLSSGSGRYLLQGPLLKRSETLRKWNERWVILDPTSGKMEYKLRRNETAIKGTILFDTSSTITLSPVNFQGMPKYDGCCFYIGTPQKKDYFLCAETPGAAKAWVSTLHATQLVLRAHKEAVNSLAGNGSPATLGTVATAVANANATTMEATKEIEAAMKVSMRAALGLGTNNSNQGQLDDLTIMKETLRVKDEELQHLAKDIRSRDATIKEIADKLTETAEAAEAAASAAHTMDEQRRLLCLEIERLKNALERQIEQSMHKLRQSEEKVISLSKEKDQLMKEKDAAFQEAHMWRTELGKAREQAVIQEATIARAEEKARVSEADAAARIKEAAEKLLAVEKEKEELLALVGVLQSQVQREQSSTKQVCEERSESCSGADDSPPLTKHVDASDDDVDKACVSDSRSVLVSSESRGPTRCGWGGHPSYWRCRVGQFPAVRGSDR

SEQ ID NO: 19663 - DNA, 2599 bp, Panicum virgatum
  misc_feature: Ceres CLONE 1806374
  misc_feature: Encodes the peptide sequence at SEQ ID NO. 19664
agatcgcgcgtcactaaactagtactcctagcactaggcactaggcaaattagcaagaaaccatggcagcagcggtgctactagtggctgcggcggtggtggcgatggcggtggcgtcgacacagcgcgcggcggcggcggacgacgccccgctgccgctggtggcccctgcgccggtagggctgccgaactgcacgaccacgtgcggcgacgtgctggtgccgtaccccttcggcctgggcccgccgcgctgctcctggccgggcttcaacctcacctgcgccgacgacaccgccagccgccccggcgcgccgccgcggctgctcctcggcgacggcaccctcgaggtcgtggacgtctccctccggaacaccgccgtccgcgtggttcgccgcggcgccgtcgccaacgtcacctccggccggaacgtcacgttcgggcgcagcttcacgggcggctacagcggctacacgctgtcggaccgcaacgagctcgtcctctccggctgcaacgtggtggcggtgctggtcggggacctcgacgagtactccaacatcatcagcggctgcgcctccttgtgctcctccgacgacggcaccagcaagggcgacatcaggcagccggccggcaagttctgctccggcctgggctgctgccaggcgcccgtcaccatgaactacagcaggcccgagggcgtgcaggtcagctggctccggggcggcgacgaccgccggcaggacctcctccggctggagcccttcgtgctcgtcgccgagaaggggtggttcgaccagagcccggtggccgaccagctggtggggcccccaggcgggagccagaggccggacgccgccgcgattgaggtccccctcgtcctgcagtggacggtcaccaacgtagccccgcccgacgacaggtaccccgggccggcgtgctcgccggcggtggcccagaggctctgcaggagcgccaacagcgagtgcacgaccaacggcaacggcgactactcgtgccagtgccgagagggctacgacggcaacccttacctcgacggcggatgccaagatatcaacgagtgcaagctgccgccggaggtcaatggctgcttcggcgactgctccaacacggagggacggttcgtctgccggtgcccgccacgaaccaatggcgaccacactcagaaaggtggctgcgccccggctgctttgacaggtttcagcgctggtataggtcttggtagcggggcaggccttatacttttgcttcttgctgcaatatttgttaccaaaaagatcagacataggaggattagaaagttgaaacaaaaattcttcagccaaaatcgtgggcagttgttgcatcagttagtatcacaaagggccgacattgctgaaaggatgatcatcacgctggatgagctcgaaaaggcaacaaacaactttgacaaatctcgtgagattggtggtggagggcatggcaccgtgtacaaggggattctatcggacctacaagtagtagccatcaaaaagtcaaaaataactgtccagaaagaaatcgacgagttcataaacgaggtagcaatcctctcccagataaaccataggaacatagtgaaacttttagggtgttgcttggaaactgaggtcccattattggtttatgagttcatttccaacggaactcttttttaccatcttcatgtcgaagggccaacttctataacatgggacagtagattgaggattgccactgaaaccgcaaaagctcttgcatatcttcactggtcagtttcaatccctgtaatacatagagatatcaagtctagcaacatacttcttgatgatgctatgacatcaaaggtttcagactttggagcttcaaggtacgctccggtggattccacagggttaaccacaaaggtgcaaggaactattggatatctggacccttcgtacttctacacgggccgtcttactgaaagaagcgatgtctttagcttcggtgtcattcttgtggagttgctcaccaggaagaaaccattttcatatttgacctccgatggtgaaggccttgttgcacattttgtgagccttcttagagaggggaatatttcccaaatattggatccacaaattatagaggaaggtggcaaagaagtccaagaagtttccgtacttgcagcatcatgcataaatttaagagctgaggaccgacctacaatgcgagaggtggaacatgcactcgaaggtcttcaagtatccaagaagaaaggatctatggtaatgtctttcaaaaaagaatatatggtaagagatgaattcgaggatgatgatggtgttgcgatgaattgaccgttatccaaagaagtgcaaagcatcggagaatgtaatcaatattcgagcagggagatacagcttgggaggcagcttaggagccatgtggtgattgggatgcatttcttggaataatctcagctctgtttgttgttggtatgcatttcatacgggcattaacaaagtttagcctttggcatgccctcaggccgctctgcatcattttggatgtccaggattaaattttgtcatgctcttatattctc

SEQ ID NO: 19664 - protein, 762 aa, Panicum virgatum
  misc_feature: Ceres CLONE 1806374
  misc_feature (460)..(727): Pfam Name: Pkinase Pfam Description: Protein kinase domain
  misc_feature: SWISSPROT Homolog: EC 2.7.11.1 Non-specific serine/threonine protein kinase
MAAAVLLVAAAVVAMAVASTQRAAAADDAPLPLVAPAPVGLPNCTTTCGDVLVPYPFGLGPPRCSWPGFNLTCADDTASRPGAPPRLLLGDGTLEVVDVSLRNTAVRVVRRGAVANVTSGRNVTFGRSFTGGYSGYTLSDRNELVLSGCNVVAVLVGDLDEYSNIISGCASLCSSDDGTSKGDIRQPAGKFCSGLGCCQAPVTMNYSRPEGVQVSWLRGGDDRRQDLLRLEPFVLVAEKGWFDQSPVADQLVGPPGGSQRPDAAAIEVPLVLQWTVTNVAPPDDRYPGPACSPAVAQRLCRSANSECTTNGNGDYSCQCREGYDGNPYLDGGCQDINECKLPPEVNGCFGDCSNTEGRFVCRCPPRTNGDHTQKGGCAPAALTGFSAGIGLGSGAGLILLLLAAIFVTKKIRHRRIRKLKQKFFSQNRGQLLHQLVSQRADIAERMIITLDELEKATNNFDKSREIGGGGHGTVYKGILSDLQVVAIKKSKITVQKEIDEFINEVAILSQINHRNIVKLLGCCLETEVPLLVYEFISNGTLFYHLHVEGPTSITWDSRLRIATETAKALAYLHWSVSIPVIHRDIKSSNILLDDAMTSKVSDFGASRYAPVDSTGLTTKVQGTIGYLDPSYFYTGRLTERSDVFSFGVILVELLTRKKPFSYLTSDGEGLVAHFVSLLREGNISQILDPQIIEEGGKEVQEVSVLAASCINLRAEDRPTMREVEHALEGLQVSKKKGSMVMSFKKEYMVRDEFEDDDGVAMN

SEQ ID NO: 19665 - DNA, 2073 bp, Panicum virgatum
  misc_feature: Ceres CLONE 1806381
  misc_feature: Encodes the peptide sequence at SEQ ID NO. 19666
aagaaacaggcaaaacagggggagcgaaagaaaacggagcaagaacagcgccacatcgacatctccccccttcctcgggctccattggatttggggagctcgggggcgccggccgctgatgaactccgaaccgagcaccaatccgcggcgaggaggctccaccgggtagctgggggcacggagcgaggcgatggcgggtgccggcgcggcggccaatggcggcaggaacgggtacgcggttcttgatcggagcgaggagcaggacctggagctggacgcgcggcgaaggccgccggtgcccgagagcgagaggaggaggagggagcggttcgtgtacgcctgcgcggtcttcgcctcgctcaacgccatcctcctcggctacgatgttggtgtcatgagtggctgcatcatctacatgcagaaagatctccacataaccgagtttcagcaagaaatactagtaggctgtctgagcgtggtctcactcgtgggaagcctatcagggggacgaacatctgatgtaattggcaggaaatggacaatgggcctcggtgcaattgtgttccaattaggcgccgccatcatgacgtttgctccatcattcactgtgcttatgatcgggaggctcctagctggagtaggcattggctttggtgccatggtatctggagtgtacattgctgagatctcccctgctggtgcccgtgggactctcacgtcccttcctgagatatgcatcaatttggggatcctcctcggctatgtttccaattatgccttttcgggcctttctgagcatatcaattggaggattatgctcggtgtcggtatccttccatctgtcttcattggctttgcacttttcgtgattccagagtcccctaggtggttggtgatggagaagagagtttcagaagccagggcagtgctgctacagataagtgagtctgaagctgaagttgaagaacggctggctgagattgaggaagccgcaggtcttatgaaatcaacgaaatctgaggagaaggaagtgtggagagagcttctgaacccttctcctgctgttcgtcggatgctgtatgctggctgtggtatccaattattccaacagattactggaattgatgctactgtctattacagcccaacaattttcaaggatgctgggatcaagtctgatcaggagcttcttgctgcgaccgtcgctgtgggtttcaccaagacagtgttcatcttggttgcaattttcctcattgataaagttggccggaagccacttctttatgtcagcacaattggcatgactatatgcttgtttctcctgggagtggcacttacattgcaaaagcatgctgcggggcttatgtctccacgtattgggatcgatctagcaatttttgcagtgtgtgggaatgtggcgttcttttcaattggcataggaccaatatgttgggtcttgtcatcagaggtatttcctttgagattacgagctcagggatcagcgcttggtcaagtgggtggtagagtgagcagtggtttggtttccatgtcgttcctttctatggcccgtgctatatcagtggcaggaatgttcttcgtctttgctgcaatatcagttgtctctgtcctgtttgtgtacttttgtgtgccagaaacaaaagggaaaacactggagcagattgaaatgatgtttgaaagtggggacgaatggagaggaggtgaaattgagcttgaggatacacagcatctaatacctagtaacaagaagtctgtacctctcagctgatatcggtacggtatcaacaagaagtctatagctccatgtttcaatgacaagccagcctcatcctgctttcatctctgctggattcaaacatcagtttcaaaaatgatcaggctgcagtgaactatgaccgacttcgaggatacagaaggcattggtactttagtaggcatagaggtgacagtagattgattatgttgttagtctaaaagtttcctcatattgttatacgactggtgtatcttccagacatccacaaaagaatatacttgctaaaaaaatctttctac

SEQ ID NO: 19666 - protein, 531 aa, Panicum virgatum
  misc_feature: Ceres CLONE 1806381
  misc_feature (51)..(501): Pfam Name: Sugar_tr Pfam Description: Sugar (and other) transporter
MAGAGAAANGGRNGYAVLDRSEEQDLELDARRRPPVPESERRRRERFVYACAVFASLNAILLGYDVGVMSGCIIYMQKDLHITEFQQEILVGCLSVVSLVGSLSGGRTSDVIGRKWTMGLGAIVFQLGAAIMTFAPSFTVLMIGRLLAGVGIGFGAMVSGVYIAEISPAGARGTLTSLPEICINLGILLGYVSNYAFSGLSEHINWRIMLGVGILPSVFIGFALFVIPESPRWLVMEKRVSEARAVLLQISESEAEVEERLAEIEEAAGLMKSTKSEEKEVWRELLNPSPAVRRMLYAGCGIQLFQQITGIDATVYYSPTIFKDAGIKSDQELLAATVAVGFTKTVFILVAIFLIDKVGRKPLLYVSTIGMTICLFLLGVALTLQKHAAGLMSPRIGIDLAIFAVCGNVAFFSIGIGPICWVLSSEVFPLRLRAQGSALGQVGGRVSSGLVSMSFLSMARAISVAGMFFVFAAISVVSVLFVYFCVPETKGKTLEQIEMMFESGDEWRGGEIELEDTQHLIPSNKKSVPLS

SEQ ID NO: 19667 - DNA, 612 bp, Panicum virgatum
  misc_feature: Ceres CLONE 1806383
  misc_feature: Encodes the peptide sequence at SEQ ID NO. 19668
gcctttgatatctccggtcatccttgtctacagcaatggcctccatgaaagcagaaagacctcaaggttcctcgcaggcacccagggttcagcaacccaagtctgcaggggcgaagccagctaccacgaagaaggtggcgaacaaaccacaggaaccgaagaaggtcacaagcattgctagacctacgatcgcggcaatcagtcccaaccgcagttcacaagtgaacagaaagagggtttactccatgacctgggtaattacatgagaagcctgaaggctgtgcattctggtgctgatcttgagtctgctatagcaacttgcatgggatacaaatcggagggtgaaggtttcatggtcggtgttcagatcaatccagtgaagggtttgccatctggatttcctgaattgctcaaatttgtgcttgaccatgttgaggacaagtcagcggaaccacttcttgaggggttgttggaagctcgagttgaactccgccctttacttcttgattcacctgaacgcatgaaagatcttatttttttggacattgctcttgattctacttttaggacagctattgaaaggtcatatgaggagcttcacaatgcagcccc

SEQ ID NO: 19668 - protein, 116 aa, Panicum virgatum
  misc_feature: Ceres CLONE 1806383
  misc_feature: SWISSPROT Homolog: EC 2.7.9.4 Alpha-glucan, water dikinase
MRSLKAVHSGADLESAIATCMGYKSEGEGFMVGVQINPVKGLPSGFPELLKFVLDHVEDKSAEPLLEGLLEARVELRPLLLDSPERMKDLIFLDIALDSTFRTAIERSYEELHNAA

SEQ ID NO: 19669 - DNA, 585 bp, Panicum virgatum
  misc_feature: Ceres CLONE 1806383-R
  misc_feature: Encodes the peptide sequence at SEQ ID NO. 19670
cccaagcaaagcccattggtctcttcataaggcgatcaatcatctttcgttctgactccaacggcgaggatctggaaggttatgctggagctggattatatgatagtgtaccgatggatgaggaggatgaagttgtacttgactacacaactgaccgtcttatagtagaccatggattccgaaattcaatcctctcaagtattgcacgggctggccatgccattgaggagctctatgggtctcctcaagatgtcgagggagtagtgaaggatggaaaaatctatgtagtccagacaagaccacagatgtaatatgtatgtatagccagctcaaaaaggcacggttgttcccttgtatggtggatatatgggttctatagcatgcatagttgtatgtcttgatgtgcaacagatgtcccaggacccacaggagctctctggtattcataagccaattccacaaatgaacagatcctcttgcggtcgtcatggatgtagcaaacatactatacctatggaataagacggatgtaagcgttgtcatgtatggaatctaagatatataacagtgatatagtttggagtt

SEQ ID NO: 19670 - protein, 102 aa, Panicum virgatum
  misc_feature: Ceres CLONE 1806383-R
  misc_feature: SWISSPROT Homolog: EC 2.7.9.4 Alpha-glucan, water dikinase
QAKPIGLFIRRSIIFRSDSNGEDLEGYAGAGLYDSVPMDEEDEVVLDYTTDRLIVDHGFRNSILSSIARAGHAIEELYGSPQDVEGVVKDGKIYVVQTRPQM

SEQ ID NO: 19671 - DNA, 691 bp, Panicum virgatum
  misc_feature: Ceres CLONE 1806419
  misc_feature: Encodes the peptide sequence at SEQ ID NO. 19672
ttcagtgtcactgttggtggtcgtgatcttattcaggaagccactataacacttgcttttggaaggcactatggccttgttggaagaaatggttctggaaagacatctttcctcagagctatggcgatgcatgcaattgatggtattccgaaaaactgtcatatattgcatgttgagcaagaggtcgtgggtgatgacaccacggctttgcagtgtgttctgaatgccgatgttgaacgagttcaacttatgcaggaagaggcccgtctggttcaacaacagaaagacctagagattgaggctgaatttggacagggctcgggcaagagcaagggtgatcttgacaaagattctatcagcaagaggcttgaggagatatataaacggcttgagtttatcgatgcagatgctgcagaggctcgcgcggcatcaattttggcgggtcttagtttcactccagaaatgcaacgcaaacgtacaaaagaattttctggtggatggcgcatgagaatagctctagcacgtgctctgttcattgagcctgatttactactacttgatgagccgacgaaccatcttgatcttcatgctgtgttatggctagaaacatatctcctgaaatggccaaagacatttattgttgtatcgcatgctagggagtttttgaatacggttgtcaccgacattcttc

SEQ ID NO: 19672 - protein, 230 aa, Panicum virgatum
  misc_feature: Ceres CLONE 1806419
  misc_feature (21)..(229): Pfam Name: ABC_tran Pfam Description: ABC transporter
  misc_feature (157)..(217): SWISSPROT Homolog: EC 3.6.3.27 Phosphate-transporting ATPase
  misc_feature (6)..(42): SWISSPROT Homolog: EC 3.6.3.41 Heme-transporting ATPase
FSVTVGGRDLIQEATITLAFGRHYGLVGRNGSGKTSFLRAMAMHAIDGIPKNCHILHVEQEVVGDDTTALQCVLNADVERVQLMQEEARLVQQQKDLEIEAEFGQGSGKSKGDLDKDSISKRLEEIYKRLEFIDADAAEARAASILAGLSFTPEMQRKRTKEFSGGWRMRIALARALFIEPDLLLLDEPTNHLDLHAVLWLETYLLKWPKTFIVVSHAREFLNTVVTDIL

SEQ ID NO: 19673 - DNA, 587 bp, Panicum virgatum
  misc_feature: Ceres CLONE 1806419-R
  misc_feature: Encodes the peptide sequence at SEQ ID NO. 19674
gtcagaagagtagggttgcattcgcgaaaatcaccttcaagaaaccacacattatacttctcgatgagccttctaaccatctggatctggacgcagttgaggcgctcatccaaggtttactggttttccagggtggagtgctaatggtgagtcacgatgagcatctcatcactggaagcgtggacgagctttgggcggtgtcagagggcagggtgaccccattctcgggcacgttcaaggattacaagaagttgctcaagccttagatcagcctggaggaatggaggatgccgcccttccgtgcacaaacgccgaaatctagaagagcgatgcacacaatgtaaagcaggaaacagttttgagtggtgtccagtttttatcctttgtgctgtgaactgaggcgacatgtacctctgccgtaggtgacatgcatcgttatcatcacagattatagggcactttgcattgtatcatgtttggagtctaaaataaacgcgagagttttgatgcgatgctgattatgcttaggcatggatggagaagttgttatgatttcctttttttttaaaaaaaaaagttgtttgtgg

SEQ ID NO: 19674 - protein, 87 aa, Panicum virgatum
  misc_feature: Ceres CLONE 1806419-R
  misc_feature: SWISSPROT Homolog: EC 3.6.3.17 Monosaccharide-transporting ATPase
QKSRVAFAKITFKKPHIILLDEPSNHLDLDAVEALIQGLLVFQGGVLMVSHDEHLITGSVDELWAVSEGRVTPFSGTFKDYKKLLKP

SEQ ID NO: 19675 - DNA, 2360 bp, Panicum virgatum
  misc_feature: Ceres CLONE 1806427
  misc_feature: Encodes the peptide sequence at SEQ ID NO. 19676
atatgtcttgtgagaagtgagtagtgagttgtcgctaaactcagtgggcatcaaggcaacaaagcaagtgaccaagtaaaattatgcttcctctgtttgtatccctgatcgtcttgctcctccagccgagtcatgcagcctcttccaccgccgccgacgagtttgtctaccagggcttcgcctcggcgaaccttgctctcgacggcctcgccgtcgtgacgcccggcgggctcctcgcgctcaccaacgccacgaaccaggcgaaatcccacgccttccaccccactcctctgcggttcctgaacacgtccgcggcgacggcggtggcgcggtccttctcgacgtgcttcgtcttcgccatcgtgtccagctacgacgggctgagcgaccacggcctcgccttggtggtcgccccgaccacggacttctccacggcgaacgccggccagttcctgggcctcctcaacgccacgaacggcacggcgagccaccgcgtcctggcggtcgagctcgacaccatcatgaaccccgacttccaagacatcgacagcaaccacgtcggcatcgacgtcaacagcctcaagtcggagcaggcccggacggccggctactacgacggtggcgtcttccaagaactgaagctcaacagccacaagccgatgcaggtgtgggaggactacgacggcgaggccgggcagctcaacgtgacgctgtctccggtcaaggtgccaaagcctcagagaccacttctctccacggccgttgatctctccaccctcatggcggatccaatgtacatcggcttctcgtcggcgaccggcgtcgtgcccacgcaccactatgtgctcgggtggagcttccgcatggatgggccagctccccccatcgacttctccaagctccccaccctgccgcgcttgggtcccaagccccggtccaaggtcctcgtcgccgtgctgccgctcgccaccgccttgctcgtcgccgccgtgctggccgccgtcttcctggccatacagaggaggcgccggtacgccgaggtgcgggaagattgggaggaagagttcgggccgcaccggttctcgtacagagatctgttccgtgccaccgatggcttcaaggacaggaacttcctcggcgtcggagggttcgggagagtctacaagggggtgcttccagcatccggtcaggagatcgcggtgaagatggtctcgcacgattcacggcagggcgtgagggagttcgtcgccgaggtagtgagcatcggccgtctccggcaccggaacctcgtgcagctgctcggctactgccggcgtgaaggcgagctcctcctggtctacgactacatggagaacggcagcctcgacaggtacctgcacgacaagcacgcgcccactctctcttggcacgagaggttccggatcatcaagggcgtcgcgacggggctcctctacctgcacgaggactgggagcaggtcgtcatccaccgagacgtgaagccgagcaacgtgctcctggacgccgggatgaacgcgaggctcggcgacttcgggctggccaggttgtacgaccacggcacggtgcctcagagcactcatgtggtcgggaccatagggtaccttgcgccggagctcatgcgcatggggaaggtgacgccttccaccgacgtgttcgcgttcggcgtgttcctcctggaggttgcttgcgcgctgaggccgatcggccctagcagcggcggcggcgacgacggcggcggccgggttgcgctggtggactgggtcatggggcaccacctcggcggttcgatcctcgacgccgtcgacccgaggctcgtcggagagtacgaggcggaggaggcgacccttgtgctgaagctgggcctgatgtgcgcgcacccatcggccagtttgaggccgagcatgagaagcataatgcagtgcttggactccggcggatcagttcctgatccgtcgcatgggtacacgagctatagcacgatgacggcgctgatgcagaatgatggctttgactcgtttgtcatgtcatccacgaacccatcatccacgcatggtgcgtcctatgtgactgaactctcaggggggagatgatccttacttgaacgagctgacgatgagctactggatggcctcatagccacacaatcgtgtgactttaatttccaccgtttttttagtttaccgtgtttcacctccctggattagtgtgattttaagataaatatgttatttgcatacaacatgattttttatattgcttaacttactcaagcatttcaccagacagtggtcagctgctgtgtttctttccttgcattaacgaacaaaagaattcattatttc

SEQ ID NO: 19676 - protein, 674 aa, Panicum virgatum
  misc_feature: Ceres CLONE 1806427
  misc_feature (23)..(260): Pfam Name: Lectin_legB Pfam Description: Legume lectin domain
  misc_feature (345)..(620): Pfam Name: Pkinase Pfam Description: Protein kinase domain
  misc_feature: SWISSPROT Homolog: EC 2.7.11.1 Non-specific serine/threonine protein kinase
MLPLFVSLIVLLLQPSHAASSTAADEFVYQGFASANLALDGLAVVTPGGLLALTNATNQAKSHAFHPTPLRFLNTSAATAVARSFSTCFVFAIVSSYDGLSDHGLALVVAPTTDFSTANAGQFLGLLNATNGTASHRVLAVELDTIMNPDFQDIDSNHVGIDVNSLKSEQARTAGYYDGGVFQELKLNSHKPMQVWEDYDGEAGQLNVTLSPVKVPKPQRPLLSTAVDLSTLMADPMYIGFSSATGVVPTHHYVLGWSFRMDGPAPPIDFSKLPTLPRLGPKPRSKVLVAVLPLATALLVAAVLAAVFLAIQRRRRYAEVREDWEEEFGPHRFSYRDLFRATDGFKDRNFLGVGGFGRVYKGVLPASGQEIAVKMVSHDSRQGVREFVAEVVSIGRLRHRNLVQLLGYCRREGELLLVYDYMENGSLDRYLHDKHAPTLSWHERFRIIKGVATGLLYLHEDWEQVVIHRDVKPSNVLLDAGMNARLGDFGLARLYDHGTVPQSTHVVGTIGYLAPELMRMGKVTPSTDVFAFGVFLLEVACALRPIGPSSGGGDDGGGRVALVDWVMGHHLGGSILDAVDPRLVGEYEAEEATLVLKLGLMCAHPSASLRPSMRSIMQCLDSGGSVPDPSHGYTSYSTMTALMQNDGFDSFVMSSTNPSSTHGASYVTELSGGR

SEQ ID NO: 19677 - DNA, 2129 bp, Panicum virgatum
  misc_feature: Ceres CLONE 1806436
  misc_feature: Encodes the peptide sequence at SEQ ID NO. 19678
aagcaagctcgcagcgcaaacgttcctctcctcctcgtcctctgttgcctgctgccgccctgcacttacttgcagagcaatcgagctacacgcagcagctgcaggacaggacagccaccacgctgcgccaccagcaatggtttctgccggggggcatggcggcgacggcgacgacgggcagaccgtggacttccggggcaacccggccgacaagtcccggaccggcgggtggctcgccgccgggctgatcctgggcacggagctggcggagcgcgtgtgcgtgatgggcatttccatgaacctcgtcacgtacctcgtcggcgacctccacctctccaactcccggtccgccaacgtcgtcaccaacttcatgggcacgctcaacgtgctcgccctcgtcggcggcttcctcgccgacgccaagctcggccgcttcctcaccatcgccatctccgccaccatcgccgccaccggcgtgggcttgctggcggtgtgcacggcggtgccgggcatgaggccgccgccgtgcgccgacgcgcgcggcccgcgcgggcacgagtgcgcgccggcgcgcggcgggcagctggcgctgctgtacgcggcgctgtacacgacggcggcgggcgcgggggggctcaaggcgaacgtgtccgggttcgggtcggaccagttcgacgggcgcgacccgcgggaggagcgcgccatggtcttcttcttcaaccgcttctacctgtgcgtcagcatggggtcgctgctcgcggtgaccgtgctggtgtacgtgcaggacaacgtgggccgcgcctggggctacggcgtctccgccgcggccatgctgctcgccgtcgcggtgctcgccgccggcgcgcccaggtaccggtaccgccgcccgcggggcagcccgctggcgacgatcgggcgggtgctcgccgcagcctggaggaagcgccggctgccgctccccgccgacgccgccgagctccacggcttccacgccgccacggtcgcccacactgacaggctgaggtgcctcgacaaggcggcgatcgtggaggcggacctgcccgccgcggcggcggagaaggggccggcggcggcgccgacggtgacggaggtggaggaggtgaagatggtggtgaagctgctgcccatctggtccacgtgcatcctcttctggacagtctactcccagatgaccaccttctccgtggagcaggccacgcgcatggaccgccacctccgcccgggcggcgccgccgcctccgggttcgccgtcccggcggggtccttctccgtcttcctcttcctctccatcctgctcttcacctccctcaacgagcgcctcctggtgccgctcgccgcccgcctcacgggccgcccgcaggggctcacctcgctgcagcgcgtcggcgccggcctcgtcctctccgtcgccgccatggccgtcgccgcgctcgtcgagcggaggcgccgcgaggcctccgccggggaggggcacgtcgccatcagcgccttctggctcgtgccgcagttcttcctggtgggcgccggcgaggcgttcgcgtacgtggggcagctggagttcttcatccgcgaggcgcccgagcggatgaagtccatgagcacgggcctcttcctggtgacgctcgccatgggcttcttcctcagcagcttcctcgtcttcgccgtcgacggcgccacgcggggcgcgtggatccggaacgacctggaccgcgggcggctcgacctcttctactggatgctggccgtgctcggcgtcgccaacttcgccgtgttcctcgtcttcgccaggcgccaccagtacaaacccagcgccgccgtgccggccgcggtggcgcccgccggcagtccgctggacagcgccggctccggggagaaggagatggacgacctcgtcgcggtcaaagaggccgtggaaggggtggacgtgtagtactactagggacgacgcgagtagggcccgcatgtcagactcggaaccgagcggtgtgctttcgctattgggtagtgtacgacatttttttttctttcgctttctcagtttgctgcttcggcctgctctcctgtaaataactgtggagacatacgaattgaggcgaagttttgtttct

SEQ ID NO: 19678 - protein, 604 aa, Panicum virgatum
  misc_feature: Ceres CLONE 1806436
  misc_feature (100)..(503): Pfam Name: PTR2 Pfam Description: POT family
MVSAGGHGGDGDDGQTVDFRGNPADKSRTGGWLAAGLILGTELAERVCVMGISMNLVTYLVGDLHLSNSRSANVVTNFMGTLNVLALVGGFLADAKLGRFLTIAISATIAATGVGLLAVCTAVPGMRPPPCADARGPRGHECAPARGGQLALLYAALYTTAAGAGGLKANVSGFGSDQFDGRDPREERAMVFFFNRFYLCVSMGSLLAVTVLVYVQDNVGRAWGYGVSAAAMLLAVAVLAAGAPRYRYRRPRGSPLATIGRVLAAAWRKRRLPLPADAAELHGFHAATVAHTDRLRCLDKAAIVEADLPAAAAEKGPAAAPTVTEVEEVKMVVKLLPIWSTCILFWTVYSQMTTFSVEQATRMDRHLRPGGAAASGFAVPAGSFSVFLFLSILLFTSLNERLLVPLAARLTGRPQGLTSLQRVGAGLVLSVAAMAVAALVERRRREASAGEGHVAISAFWLVPQFFLVGAGEAFAYVGQLEFFIREAPERMKSMSTGLFLVTLAMGFFLSSFLVFAVDGATRGAWIRNDLDRGRLDLFYWMLAVLGVANFAVFLVFARRHQYKPSAAVPAAVAPAGSPLDSAGSGEKEMDDLVAVKEAVEGVDV

SEQ ID NO: 19679 - DNA, 2823 bp, Panicum virgatum
  misc_feature: Ceres CLONE 1806447
  misc_feature: Encodes the peptide sequence at SEQ ID NO. 19680
ggggggacatttgaattccccgcagcttccgcttcctgcgcggcctcgtaccgtccggaggcgccgccggccgggcccggcccctatcccctccccccctagggtttcgcgtcccccctcggcgatgggggacgccgccgccgccgccacgccagcagcgtcgcccgcggggaagcggcggcgcggcgatgaagtcgcggggctgaggcgggtggcggagatcgtgatggtgctggccgcggccggggaggtgcggggcgggagggagcccacggcggcggagcgggcgctcgcggccgaggcgcgggagaggctggctgcagccgtcgccgagggggcagtgcgtcccaaggatctgttcccaggggaggcggtgcgcgcggtcgtcgaggatctcgggctcaaccgcgccaaggaccccgccgccatggggttccgcccgcccaaggcatccatcgctgataggctcatgcttactaagcgcaagatggaagaagtcaaggaagctccagtccaaccaacagttagcacacctcaaacggtcgtcagtggaatgtctgagttccatagtttgaatggggctcccaagtttggtgttggagttcctcggaacccacaagttgcagctgtagctgctactgccccattaacctcgacatcccctgttatcttgaagccaccaggatcatctcctgtcaaaccagttgccaactcctcaggtgttgccctaccccatactggtccgtcacacaaattggacatagatgtcaatggtcctctgaattttgcacgcggtggagccactgttgtctacccaaacaagtctactctagatacatctgctaggcccaatgtaaatgctgtacagagttccaatcagttgttgaaaaaccaggacacaaagccagtggcagttcaagctgcaacaggtaatactgttgtggtgcatcgtgctacacaaagtgtggcatttgttccaccaaaacctacttttgtcaaccacaatgagattgcaaagtctgttcaacggtttctgcaccaacctacgaatcatcctagttggactccaccatcaactgagtacatgcattctcgcttgggctgtcaaatatgcaaagttgctatcactgatacagacagtttacttgtttgtgatgcctgtgagaggggagtacacttgaaatgccttcagcagtatggtaataagggtgttcctaaagctgagtggcattgttcagcatgcctgacacagagtaaaggcaaacccctgccaccaaagtatggcaaggttacaagaactgttgttgcatcaaaggctgcaccacctgctggtgcagcacaagcttctttgcagggatcagcagaaaacatggctgcaaaggagaatcaccaaaagttggctgcaaatggaaatcttatgaagccaatctccacacatggtggcagcactatgcacaacgtaaatgtattggcactgggtgccatgggtgctggttcacaatcacaattagcttctaccttgagacctccaatagtaaatactgttaaagctgaaacttcctctactggaaaggaaggaactgggcagcagcgcagtagtgtgacacagcctgatgtgaaattccctctaaggttgagaagtggttcctctttgaactctgcggtttctgctaatgataccatgaatagtgagcaaactgcagaaatgtctggcgctgaggcaaaggtcaagtctgaagcaaactttgagccccctgtgagcagggatgatgaattggttgatagtagtagaacatctgttgaacaaactaagattgttgctactgaagaaaatcccagggcacaagcaacccctgtgactgacaaattgaaagatgaggagatgactaccaacaatggaacatcaacagatcaaggaagaaacttcactactgaagcaaagctccccagtgaagcaccttctgaggcactcacaatcaatgatgtgaaaatgactatcagtactggaataccagtacagcaaagcaacattgttactattgaagaaaagctccagattgatgcggcctctgatccacataggatccaagatatggaaatgagtaccgacaatggactaccagcagatcaaagcagcaatattgttgctgaagaaatgtcccagtcagaaaagacctcttcaactggtgatacagatgtccctgctaatgctggaataccaacagatcaaacacagcattcgaatgggtcaaccgaaaatgcagtaaaacaacctcccaatggagaaccatataaagacaaattaggttgtaatatagtctcagattgtgtttcttctacccaaagaatagcttcgaatggcatcatataccctaaggatgaaacttcatgtgttagtgaaaatgaggctgtgggttgcaacacagaagcaaaagaagcaaactagatccagtagcaggttgcatcaaattttcttttttcagatagaactatgccgaatctaccattaattttaccagcgtcatgatcaactgtgttctttgcattctcttggatgacatacatttagccaccgccaaccatttttccaggaaggtatctactacctcctggtgtagctatagaagcctagaacacaggaaacgtggccccttaatgttgtactttatgtagatcgataatcttgagttcctaactatttaattccattttcccgtctgtttgtcccgtgcttatctgtagtcttgtaattagatagggtttagctgagtgaggattggattatcatgtcacaataatgatgcttgccttgggtcagttacc

SEQ ID NO: 19680 - protein, 773 aa, Panicum virgatum
  misc_feature: Ceres CLONE 1806447
  misc_feature (326)..(376): Pfam Name: PHD Pfam Description: PHD-finger
  misc_feature (327)..(385): SWISSPROT Homolog: EC 2.3.1.48 Histone acetyltransferase
  misc_feature (465)..(655): SWISSPROT Homolog: EC 3.4.24.75 Lysostaphin
MGDAAAAATPAASPAGKRRRGDEVAGLRRVAEIVMVLAAAGEVRGGREPTAAERALAAEARERLAAAVAEGAVRPKDLFPGEAVRAVVEDLGLNRAKDPAAMGFRPPKASIADRLMLTKRKMEEVKEAPVQPTVSTPQTVVSGMSEFHSLNGAPKFGVGVPRNPQVAAVAATAPLTSTSPVILKPPGSSPVKPVANSSGVALPHTGPSHKLDIDVNGPLNFARGGATVVYPNKSTLDTSARPNVNAVQSSNQLLKNQDTKPVAVQAATGNTVVVHRATQSVAFVPPKPTFVNHNEIAKSVQRFLHQPTNHPSWTPPSTEYMHSRLGCQICKVAITDTDSLLVCDACERGVHLKCLQQYGNKGVPKAEWHCSACLTQSKGKPLPPKYGKVTRTVVASKAAPPAGAAQASLQGSAENMAAKENHQKLAANGNLMKPISTHGGSTMHNVNVLALGAMGAGSQSQLASTLRPPIVNTVKAETSSTGKEGTGQQRSSVTQPDVKFPLRLRSGSSLNSAVSANDTMNSEQTAEMSGAEAKVKSEANFEPPVSRDDELVDSSRTSVEQTKIVATEENPRAQATPVTDKLKDEEMTTNNGTSTDQGRNFTTEAKLPSEAPSEALTINDVKMTISTGIPVQQSNIVTIEEKLQIDAASDPHRIQDMEMSTDNGLPADQSSNIVAEEMSQSEKTSSTGDTDVPANAGIPTDQTQHSNGSTENAVKQPPNGEPYKDKLGCNIVSDCVSSTQRIASNGIIYPKDETSCVSENEAVGCNTEAKEAN

SEQ ID NO: 19681 - DNA, 1839 bp, Panicum virgatum
  misc_feature: Ceres CLONE 1806449
  misc_feature: Encodes the peptide sequence at SEQ ID NO. 19682
aacatccaaagttagcccataaaatttaaccaacctagctatcaggagtcgccatagcctgctgccggccatgggagcactacaagcccaccacttctcctcttcggcgccgctggccgccgccggcctcgcgctgctggcgctctgctcgtactacctgctcgtcgtcgtcggccgccgccgcggcggcgtcggcaagccggagaagcggtacccgcccgtggtgggcacggtgttccaccagctgtaccacgtccggcggctgcacgactaccacacggacctgttccgggggcgcaagaccttccagctgctggcgccggccgggcggcggcagatctacacgtgcgacccggccgtcgtggagcacatcctccggaccaacttcgccaactacggcaagggcgcgttcaactacgagaacatgaccgacctgctcggcgacggcatcttcgccgtggacggcgacaagtggcggcagcagcggaagatggccagctacgacttctccacgcgggcgctccgcgacttcagcggcgccgtcttcaagcggaacgccgccaggctcgccggcgtgatctccgatgccgcggaggccgggcggcccgtggagttccagggcctcgcgctccgggcgaccatggactccatcttcgccatcgccttcggcctggacctcgacacgctggccggctccggcgagggcacccgcttcgccgcggccttcgacgacgccagcgagttcgcgcttctccgctacgtcaacgccttctggaaggcgatgaggttcctcaacgtggggtccgaggcggcgctccgggaccgggtcaaggtcgtcgacgagttcgtgtacaagctcatccgcgacagggcagaggagctctcctctggcagcaaggattcgaggcaagacatgctgtccaggttcatcgaagcggccacggacgagtccgggacggtggactacaagtacctgagggacatcatcctgaacatagtgatcgccggcaaggacacgacggcgggggcgctggcgtggttcctctacatggcgtgcaagcacccggaggtccaggagaaggtccgcgaggaggccgcaagggccaccggcgccagcgagacggcgaccgcggaggagttcgcgcagagcctgaccgacgaggccctgaacaagatgcactacctgcacgccgccctgacggagacgctcaggctgtacccgtcggttcccctggataacaagcagtgcttgggcgacgacgtcctgcccgacggctccagcgtgagcaagggggacatcgtgttctacgccccgtacgccatgggccggatgaagtacctgtggggcgcggacgccgaggacttccgccccgagcggtggctcggcggcgacggcggcgagttccaggcgcagagcccgttcaagttcacggcgttccaggccgggccgaggatatgcctgggcaaggagttcgcgtacaggcagatgaagatcttcgcggccgtgctcctccggtccttggcgttccgcctccgcgacggcgagggggaggacgtcggctaccgcaccatgatcacgctccacatcgacagggggctccacctgtcggcgacggcgaggtgagcggggctgcctggtcctggtgggtggtggctagcccgctcgcgccggcctgggcgcgtcgcgtcgcgtcgcggcatcaggcagctggccggcgccctccgcgagcgacggatccctggacttgcacgagagtagacgagcactagtgatgccgtgcagccactcgcgcaccgcgtgtccgcgtcgcccggttgggagtatagtatggtaacatc

SEQ ID NO: 19682 - protein, 517 aa, Panicum virgatum
  misc_feature: Ceres CLONE 1806449
  misc_feature (47)..(513): Pfam Name: p450 Pfam Description: Cytochrome P450
  misc_feature: SWISSPROT Homolog: EC 1.14.14.1 Unspecific monooxygenase
MGALQAHHFSSSAPLAAAGLALLALCSYYLLVVVGRRRGGVGKPEKRYPPVVGTVFHQLYHVRRLHDYHTDLFRGRKTFQLLAPAGRRQIYTCDPAVVEHILRTNFANYGKGAFNYENMTDLLGDGIFAVDGDKWRQQRKMASYDFSTRALRDFSGAVFKRNAARLAGVISDAAEAGRPVEFQGLALRATMDSIFAIAFGLDLDTLAGSGEGTRFAAAFDDASEFALLRYVNAFWKAMRFLNVGSEAALRDRVKVVDEFVYKLIRDRAEELSSGSKDSRQDMLSRFIEAATDESGTVDYKYLRDIILNIVIAGKDTTAGALAWFLYMACKHPEVQEKVREEAARATGASETATAEEFAQSLTDEALNKMHYLHAALTETLRLYPSVPLDNKQCLGDDVLPDGSSVSKGDIVFYAPYAMGRMKYLWGADAEDFRPERWLGGDGGEFQAQSPFKFTAFQAGPRICLGKEFAYRQMKIFAAVLLRSLAFRLRDGEGEDVGYRTMITLHIDRGLHLSATAR

SEQ ID NO: 19683 - DNA, 2664 bp, Panicum virgatum
  misc_feature: Ceres CLONE 1806452
  misc_feature: Encodes the peptide sequence at SEQ ID NO. 19684
accttgaagacttttgagcgacgcgcggcctgtcgagaccaacaggtggactaggaaggaggagcacgccatacgcccatagccccataccatgacacgatctctgctccgacctgcagcggatgccatcgccatggcaagcgccacgagaacgcgcacccgaaccgccgccgccctcctcctctacgcgctcacgttccagttactgacgcgcgcgtcatccaccaccgcggtcaccgcctctccaccgccggcagccgtcgccgaagcccgcgcgctgctgcggtggaagtccactctgccgccgcccggccccacccgcgccccgctctcctcatggtcgcccgcgaccgccgcctgcgcctcgtgggtcggcgtcgcgtgcgacgccggcggccgcgtcgccgagatcgcgctccccggcgcgggtatcgccggcacgctcgcggccctcgacctcgccgcgttcccggcgctcgcgggcctcaacctcagcggcaaccgcctcacgggcgccatcccggccagcgtctccgcgctgacgtcgctcgtttcgctcgatctgtccgacaacgccctcaccggcggcatcccgggggcggcgctcgcggcgctgccggtgctgagggtcctcgtgctgcgcaacaactcgctcggcggtgccatcccggcttctctgggcgggctgcggacgctggagcggctggacctgcaggccacggggctggtatccacgctgccgccagagatgggaggcgtggcgagcctcagcttcttggacctctccaggaacaacctctccggcgggctgccgccgtcctttgctgggatgagcaagatgaaggaattatacttgtcgagaaacaggctctcgggtacgattccgcctcagattttcaagaactggccgaacctaaccctgctctacctgcactacaacgccttcacgggaaccatcccagcggagattggagaggcgaagaagctgcttcggctatcactttggagcaacaacctcaccggcgtgatcccagcggagatcagcggcttgccgagcctgcagatgctgcacctgggacagaattgcctcactgggccgatcgccccttctttggggaacctgactcagcttgtgatcctggttttgtccttcaacaacctcacaggcatggtccctgctgagatcggcagcctgacagcactgcaagaccttgacctcatcagcaaccagttggaaggtgagctgcctcctaccctgtcattgctcaaagatctttactatctttccttggcgagtaacaacttcgtcggcactatcccgagctttgcaagtcagaagttggtctctgctgaattgaatggtaacaaattctctggaggcttccctctgtcattctgccagtttacttccttggagatcctggacctatctagcaaccaactttctggccagctccctagctgcatatgggacttgcaggatcttatgttcatggatttgtccaataatgctctttcaggggatgtactggcttccacaaactctaatttatcgttggagtcattgcatttggcaaataacagattcacaggaggcttcccatcaatcactcactacttgaagatgctatctgtcctggaccttggtggtaacgttttttctggcgcaattccatcatggataggttcaaggttacctttgctaagatttcttcgactgcggtcgaacaggttcaatggcagtattcctttgcagctgctacagctctctcatctccagctgctggacctggctagcaacaattttgaaggtcacataccatgtggcctcaccaacttaacatccatgatccgaccacagactgaattcaacatgaggtcgacaatgcaccatcaaattttatatatgcaagctgatttttattatgccgatcgagtggatgtgaactggaagatgcagacttatggatttcaaggggcaattgcgctgatgaccggtatcgatttgtcaggcaattctatcaatggcgaaattccaactgaattaacaaatcttcaaggccttcggtttctgaacctgtcaagaaatcatctatctggtactattcctgtgagtattggcgatttaaaacttttggagtcccttgatctctcatggaatgaactgtctggtcatattccttcaggcatctcggaactgatatctcttagttcgttaaatctctctaacaatatgctctcaggtgaaataccaactggtaatcaactccaaacactaaccgacccttcaatttacagcaacaactttgggctttgtggctttccattgagtatatcatgtctcaatggttcgagtatacaaacattggaccgcagtaaagaatttgaaggtgtctatgtctactactcgataattgccggagttgtatttgggctgtggttgtggttcggatcattagttttgttcgctccatggagaatctcatttttctactatgtcgattgcacccatagaaagcttatgagataaatctttaaagtctgttgttttttttaaaaaaaatgtaaagtctgttgttgtaaaattaagtaaggatgtgtgcaatactatttttcttgtcatctacctttctcttttcaatttacctttactttctctttggc

SEQ ID NO: 19684 - protein, 798 aa, Panicum virgatum
  misc_feature: Ceres CLONE 1806452
  misc_feature (42)..(85): Pfam Name: LRRNT_2 Pfam Description: Leucine rich repeat N-terminal domain
  misc_feature: SWISSPROT Homolog: EC 2.7.11.1 Non-specific serine/threonine protein kinase
MASATRTRTRTAAALLLYALTFQLLTRASSTTAVTASPPPAAVAEARALLRWKSTLPPPGPTRAPLSSWSPATAACASWVGVACDAGGRVAEIALPGAGIAGTLAALDLAAFPALAGLNLSGNRLTGAIPASVSALTSLVSLDLSDNALTGGIPGAALAALPVLRVLVLRNNSLGGAIPASLGGLRTLERLDLQATGLVSTLPPEMGGVASLSFLDLSRNNLSGGLPPSFAGMSKMKELYLSRNRLSGTIPPQIFKNWPNLTLLYLHYNAFTGTIPAEIGEAKKLLRLSLWSNNLTGVIPAEISGLPSLQMLHLGQNCLTGPIAPSLGNLTQLVILVLSFNNLTGMVPAEIGSLTALQDLDLISNQLEGELPPTLSLLKDLYYLSLASNNFVGTIPSFASQKLVSAELNGNKFSGGFPLSFCQFTSLEILDLSSNQLSGQLPSCIWDLQDLMFMDLSNNALSGDVLASTNSNLSLESLHLANNRFTGGFPSITHYLKMLSVLDLGGNVFSGAIPSWIGSRLPLLRFLRLRSNRFNGSIPLQLLQLSHLQLLDLASNNFEGHIPCGLTNLTSMIRPQTEFNMRSTMHHQILYMQADFYYADRVDVNWKMQTYGFQGAIALMTGIDLSGNSINGEIPTELTNLQGLRFLNLSRNHLSGTIPVSIGDLKLLESLDLSWNELSGHIPSGISELISLSSLNLSNNMLSGEIPTGNQLQTLTDPSIYSNNFGLCGFPLSISCLNGSSIQTLDRSKEFEGVYVYYSIIAGVVFGLWLWFGSLVLFAPWRISFFYYVDCTHRKLMR

SEQ ID NO: 19685 - DNA, 1915 bp, Panicum virgatum
  misc_feature: Ceres CLONE 1806458
  misc_feature: Encodes the peptide sequence at SEQ ID NO. 19686
gtcccgaatcctcctgtctcccgaactcctcccgacccctgcccaatacgccgccgccgcctgcccagtacgccgccgccgcctgcccagtacgccgccgcaggtacgggcgccgtcgccggcgaggtccgcccgacctccctccggccagatccgcccggcctcttgccttctgccgcccagagccggccacccggcccccttgccctctgcgcgcgtgaggccggcgcgggaggccgccgcccaggccaccgcggcgcgtggagggacttccccgcgacgtcgcttctcgagctctctcctctgttccctctcctccccgccgcggctctcctctcctctgccccgctccgctagggttttgccgccgccctctctctcgctcccttccggctccgcgaggcaaccatccgacccgtagaaaatggtggacgtggaggaggtcgggaagatgcaatcgcagatgcgcctgcacgccgagccggaggacgacgccgccgacctccccctgctggccctcttcgacagggcgtcgcggctccacgccctggcctccagctccgccctcgaccaggatgggatccgcaccggggttgatctgctgcggtgctgcgacgagatggtcagcaagctcggcctcttctcccccaacgagaccaaggaggacgtctccaccgcaaacctcaagtacctactcgttccctattaccttgcggaaatgaccgaaaagatagcacaggaggatcggatcccagttcttaaggcgtcacaagaccacttgaaggagttcattgctctatgtgaagtactagagctaattccagaggatgagctagaattgtctaggcagaagcagcctgatactatggcaaacagaagagcgcagaaggttgcccggttcaaacgtcaaaaggctgctgaaacgaagctccaagagatcagagagagaaaagaaaggcgtggacgctcactgagagcagctgctttatctgccccaattgaaactggagaggaagatgacttggaggatgatggggaggaagaaagagaggcttggttagctaccatctccttggctctctgcaaggcgtttgatcttctcgacatgctaaagaaggaagaagaaatgcttctagctgtaaaggaaaggaaggcaaaggacgggaatgcatttgctcgtgaaatgcttgatgaacagacaaagaaggctgaagcatggcaccataatgctgccaatcgtgtggcatattccaaaccagctgatccaatcacttgcgcaacatttgctcaagatgtcattgaaggtagagcaagcgtttcacaagctcacgagcacaaacaccagcccctgatatttggacctgcaaatcttgttggtggtggtctaaccagtgaaagggaaagaatggcagcacaagtttttcagcctagttgcaggatgccaacaatgagcatcgaagaagctggtttgcgcgagatgaaaatgatggagaagtggcaagacagggctaccaagacgatgaaagaagcaaactccgcgtggcacaatgatggcaccagctcggcccaagaggacgaggacgccatcaattttgcgctactccctgatgaggctctcttggcatctcagctagagggagcccggagatcctctattgagaaggcctataatgcggcactccgcgaggctgaaaaaatacacacaggaagaagaacaaaacccaccgcacgttggccgaagaaagtggtggaagtctttcagatgatctatatggcaacatgtatgacaaaagaagtgcgctttaaaagaggcgaggagaattgggttgatgatcccatagttcacgatatggcgcttgagctctttgcgagaacgcaaagagcatatagcggccaacaattgcacaacaaatgg

SEQ ID NO: 19686 - protein, 496 aa, Panicum virgatum
  misc_feature: Ceres CLONE 1806458
  misc_feature (27)..(417): Pfam Name: TAP42 Pfam Description: TAP42-like family
  misc_feature: Functional homolog of the protein sequence given in SEQ ID NO 50847
  misc_feature: Useful for making plants with modulated biomass
MVDVEEVGKMQSQMRLHAEPEDDAADLPLLALFDRASRLHALASSSALDQDGIRTGVDLLRCCDEMVSKLGLFSPNETKEDVSTANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIETGEEDDLEDDGEEEREAWLATISLALCKAFDLLDMLKKEEEMLLAVKERKAKDGNAFAREMLDEQTKKAEAWHHNAANRVAYSKPADPITCATFAQDVIEGRASVSQAHEHKHQPLIFGPANLVGGGLTSERERMAAQVFQPSCRMPTMSIEEAGLREMKMMEKWQDRATKTMKEANSAWHNDGTSSAQEDEDAINFALLPDEALLASQLEGARRSSIEKAYNAALREAEKIHTGRRTKPTARWPKKVVEVFQMIYMATCMTKEVRFKRGEENWVDDPIVHDMALELFARTQRAYSGQQLHNK

SEQ ID NO: 19687 - DNA, 1232 bp, Panicum virgatum
  misc_feature: Ceres CLONE 1806470
  misc_feature: Encodes the peptide sequence at SEQ ID NO. 19688
accatccaagcagacacgctagctgtagcatagcaatttccgcaagaacacctggtgatctttatctcgctcggaaagcagtagaggtagagagagatttcattgccgcttgttgtagcagaagagtgtgaggagtagcagagagcagcagccatgaatcccgacaacttcacgcacaagaccaacgaggcgctggtggcggcgcacgagatggcgtcggaggccggccacgcgcagctcacgccgctgcacctggctgcggcgctggcggcggacaagggcggcatcctgcggcaggccatcacgggggcgtccggcggcgacgggtccgccggggactcgttcgagcgcgtgctagccagcgcgctcaagaagctgccgtcgcagtccccgccgccggactcggtcccggcgtccacggcgctgatcaaggccatccgccgcgcgcagtccgcgcagaagaagcgcggcgactcccacctcgccgtcgaccagctgctgctcggcctgctcgaggactcgcagatctccgactgcctcaaggaggccggcgtgtccgccgcgcgggtgcgcgccgagctcgagaagctccgcggcggggagggccgccgcgtcgagtccgcgtccggcgacaccaacttccaggcgctcaagacctacggccgcgacctcgtcgagcaggccgggaagctggaccccgtcatcggccgcgacgaggagatccgccgcgtggtgcgcatcctctcgcgccgcaccaagaacaacccggtcctcatcggcgagcccggcgtggggaagacggccgtcgtggagggcctcgcgcagcgcatcgtccgcggcgacgtgcccagcaacctcctcgacgtccgcctcgtcgcgctcgacatgggcgcgctcgtcgccggcgccaagtaccgcggcgagttcgaggagcgcctcaaggccgtgctcaaggaggtcgaggaggccgaggggaaggtcatcctcttcatcgacgagatccacctcgtcctcggcgcgggcaggacggaggggtccttggacgccgccaacctgttcaagcccatgctcgcgaggggccagctccggtgcatcggcgccaccacgctggaggagtaccgcaagtacgtggagaaggacgccgcgttcgagcggcgcttccagcaggtgttcgtcgccgagccgagcgtgcccgacaccgtcagcatcctgagggggctcagggaaaagta

SEQ ID NO: 19688 - protein, 359 aa, Panicum virgatum
  misc_feature: Ceres CLONE 1806470
  misc_feature (98)..(148): Pfam Name: Clp_N Pfam Description: Clp amino terminal domain
  misc_feature (17)..(69): Pfam Name: Clp_N Pfam Description: Clp amino terminal domain
  misc_feature (204)..(357): Pfam Name: AAA Pfam Description: ATPase family associated with various cellular activities (AAA)
  misc_feature: Functional homolog of the protein sequence given in SEQ ID NO 50876
  misc_feature: Useful for making plants with modulated heat sensitivity
MNPDNFTHKTNEALVAAHEMASEAGHAQLTPLHLAAALAADKGGILRQAITGASGGDGSAGDSFERVLASALKKLPSQSPPPDSVPASTALIKAIRRAQSAQKKRGDSHLAVDQLLLGLLEDSQISDCLKEAGVSAARVRAELEKLRGGEGRRVESASGDTNFQALKTYGRDLVEQAGKLDPVIGRDEEIRRVVRILSRRTKNNPVLIGEPGVGKTAVVEGLAQRIVRGDVPSNLLDVRLVALDMGALVAGAKYRGEFEERLKAVLKEVEEAEGKVILFIDEIHLVLGAGRTEGSLDAANLFKPMLARGQLRCIGATTLEEYRKYVEKDAAFERRFQQVFVAEPSVPDTVSILRGLREK

SEQ ID NO: 19689 - DNA, 1451 bp, Panicum virgatum
  misc_feature: Ceres CLONE 1806470-R
  misc_feature: Encodes the peptide sequence at SEQ ID NO. 19690
tgatgctcactgaaaccgtcggccctgaacaaattgcagaggtggtgagccgatggacgggcattccggtgacccggctcgggcagaacgacaaggagaggctggttggcctggcagacaggctgcaccagagggtggtcggccagacggaggccgtgaacgctgttgcagaggcggtgctgaggtcgagggccggtctcggccggccgcagcagcccaccgggtccttcctcttcctgggtccgaccggtgtgggcaagactgagctcgccaaggccctcgctgagcagctgttcgacgacgagaacctacttgtccgcattgacatgtccgagtacatggagcagcactcggttgctcgactgatcggagcaccacctggctatgttggacacgaggagggtgggcagctgaccgagcaagtgaggaggaggccgtacagcgtgatcctcttcgatgaggtggagaaggcgcacgtgtccgtgttcaacaccctgctccaggtgctcgacgacgggaggctgaccgacgggcaaggcaggacggtggacttcaggaacaccgtgatcatcatgacatccaacctcggcgccgagcaccttctcgccgggatggtgggcaagaactccatgaaggtcgctcgcgatctcgtcatgcaggagttgaggaggcacttccgccctgagctgctgaaccggctcgacgagatcgtgatcttcgatcccctttcccacgagcagctgaggaaggttgctcgccttcagatgaaggacgtggccgtccgtcttgccgagaggggcatcgcgctggccgtcaccgacgccgccctcgacgtcatcctctcgctgtcctacgatccggtctatggagcgaggcccatcaggaggtggatcgagaagagggtggtgacgcagctgtcgaagatgctgatccaggaggagatcgacgagaactgcacggtgtacatcgacgccgcgccggccaaggacgagctggcctacaaggtggaccggagcggcgggctggtgaacgccgagacgggccagaagtcggacatcctgatccaggtccccagcgccgccggcaggggcgacgccgcgcaggccgtgaagaagatgcggatcatggaggaggacgacgaggacggcatggacgaggagtagagaggcccgggcgtgccgaggagcgtcccatcctgctccggggctccgggctccggcggcgcccccgggtgtttgccaaataagtgtgtagataagtcgtgttgcgaaggcacaatgtgacgctttgtgaagatgatgtgtttttgaacttctcatgcttttgtaaggagggttgtgtttgttgaaaacatctgcagcggaatcgatggaatgaatgatgcttttgtaataagtttcaagcacatttgacgcctgtaatcgcaaaagaaaaagaacatttgacgccgc

SEQ ID NO: 19690 - protein, 386 aa, Panicum virgatum
  misc_feature: Ceres CLONE 1806470-R
  misc_feature (71)..(236): Pfam Name: AAA_2 Pfam Description: ATPase family associated with various cellular activities (AAA)
  misc_feature: SWISSPROT Homolog: EC 3.4.21.53 Endopeptidase La
  misc_feature: Functional homolog of the protein sequence given in SEQ ID NO 50876
  misc_feature: Useful for making plants with modulated heat sensitivity
MLTETVGPEQIAEVVSRWTGIPVTRLGQNDKERLVGLADRLHQRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVSVFNTLLQVLDDGRLTDGQGRTVDFRNTVIIMTSNLGAEHLLAGMVGKNSMKVARDLVMQELRRHFRPELLNRLDEIVIFDPLSHEQLRKVARLQMKDVAVRLAERGIALAVTDAALDVILSLSYDPVYGARPIRRWIEKRVVTQLSKMLIQEEIDENCTVYIDAAPAKDELAYKVDRSGGLVNAETGQKSDILIQVPSAAGRGDAAQAVKKMRIMEEDDEDGMDEE

SEQ ID NO: 19691 - DNA, 670 bp, Panicum virgatum
  misc_feature: Ceres CLONE 1806473-R
  misc_feature: Encodes the peptide sequence at SEQ ID NO. 19692
aggctctcaaccacagcatggaagccacccagcagagcatctccgacattatcgctgcacccgatgtcgctcccgcaaccttcatgggccacatgtccctcgccatgaacaaggtcagctctatggagggctttgtcatgcaggcagatggactaaggcagcagaccctccataagctccaccacatcctgaccacccgtcaggctgctcggtgcatggttgcgatcgctgactacttccaccgccttcgcgcgctcagcactctctgggatgcaaggccaaggcaggaggatgggctagcgctgtagatgaagctcgcagaataaaacgaggaagaagaagtacaataatgcatgcacgtgcaagtttaattgttctttttcttcttgttgcatgcatgcaaagctagttagtctaagagaagaaaccaatgcatgcaagatttaattgatctaattaagaactagtgtatggtggcttagtttcagctggtagtgcacactgatgaagaaaggattgttcttcatatgtgtgagcagcaacttctttaaggtgtacatggccggggcagagaaggtaggaagtaagaatagtgttgactgtggacctcccttttgttcctaacttatgcaccaactattttggaggtattcacccagaacatcattgg

SEQ ID NO: 19692 - protein, 101 aa, Panicum virgatum
  misc_feature: Ceres CLONE 1806473-R
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: Functional homolog of the protein sequence given in SEQ ID NO 50877
  misc_feature: Useful for making plants with modulated biomass
ALNHSMEATQQSISDIIAAPDVAPATFMGHMSLAMNKVSSMEGFVMQADGLRQQTLHKLHHILTTRQAARCMVAIADYFHRLRALSTLWDARPRQEDGLAL

SEQ ID NO: 19693 - DNA, 726 bp, Panicum virgatum
  misc_feature: Ceres CLONE 1806473
gtgcatctctctctcccggctctctctctctatacctctcttaaaagtcctctcaggttcttggtcaaaaggtgagggtagaagggaggcgattttaggtgacatatatacaaacgaaaaggctttgcagacttcctttaaagctttgtgccaactataaaaagagagggtgcaaacagaagacggttttgccattaattctggttttggatccttttgctggggttgtgcatagtgtgaggagaaagagccgggtggaggatggtcagggccttcataaggtcttcatcaggcggggttctgctggagaagaagaccaccaccaccaccatcaccaagcacctgagctccccctgggtctccggagcgcctaaccgccgacgatgatgcctgcttcttccaccatgagcaaggaatcagcaagctatgacatggcggaattcgaccagtcagcaatttttctctacctggatggccacgatcaagaacaacggcagactctaaacatcttcccatcgcagccgatgcatgtagccgagccaattcctgccaaggatgttagcgtgggcatggtggcagccatgcccaatggcactcttctcctcccaagagacaagagcaaggtggccagaggagtcctgctgtacctcctgcccccactgtggccttgcttacctcagccaaaggagaccaagagtagcctaactaagagggaagcaactaacg

SEQ ID NO: 19694 - DNA, 2507 bp, Panicum virgatum
  misc_feature: Ceres CLONE 1806478
  misc_feature: Encodes the peptide sequence at SEQ ID NO. 19695
agccccgcaccttctcttccccccaggccccagcgccgccgccaccgccgccgcaacacagcgcgagcacccccgcctcttctgtctcgttctcgcagagggtttcaggcgttgtatgtaggagaagatggcgctggcaatctccatggaaggaatcgaggcgcgtgcgcgggagatcggggtggacctctccgccgtcaatctggactccatcaccctcccggccggcgaggacttcggcatcctgagtgatgatgaggagatacttcgaaatgaggaccctcctgaacttgaaatgggtttatccaacattatcgtagtggacaatctgccggtcgttcctccagaaaaatttgagaagcttgagaatgttattcgcaagatatacagccaaattggagtgataaaagaaaatggtctatggatgccggtaaacccagatacaaagaagacatatggctactgtttcattgagtataatacccctcaggaagctgagcttgcaagggaaaaaaccaatgggtacaagctcgacaagtctcatatctttgcagttaacatgcttgatgactttgagaaatacatgaaggttcctgacacatggacgcctgcagaaataaagccatacactcctggagaaaatcttctgaaatggctaactgatgaaaaggcccgagatcagtttgtcatccgtgctggtacattgacagaagtttactggaatgatgctagaaagctggcacctgaactcgtgtttcaaaagcagtactggacagacagtttcattcagtggtcccctcttggaacatacttggcaactgttcataggcaggggtcacaggtgtggggcggtgaaaatggcttcgagcggttgatgcgttttgctcatccgatggtcaaattgattgacttttctcctggtgagagatatttggtcacatacagcagccacgagcccagcaatcctagagacacacatagggttgtcctaaatatctttgatgtaaggactggaaaagttatgcgagacttcaagggaaatgctgatgaatttaccactggcgggaatgttggtgtttctggtgtttcatggcccatattcaggtggggtggtggaaaggacgataagtatttcgcaaggcttgggaagaacgtaatatcggtctatgaaacagatatgttctcccttcttgataagaagtcattgaaggtagaaaatgtagtggacttcagctggtctcccactgatccaatcatatccttgtttgtgcctgaaatgggtggtggcaaccagccagcaagggtgagccttgtgcaaattccaggcaaagaggaactgcggcagaaaaatcttttcagtgtcagcgactgcaagatgtattggcagaataatggagaatatcttgctgtccaggttgatagatacacaaaaacaaagaagagcacctacactgggtttgagttgtttagaattaaggagagagacatcccaattgaggtccttgaactcgagaacaagaatgacaagatcattgcatttgcctgggaacctaaaggccatcgcttcgccatcattcatggtgatggccctaggcctgatgttagtttttacaccatgcgaacagcaaataacactagccgtgtgtcgaagctcaccactctcaaggccaagcaagcgaacgcactgtattggtctcctgctggccgcttcattgttcttgctgggctgaagggattcaatggacagctggaattctacaatgttgatgagcttgaaatgatggcaacaggagagcattttatggcaacagacataatgtgggatcctactggaagatatcttgcaactgctgttacctcagtccatgaaatggagaatggatttcaaatatggtccttcaatggcaagcacctttacaaggtgtcaaaggatcacttctatcagtttatttggcggccaagaccaccatcacttttgactcctgagaaagaagaggaaatatcaaagaacctgaagaagtacagcaagaaatacgaactagaagaccaggatgcgttcaaccagctgagcgagcaggagcgcaagaggaggacacagctccaggaagaatgggactcgtgggttgccaagtggaagcagatgcatgaggaggagcgtgcatataggagggagctcagggatggggaggccagtgatgaggaggaagagtacgaggccaaggaggttgaggtggaagaagtggtggatgtcaccgaagaagttctcgcatttgacctggatcaggagtgaaaggcttatgatagaatctgttgagttgcttttagtttaccagcgtgtcagaagttcatcgccgtcgctttgcataataggctcagtgatcaagctcacagtttgctgatcgttttacttgtctgtacacttgctgcttggatttgtggatcatgtattcagatatcaaattttgctgctgctggattactaatctttgtctggctttgccacagtt

SEQ ID NO: 19695 - protein, 720 aa, Panicum virgatum
  misc_feature: Ceres CLONE 1806478
  misc_feature (407)..(607): Pfam Name: eIF2A Pfam Description: Eukaryotic translation initiation factor eIF2A
  misc_feature (63)..(142): Pfam Name: RRM_1 Pfam Description: RNA recognition motif. (a.k.a. RRM, RBD, or RNP domain)
MALAISMEGIEARAREIGVDLSAVNLDSITLPAGEDFGILSDDEEILRNEDPPELEMGLSNIIVVDNLPVVPPEKFEKLENVIRKIYSQIGVIKENGLWMPVNPDTKKTYGYCFIEYNTPQEAELAREKTNGYKLDKSHIFAVNMLDDFEKYMKVPDTWTPAEIKPYTPGENLLKWLTDEKARDQFVIRAGTLTEVYWNDARKLAPELVFQKQYWTDSFIQWSPLGTYLATVHRQGSQVWGGENGFERLMRFAHPMVKLIDFSPGERYLVTYSSHEPSNPRDTHRVVLNIFDVRTGKVMRDFKGNADEFTTGGNVGVSGVSWPIFRWGGGKDDKYFARLGKNVISVYETDMFSLLDKKSLKVENVVDFSWSPTDPIISLFVPEMGGGNQPARVSLVQIPGKEELRQKNLFSVSDCKMYWQNNGEYLAVQVDRYTKTKKSTYTGFELFRIKERDIPIEVLELENKNDKIIAFAWEPKGHRFAIIHGDGPRPDVSFYTMRTANNTSRVSKLTTLKAKQANALYWSPAGRFIVLAGLKGFNGQLEFYNVDELEMMATGEHFMATDIMWDPTGRYLATAVTSVHEMENGFQIWSFNGKHLYKVSKDHFYQFIWRPRPPSLLTPEKEEEISKNLKKYSKKYELEDQDAFNQLSEQERKRRTQLQEEWDSWVAKWKQMHEEERAYRRELRDGEASDEEEEYEAKEVEVEEVVDVTEEVLAFDLDQE

SEQ ID NO: 19696 - DNA, 2164 bp, Panicum virgatum
  misc_feature: Ceres CLONE 1806484
  misc_feature: Encodes the peptide sequence at SEQ ID NO. 19697
gccttcttcttgcattgctgctatcaccagtgtccagcctttgtacctgctagccataaataaagccagctgagctgagctagctccatgcatgcccatcagcagttatatgcagcaagacacaaagcaaaattaatagctagagagatagccagcagcaggtagtagcaattccaacaagtcatggctcaagtgttgcagcaggtgcgccatgccttccatgagctgctgctgctgctgccacaagcatcagcagtagcagtattggtctccatcctgctcatcatcatcctgatcgagatcgtgcgccgcccatcgacggcggcggccaccgcagcaagaagaagagccagcatcagagaagagctgctgagcaagctgccttcgcctcccggcaggctccccgccatcggccacctccacctcgtgggctccctcccgcacgtctcgctccgcgacctcgccgcccggcacggccgcgacggcctcctgctcctccgcctcggcgccgtcccgacgctcatcgtctcctcgccgcgcgccgcgcaggccgtcctccgcacgcacgaccacgtcttcgcctcccgggcctcctcccccgtcaccgacatcctcttctacggctccacggacgtcgccttcgccccctacggcgagcactggcgtcaggtgaggaagatcgccaccacgcacctgctcacggccaggaaggtccggtcctaccgccgcgcccgcgagcacgaggtgaggctggtggtggccaggatccgcgaggcggcggccggcacgggcggcgccgccgtggacctgagcgagctgctcaactgcttcaccaacgacgtggtgtgccacgccgtgtccggcaagttcttcagggaggaagggcggaacaggctgttccgggagctcgtggaggccaactcgtcgctcatcggcggcttcaacgtggaggactacttcccggcgctggtgaagctggaggtggtgaagaggatggtgtgcgccaaggcccggaaggtgaaggggatgtgggacgagctgctggagaagctcatcgatgaccatgccagcaggctgccagcggcggaacgcgacggcggcgaggagagcagcgacttcatcgatgtgctgctctccgtgcagcaagagtacaagctcacgagagaccacatcaaggcgcaattggcggtaaataacaatttaattgccatcgtcgtcgtcatcacaaactaattaacagctacatgttttaactctgttcgtttttgtatatacatatacatgacgtagatcatgttcgaagctggcacggatacgtcattcatcgtcctggaatacgcaatggttcggctgatgcaaaaccctggcctcatggacaagctccaagccgaggtgagaagcactgtaggcaaagcacgcaaggataaagacgacgacgacatggtggttaccgaggatgagctcaacgacaacatcaacaatctagcctacctcaaggccgtcatcaaagagacgctccgactccacatgccggcgccactcctggtgccgcacctctccatggccgactgcgacatcgagggctacaccataccggcggggacgcgcgccatcgtcaacggctgggcgcttgcaagagacccaagctactgggagaaggcggaggagttcatgccggagcggttcatggaaggcggcagcgctgcggccatggagtacaaggggaacgacttcctctacctgccattcggggcagggcggaggatctgccctggcatcaactttgcgacctccaccatcctagtcatgcttgcaaaccttgtgtaccacttcaactgggagctgccacctgagtcggcggagaaaggcatcgacatgaccgagtcattcggggtcaccgtgcaccggaaagagaagctcctccttgtccccgtactgcctccatcatatcattagtcctttattcatgagctgcatgcggatcgatcaagggctactcttaattaaactagcttaattaattcctatatatgattatattgtttgtttttgcgaggactacctatacatatataattattgtgtaatatcgcaaagtggatcggatgtcagtactgtactatgtttctaaataaaagaataaaattgttgttataagttgtac

SEQ ID NO: 19697 - protein, 349 aa, Panicum virgatum
  misc_feature: Ceres CLONE 1806484
  misc_feature (67)..(349): Pfam Name: p450 Pfam Description: Cytochrome P450
  misc_feature: SWISSPROT Homolog: EC 1.14.13.68 4-hydroxyphenylacetaldehyde oxime monooxygenase
MAQVLQQVRHAFHELLLLLPQASAVAVLVSILLIIILIEIVRRPSTAAATAARRRASIREELLSKLPSPPGRLPAIGHLHLVGSLPHVSLRDLAARHGRDGLLLLRLGAVPTLIVSSPRAAQAVLRTHDHVFASRASSPVTDILFYGSTDVAFAPYGEHWRQVRKIATTHLLTARKVRSYRRAREHEVRLVVARIREAAAGTGGAAVDLSELLNCFTNDVVCHAVSGKFFREEGRNRLFRELVEANSSLIGGFNVEDYFPALVKLEVVKRMVCAKARKVKGMWDELLEKLIDDHASRLPAAERDGGEESSDFIDVLLSVQQEYKLTRDHIKAQLAVNNNLIAIVVVITN

SEQ ID NO: 19698 - DNA, 1595 bp, Panicum virgatum
  misc_feature: Ceres CLONE 1806498
  misc_feature: Encodes the peptide sequence at SEQ ID NO. 19699
caacagctgaacaatggaggtcgctagcgagaagatggtcaacagggacgagatcacggacgccgcttagtccatgttcgccggcgactccaccgacatccccgagagttacatcaggacggacgaggtccttgccgccgaagtcgtcggtgaggacgaggcctacgagctgccggtcgtcgacatggccaagcttcttgaccctgattcctcggccatggagacggagaagctcggccatgcgtgccggcactggggtttctttcagctaaccaaccatggagtcgacgaagcagtggcgcagcttataaaggacaccaccgtgcagttcttcagcctgccactggacgtcaagaacagagtggcagtgccggaagaaagtgctggcattgaaggatatggccaccactacagcagggggcgaggtgacaaattggactgggccgagggcctgatcctcatcacgcagctagtccaagacaggaacatgaacatgtggctaggggtggtaaagggcccaatattttgaactagaaaatctaaggatcggaccctaaaagggtcgggctctaaacatatgtatttttgaactaaaaattttaagggttttattggactatgaagaggccattagggccatggcccattaccacccctacctgtggcccaccaacccgcccgcatttcggtctgctgtctccctgttcatcggatttcatgttcttttcctttgggcgtgtagattaattgtttcagttacatactcccaacccaattcaatcgcgtgatctgatgaggttgcttaaatacaatgttccttttggtttctagcgatgcgctcgccacgtactcaacggagatgacaaagctcgcgaggcggctgctgggattcatggcggccgacatcggagacgaggacgaggagctcgtcgacgccttcaccgggaagcggcagagcatggcgatgcactactacccgccgtgcccctgcccggacaaggtgctgggcatcacgccgcacaccgacgggctgggcctgacgctgctgctgcacctggacgacacgccaggcctgcagatcaagaaggacggcaggtggtaccccgtacggccactgccgggcgcctaactcgtcaacgtcggcgacatcctcgacgtcctgaccaacggcgcctaccggagcgtcgagcactgggtgatcccggacgcccggaggggccgcaccaccgtggtcttcgtggaggagggtacggtgggggggatggtcgcgccgctcccgggcctcctcaaggagcaggagccgcgctacaggtccatcgagctcgacgagtacgtcaagggcatcctcaaggcgatccccgaagggattcggttcgtggacactctcaaggtctagcaagagatgcgtacgtctgcctggagaatgtcgatggaaaacggcgaggggcttcgcgtccctgtctcgtgtccactgtccagtttagtattatgtgctcgtggaaaaataaaagcacctggggtcaggtgtgtactacatgaaccgtcttgtgtgtgtcaaagtttgcttgctgttgctatcacctaaacttcgttag

SEQ ID NO: 19699 - protein, 151 aa, Panicum virgatum
  misc_feature: Ceres CLONE 1806498
  misc_feature: SWISSPROT Homolog: EC 1.14.11.19 Leucocyanidin oxygenase
MFAGDSTDIPESYIRTDEVLAAEVVGEDEAYELPVVDMAKLLDPDSSAMETEKLGHACRHWGFFQLTNHGVDEAVAQLIKDTTVQFFSLPLDVKNRVAVPEESAGIEGYGHHYSRGRGDKLDWAEGLILITQLVQDRNMNMWLGVVKGPIF

SEQ ID NO: 19700 - DNA, 2066 bp, Panicum virgatum
  misc_feature: Ceres CLONE 1806503
  misc_feature: Encodes the peptide sequence at SEQ ID NO. 19701
gtcgcctcgcctcctatttccactcgctcgcctcacgcttcccacactggtacggcaatctagtctctagtcgccgcctcgccacgatcttccgcgcgcgcgcgcgagagagggagagagggagggagagagttgggagaggatgagttctgggcgcgggtccgcggcgccggagcgggacatcgacgacctgccgcggaacgacgccaactacacggcgctcacgccgctctggttcctggagcgcgccgcgctggcgcagccgggcagggcctccgtcgtgcacggccccgtgcgctacacctgggccgagacctaccgccggtgccgccgcctcgcgtccgccctcgcgcgccgatccgtcggtcctggaagcacggttgctgtaatagccccaaacatcccagcagtttatgaagctcattttggtgttccgatgtccggagctgttgtgaactgcgtcaatatcaggttaaatgccgagacaatcgcattccttcttgaccattctgtggcagaagttgtgatggtggaccaagaattcttcactctagctgaagaatccctgaagatactctccgagaagaagaaatctgctttccggcctccgatcctggtcgttatcggtgacccaacctgtgatccaaagtctctgcactatgctctaggaaagggagctatggagtatgaagagttcctgaaaactggtgacccagagttcaactggaagccaccaagggatgagtggcagagcatcgccctaggctacacttccgggactacttccagcccgaaaggcgtcgtgctgcatcaccgcggcgcctatctcatggcgctcagtgttgctatggtgtggggaatgcctgaaggtgctgtctacctgtggactctgcccatgttccactgcaatggttggtgctatacttgggcgttggcagcgttctgtggaacaagcatatgccttcgccaggtgagcacaaaagcgatataccatggcatcgcgaagcaaggagtgacgcacttctgcgctgcgccggtggtcctcaacaacctcatcaacgcccccgcgagcgagaccctcctgccgctcccgcgcgtcgtgaacgtcaacgtggccggcgccgccccgacgccgtccctgctcgccgcgctgtccatccgcggcttccgcgtcacgcacacgtacggcctgtcggagacgtacgggccctcgacggtgtgcgcgtggaggcccgagtgggacgagctgccgctggaggagcggtcccgcctgcactgccgccagggcatccgctacgtggcgctggaaggcctggacgtggtggaccccaagacgatggcgcccgtccccgccgacggcgagacctacggcgagatcgtgatgcggggcaacgccgtgatgaagggctacctgaagaaccccaaggcgaacgcggaggcgttcgcgggcgggtggtaccactcgggcgacctgggcgtgagacaccccgacgggtacatcgaggtgagggaccggatgaaggacgtgatcatctccggcggggagaacatcagcagcctggaggtggagaaggtggtgtgcgcgcacccggcggtgctggaggcgtcggtggtcgccagggccgacgagcggtggggggagtcgccgtgcgcgttcgtgacgctcaaggacggggccgccgccgacggcggctcggaggacaccgcgagcgacatcatgcgcttctgccgggagaggatgccggggtactgggtgcccaagtcggtcatcttcgggccgctgcccaagacggccacggggaagatcaagaagcacgagctgagggccagggccagggagctggggcctgtcaagaacagcaggatgtgaaccctgcctggtgcagagacatttgtacaggggcaaaagaagaaacggacggtgtcatcaatccagaaatttcacagataaagtgaagtagccgtcaaaatcttggaatttccaaataagcataagaagtttgggtgttctttattcagttgtatatatccttcagagattcagataagacctgtattttacagtc

SEQ ID NO: 19701 - protein, 575 aa, Panicum virgatum
  misc_feature: Ceres CLONE 1806503
  misc_feature (54)..(490): Pfam Name: AMP-binding Pfam Description: AMP-binding enzyme
  misc_feature: SWISSPROT Homolog: EC 6.2.1.26 o-succinylbenzoate--CoA ligase
MSSGRGSAAPERDIDDLPRNDANYTALTPLWFLERAALAQPGRASVVHGPVRYTWAETYRRCRRLASALARRSVGPGSTVAVIAPNIPAVYEAHFGVPMSGAVVNCVNIRLNAETIAFLLDHSVAEVVMVDQEFFTLAEESLKILSEKKKSAFRPPILVVIGDPTCDPKSLHYALGKGAMEYEEFLKTGDPEFNWKPPRDEWQSIALGYTSGTTSSPKGVVLHHRGAYLMALSVAMVWGMPEGAVYLWTLPMFHCNGWCYTWALAAFCGTSICLRQVSTKAIYHGIAKQGVTHFCAAPVVLNNLINAPASETLLPLPRVVNVNVAGAAPTPSLLAALSIRGFRVTHTYGLSETYGPSTVCAWRPEWDELPLEERSRLHCRQGIRYVALEGLDVVDPKTMAPVPADGETYGEIVMRGNAVMKGYLKNPKANAEAFAGGWYHSGDLGVRHPDGYIEVRDRMKDVIISGGENISSLEVEKVVCAHPAVLEASVVARADERWGESPCAFVTLKDGAAADGGSEDTASDIMRFCRERMPGYWVPKSVIFGPLPKTATGKIKKHELRARARELGPVKNSRM

SEQ ID NO: 19702 - DNA, 581 bp, Panicum virgatum
  misc_feature: Ceres CLONE 1806510
  misc_feature: Encodes the peptide sequence at SEQ ID NO. 19703
acctcgcgacagctatggccgccgcctccctgctccgctcgctcacccgacacgcgcgcggcgcttccgcttaccaccaccaccaccaaactcgggcgcccttctccaccgcggcggcggcgggtgcgcgggatgaggcgaggaaggggttccctgggctggggccgacggtgaagggggagaaggcgagggtggtggtgctggggaccggctgggcggggtcgcgcctcctcaaggacctcgacacgagcggctacgacgtcgtctgcgtcgccccgggcaaacacatggtgttcacgccgctgctcgcctccacctgcgtcggcacgctcgagttccgctccgtcgccgagcccgtcgcgcgcatccaggccgccgagtccaagtcgccgggctccttcttccgcctcgcccgctgcaccggcgtcaaccccgacgcccagaaggtgagatcccccgattctgggttggtgtgggtccctcgatcctaccaggcggtgtttactttcacacacgcgtgtgttcccggattctcggacaaattccccaagtgcatttatgctagtcttgtgcgtaattcg

SEQ ID NO: 19703 - protein, 188 aa, Panicum virgatum
  misc_feature: Ceres CLONE 1806510
  misc_feature: SWISSPROT Homolog: EC 1.6.5.3 NADH dehydrogenase (ubiquinone)
MAAASLLRSLTRHARGASAYHHHHQTRAPFSTAAAAGARDEARKGFPGLGPTVKGEKARVVVLGTGWAGSRLLKDLDTSGYDVVCVAPGKHMVFTPLLASTCVGTLEFRSVAEPVARIQAAESKSPGSFFRLARCTGVNPDAQKVRSPDSGLVWVPRSYQAVFTFTHACVPGFSDKFPKCIYASLVRN

SEQ ID NO: 19704 - DNA, 637 bp, Panicum virgatum
  misc_feature: Ceres CLONE 1806519
  misc_feature: Encodes the peptide sequence at SEQ ID NO. 19705
agacgaccgcttcctctccacagactactctcgcgcacgccaccgccgaccagcgccgccccagccgcctccgttcgcctggccgcgccgccgaggccgagcgcgcccgtcagtccagcttcccccggtgcttagccgcctcgaattccaatctaccagcagtagcctccctccccctccgctctatcgcgatggcgtcgagtggggatgcgcccggatctaccgatgagaagaaagccccaaaaccagaaggatcatccatcgagcgccaaggggttcctccagcaggcttttcgaatcctttcgactttgcttctatgcaaaatttgctcaatgatccatctattaaggagatggcagatcaaattgcaaaagatcctgcattcaaccagatggctgagcagctacagaaaagtgctcagagtacaggagaacagggaatgcctccattggaccctccacagtacatggaaacaatgcaaaaggtcatggaaaacccccagtttatgacattggctgagcgtctggggaatgctcttatgcaggatcctgctatgtccagtatgctgggaaacttttagtagtccatcacacaaggaggcagctggaagagcgtatgtcccgcatttaggaagat

SEQ ID NO: 19705 - protein, 129 aa, Panicum virgatum
  misc_feature: Ceres CLONE 1806519
  misc_feature: The sequence is a functional homolog of SEQ ID NO 1839 in the 10/374,780 US patent application
MASSGDAPGSTDEKKAPKPEGSSIERQGVPPAGFSNPFDFASMQNLLNDPSIKEMADQIAKDPAFNQMAEQLQKSAQSTGEQGMPPLDPPQYMETMQKVMENPQFMTLAERLGNALMQDPAMSSMLGNF

SEQ ID NO: 19706 - DNA, 658 bp, Panicum virgatum
  misc_feature: Ceres CLONE 1806519-R
  misc_feature: Encodes the peptide sequence at SEQ ID NO. 19707
gatgatgagggtctgaagaaggcactggatggtggagcagacaaggatgaagaagactccaagggaagaagagccttacattttgcatgtggatatggggagttgaagtgtgcccaagtccttcttgaggccggtgcagcagtggatgctttggataagaacaagaacaccccgctgcattacgctgctggctatgggcgcaaggagtgcgtcgatcttctcttgaagcatggtgctgccgtcacgctccaaaacctggatgggaagacgcccattgacgttgccaagctcaacaaccaggatgaggtcctcaagttgctcgagaaggacgccttcctttaaatcccatggctctcatagacacatagacagttggttccagtatggtcatgtttcacttctgttgactttgctttgctcggatggtcaatactcgtatcagcatttatctgttctgtaagatttgctatctggtctagctggctcttagcctgctgcaattcgtgatacagtgaagggggcagctattagaactactgccctgttatgttgtcacggtggcttgtgtacccctttctttatttccgttgttttcacgatagaaatcgggattgttaatattactctgttatatatgtttcatgccgacattgaagcc

SEQ ID NO: 19707 - protein, 113 aa, Panicum virgatum
  misc_feature: Ceres CLONE 1806519-R
  misc_feature (54)..(86): Pfam Name: Ank Pfam Description: Ankyrin repeat
  misc_feature (21)..(53): Pfam Name: Ank Pfam Description: Ankyrin repeat
  misc_feature: SWISSPROT Homolog: EC 2.4.2.30 NAD(+) ADP-ribosyltransferase
  misc_feature: The sequence is a functional homolog of SEQ ID NO 1839 in the 10/374,780 US patent application
DDEGLKKALDGGADKDEEDSKGRRALHFACGYGELKCAQVLLEAGAAVDALDKNKNTPLHYAAGYGRKECVDLLLKHGAAVTLQNLDGKTPIDVAKLNNQDEVLKLLEKDAFL

SEQ ID NO: 19708 - DNA, 515 bp, Panicum virgatum
  misc_feature: Ceres CLONE 1806538
  misc_feature: Encodes the peptide sequence at SEQ ID NO. 19709
cccgagacccgtgaggaggtagagcagagcagagggggagtagtcgtcgtctgcggcggcggcggcggcgcgaggtggagatggcggcgttctaggtgacgcggatctcgtagggcccggcgaaggcggcgtcagcgacccccgaggagacgctgccgctggcgtgggtggagcggtacccgacccaccggggcctggtggactcgatgcacaacttccggtcgggcgcggacgcggcggccggcgtgatccgggacgtgctgggcgaggcgctggccttcttctacccgctgggggggcgcgtcaaggagggcgcgaagaccgggtgccccgccatccactgcaccgccgacggcgtcgacttcgcggaggtctaggtagactgctgcctcggagacgtgtggttcctggagcgccctctgctgctggccgatgaggatctcgtcccctttctcgacgacgaccgctggggctttgagcctcttcatcttccgtcctgatgatgcagatcgcct

SEQ ID NO: 19709 - protein, 56 aa, Panicum virgatum
  misc_feature: Ceres CLONE 1806538
  misc_feature: Functional homolog of the protein sequence given in SEQ ID NO 50699
  misc_feature: Useful for making plants with altered carbohydrate content
MHNFRSGADAAAGVIRDVLGEALAFFYPLGGRVKEGAKTGCPAIHCTADGVDFAEV

SEQ ID NO: 19710 - DNA, 1879 bp, Panicum virgatum
  misc_feature: Ceres CLONE 1806541
  misc_feature: Encodes the peptide sequence at SEQ ID NO. 19711
accacggaagcctcctccgttcgagccgccaccgagctgatgacggccatggcgtcaacgacgagcgcgccggggaagcctcttctcgtcctcatctccctcgtcacgctgctcctcgtcttcgtctccaccgcggagacctacgacggccgccatgtggcggcgcgccgctccagcctggggatgacccggcacgtgcatcaccgacggaccgcgacgccgcaccggtacgtcctcgcggagaagagcaacacgacgggcgccggccccaggaaccgcagcgcgccggcgacctctccgacgccggcgcccccggccggaccgagcaagcaccaccgcagccacaagcaccgcgtccgcaactggatcatcggcttcgtcgtcgggtccgtcgccggcgtcatctcggggctggtgctgtcgatactgttccgcctcgcgctcaactacttcagggggcggtacaggacgcggtccggcacggtgatcttcaccccgaagctgatcaggcgcgccgagcacctggcgttcctggagaaggacgacgggctggcgtcgctggccgtgatcgggcgcggcgggtgcggcgaggtgtacaaggcgcagctccccgtggagcgggagggggaggagccccggttcatcgccatcaagaagatcaagaagcacggcggcgacacgcccaacaacctgagcgacgaggagagccggcagctggacaagtggtcgcggcagatccagtcggagatcaggacggtgggccacatccggcaccgcaacctcctgccgctggcggcgcacgtcccccgccccgactgccactacctggtgtacgagtacatgaagaacggcagcctgcaccacgcgctccagggcggcggcggcggcggggacgacggcaccagcagcagcagcggtggcgccgccgcggggctgtcgtggcctgctcgtctccgcgtggcggtgggcgtcgccgagggcctcgagtacctccacgtctcgcaccggccgcagatcatccaccgcgacctgaagccggccaacatcctcctcgacgacgacctggagccgcgcatcgccgacttcgggctggccaaggcgatgcccgacgcgcacacgcacgtgacggcgtcgaacctcgccggcacgtgggggtacatcgcgccggagtaccaccagacgctcaagttcacggccaagtgcgacgtgtacagcttcggggtgatcctggcggtgctggcgacggggaaggagccgtcggacgacttcttcaagcagacggacgaggtgggcatcgtcaagtggctccgccgcgtgatgcagtcgggcgaccacgccgaggccatcgacccggccatcgccggcgccgggcacgacgaacagatcgtgctggtgctgcgcatctccgtcttctgcaccaacgaccaccccaacgaccggcccaccgccaaggacgtccgctgcatgctgtcgcagatcaagaactagtccaaattattaggaccagcaataattcagtgcatctgtgcctgtgcgtggaacattgaagtgctgggtcaaagtcgtcgcgtcaactttcaggtggggccggcagactaggaccggccgtttaaagcacgatacgtagttttcttgggcatttaaagcacgctgatagttcaggaatataatcgggacaaagaaaattctgaaagggaagtcagcgcacgcgctggacaggaaccgggtatattttgcttttctttctcttagcaccagtagtgtgaaagctcgaggagactagagctttagaatggataaacatacttcaatattctcacgtggtcccgtgtatctttgtatcatatgttccaacaatctatcatataatatatagcac

SEQ ID NO: 19711 - protein, 479 aa, Panicum virgatum
  misc_feature: Ceres CLONE 1806541
  misc_feature (168)..(474): Pfam Name: Pkinase Pfam Description: Protein kinase domain
  misc_feature: SWISSPROT Homolog: EC 2.7.11.1 Non-specific serine/threonine protein kinase
MASTTSAPGKPLLVLISLVTLLLVFVSTAETYDGRHVAARRSSLGMTRHVHHRRTATPHRYVLAEKSNTTGAGPRNRSAPATSPTPAPPAGPSKHHRSHKHRVRNWIIGFVVGSVAGVISGLVLSILFRLALNYFRGRYRTRSGTVIFTPKLIRRAEHLAFLEKDDGLASLAVIGRGGCGEVYKAQLPVEREGEEPRFIAIKKIKKHGGDTPNNLSDEESRQLDKWSRQIQSEIRTVGHIRHRNLLPLAAHVPRPDCHYLVYEYMKNGSLHHALQGGGGGGDDGTSSSSGGAAAGLSWPARLRVAVGVAEGLEYLHVSHRPQIIHRDLKPANILLDDDLEPRIADFGLAKAMPDAHTHVTASNLAGTWGYIAPEYHQTLKFTAKCDVYSFGVILAVLATGKEPSDDFFKQTDEVGIVKWLRRVMQSGDHAEAIDPAIAGAGHDEQIVLVLRISVFCTNDHPNDRPTAKDVRCMLSQIKN

SEQ ID NO: 19712 - DNA, 3206 bp, Panicum virgatum
  misc_feature: Ceres CLONE 1806558
  misc_feature: Encodes the peptide sequence at SEQ ID NO. 19713
gaaaaagaaaaatataatccatccctgccccttagggcgggcggctgcctctccgccggtccgccctaaaaccccgccgccgacgaaataaaaccacccccctctgcgagcacgcgagccatgccgcaggtgcccgcccctctccgcctcctcctccccctctcccaaaccctagccccctgccccctcctccacctctcgcgccgcctcttcacctcctcctccttcgggcgcgccgccagcctccgcgccctcgcctaccgccgccaccacccgccccgccgcgggaatagcacgctccggaaggcgcccaaggaggagatggctggaggaggggataaggaggtggccttcaacaggaagcgggcggaggggagggacgtcgggaagcgcgggagcatggagctgaaggcccgcaagctcaaccccgtcaacaccacctgctacgtgcagatacttggtacagggatggacacccaggacacttcaccttctattttactcttctttgacaagcaaaggtttatatttaatgcaggcgagggtcttcaacgtttctgtactgaacacaagataaagttatcaaagattgaccatatctttttaactcgggtgtgctcagaaactgcagggggccttccaggcctggtgctaaccctggcaggcataggagatgagggcatgtcggtgaacatatggggcccttctgatcttgactttctagccggggcaatgagatcttttataccaaatagagcaatgcttcacacacatagctttggtgctgaatggaatgcatcttcttcacaacctaaagactctgttgttattcttaatgatgaagtagttaggatatcagcaatgtttgtcaaaccaaggtacccaaatggagctggtagcttgaatgatatcgacatgaaaccaggtgatactgctatagtctatgtgtgtgaattgccagaaattaagggaaagtttgaccctgctaaggctgctgcccttggtctgaggcctgggcccaagtatcgagaacttcaacttgggaactctgtgcagtctgatcagttcgacgaaatggttcatccaagtgatgttcttggcccgtcaattcctggaccagctgttcttctggtggattgccctacacaatatcatatgccagaacttttctcactgcaatcccttagctgcttttatgaagactcttcgaaccaaagagagagtggcaagaaagtaaattgcataatccacttaggtccatcctccgttactaaatctgttgactatcagaactggatgaaaagatttggtgaaacacagcatatcatggcaggacatgaaattaaaaacatggaaattccaatcttgaaaggtagtgcaagaatatcatcgcgcctcaattttgtatgccctcagctattcccatcctctgggttttggtctgttaaacctgcaaatgatgtcatggagaatgataagagtacttcattggaagcctgtggaattgtgtctgcgcaaaatctgctcaagtttcatctgcgtccatatgctcaactggggttggatagtgcttctattccaagttcgttcacgtacaaggatattgtaaaagagcttgtatctgagatcccagaggttagggaagttcctgaacaggttctcaaattctggcaaaataatgcaaacgtcaaaaatatacaaccagcaggcagtcttatgctgatggttgaagagacatggatcggtcagaaatcagctaagctagatggtagcccaaagcatccacgggacaatcaggagatcccttgctgtgtggaggatgcatcaagggaagatatggagattacatttttgggtacaggttcatctcagccttcaaaatatcggaatgtaggttctgtatatattaacttgtatgctcaaggaggtatacttcttgattgtggtgaaggaactttaggacaactaaagaggaggttcggtgtaaatggtgctgatgaagctgtaaaaaatttgaggtgtatttggatttcgcatattcatgctgatcaccacacagggttagctagagttcttgctctaaggtctaaattgttaaaagggatgcctcataaacccttgcttgtgattggaccaagaccacttgagagattcctgagtgcttattcaactcttgaagatcttgacatgcaattcctagactgcaggaatactctgaagcctagcgtcaaggcttttctcagtgaaaatgttactggatcagccacacctcaactagagaacaccatgtttgcccctggaagtagaatggagaactacaacaggaagcctgcaagtcccagggataccacagctcttgctaattttaaagaagttctgcaggaatcaggcttggagattctgtgcagtgtccccgtagtacactgtccacaggcatttggtgttgtgttgagagccacagagaaggtgaacagtgctggaaaggttattccaggctggaaagttgtatattctggtgacacacgaccctgtccagctcttatagatgcatccagagatgcgacagtgctaatacacgaggcaacatttgaggacagtatgaagaacgaagcaatcgcgaggaaccatagcacaacaaaggaggcaatagaagtaggcacatcagctggagcataccggatcattttgacccacttcagccagcgatacccaaaaatcccagttattgatgaggttgacatggagaagacgtgcattgcctttgacctgatgagcgtaaaccttgcggatttgcctgtcttgcccaaggtcctgccacacctgaaggtcctattcaaggacgagatggtagttgaggaggctgatgagatccaagaggctgctgtgtactgatagataaaagaatgcacattagttttgatcaccgtactatagcttttaacattgtttctttgacctgagaatccaattgaagaccgcctagccatgggaggacgggaatgcgaaggaataaactaagggttgggaagccgaccaccgccaagccaggaactgcatctgcaggaagttcctgtttcgcgcgtccatctggtgcagaatagaatagagctgtacattttcttctccttcgcaattgtttgcaagtgctgtgaattggataataaatataaacgtgtagctattttttgcgactgcgcctgagcagc

SEQ ID NO: 19713 - protein, 856 aa, Panicum virgatum
  misc_feature: Ceres CLONE 1806558
  misc_feature (523)..(769): Pfam Name: Lactamase_B Pfam Description: Metallo-beta-lactamase superfamily
  misc_feature: SWISSPROT Homolog: EC 3.1.26.11 Ribonuclease Z
MAGGGDKEVAFNRKRAEGRDVGKRGSMELKARKLNPVNTTCYVQILGTGMDTQDTSPSILLFFDKQRFIFNAGEGLQRFCTEHKIKLSKIDHIFLTRVCSETAGGLPGLVLTLAGIGDEGMSVNIWGPSDLDFLAGAMRSFIPNRAMLHTHSFGAEWNASSSQPKDSVVILNDEVVRISAMFVKPRYPNGAGSLNDIDMKPGDTAIVYVCELPEIKGKFDPAKAAALGLRPGPKYRELQLGNSVQSDQFDEMVHPSDVLGPSIPGPAVLLVDCPTQYHMPELFSLQSLSCFYEDSSNQRESGKKVNCIIHLGPSSVTKSVDYQNWMKRFGETQHIMAGHEIKNMEIPILKGSARISSRLNFVCPQLFPSSGFWSVKPANDVMENDKSTSLEACGIVSAQNLLKFHLRPYAQLGLDSASIPSSFTYKDIVKELVSEIPEVREVPEQVLKFWQNNANVKNIQPAGSLMLMVEETWIGQKSAKLDGSPKHPRDNQEIPCCVEDASREDMEITFLGTGSSQPSKYRNVGSVYINLYAQGGILLDCGEGTLGQLKRRFGVNGADEAVKNLRCIWISHIHADHHTGLARVLALRSKLLKGMPHKPLLVIGPRPLERFLSAYSTLEDLDMQFLDCRNTLKPSVKAFLSENVTGSATPQLENTMFAPGSRMENYNRKPASPRDTTALANFKEVLQESGLEILCSVPVVHCPQAFGVVLRATEKVNSAGKVIPGWKVVYSGDTRPCPALIDASRDATVLIHEATFEDSMKNEAIARNHSTTKEAIEVGTSAGAYRIILTHFSQRYPKIPVIDEVDMEKTCIAFDLMSVNLADLPVLPKVLPHLKVLFKDEMVVEEADEIQEAAVY

SEQ ID NO: 19714 - DNA, 2144 bp, Panicum virgatum
  misc_feature: Ceres CLONE 1806567
  misc_feature: Encodes the peptide sequence at SEQ ID NO. 19715
ctcttccacacaacaccaagaaccttctcctccatctccttctccatatatgtgtatatatccatcgaccgcatgagctctcggagctagctggagaggaagagaggagagaaggggtgcgaaccgcccgcgcgcgatcaggatagagacgcgcgtcggaaggtagacagcgggcgatggaggcgagctcggcggcgtcgccggacctctcgctccacatcagcctgccgagcagcgcgccggggtccgggccgtccggcgggcgcgccacggtagggggagcaggcggcggaggcggtggaggcgcggggggagacccgtggcggaggttgaacgggtcgacggcgtccacggagctgtcgctgtcgccgccagccgagcaggagcgcgcggacgcgctgccctggcggcaccgcccgtcggcggcgggcgcgccgccctccgcggcaaccacctcggcgggcgcggcgctgatgcccactatgccgatgctgcagccgctcgacggcggaggcgcgtcggcggcggcgccaatccggggaatacctatctacaacggcccgggaggattcccgttcctgccgccggccgccggcggagacggcggccaccaccagaagctcgggttctacggctcctaccacccggccacgtggccttcctcgctgggctccacgtcgccgtcgccgggtgcgccgccgccggcccctcaggacccggcgtcggctttcctctcccccgccgcgcaccaccatcaccggatgctgtcggcgtcgggcagcctgaacggcatgctctccgacaccctccgcggctacggcggcggtggcggcggcctgggcggcatcggcgggcaccaccaccaccacctccacggcgcgcagcccttcggcctgggctcccggttcatgcccaagctccccgccaagcgcagcatgcgcgcgccgcgcatgcggtggacgagcaccctccacgcccgcttcgtccacgccgtcgagctcctcggcggccacgagagggcgacgcccaaatcagtgcttgagctcatggacgtgaaggatctgaccctagcgcacgtcaaaagccatctccagatgtatcggaccgtcaagagcactgacaagcctgcggcgtcatcagggccgaacgacggcggctccggcgacgaggacttccccggcgccggccaggccgcgtccggcggcgacaacatgtgcggcagcggcgcgaggccgttcggcgagcaccaccggtccacatccgagggcgccgcgagctcggtgggcggcggcggcggcgacatggaccagtcctcggccgggaacacgagcaccaggtggagcaactcgtcaagggacccatggctgtcgtcgaattcatgcaacatggacgctcaccgcttggcaggactgtcttctccaattgagaatgcagagccttgccgatcgagcagctcgcaggtatccaaccacgagctgagcagcccgagcctggagttcacgctcgggagaccggactggcagggtgcggatcatgactagccagtagccaccatcatcgccaagctcacaagaacctagaaggctaatttcttcattgagagatatatatacaggtagcagtactgatatcatgcttgctagcttgatcgtccccaagctccgcgacaacgacaagttttcgtcagggaagaaagaagaaacgcaagcagcagcagcagcagcagcagcatttttaccgtaccggtccggagatggagtccgggagcaccgggaattttaaagactttaccggcgggtctctctcagcctttgggtggttccttagattgcccatgttcctgatttccttttctttcttgcttctctctttttgtttccttgtgcctgccgtggcgacccgagcggccacgatgctggccgcgcagggatagtagtagcagatgacggtgatggccagagccgatggagccgtgtgcgtttgtccatgtttggtgaggttgacgttggcctggtggtgtgcgcgtgtgtgtgtgtggagctagctagctagcgtatcattagcacatggaaagttggaaaggagaaaagaaagaaaagggaatgagttatcatgaagcaatctaactgaaggtgaagatttcg

SEQ ID NO: 19715 - protein, 454 aa, Panicum virgatum
  misc_feature: Ceres CLONE 1806567
  misc_feature (258)..(309): Pfam Name: Myb_DNA-binding Pfam Description: Myb-like DNA-binding domain
  misc_feature: The sequence is a functional homolog of SEQ ID NO 1339 in the 10/374,780 US patent application
  misc_feature: Functional homolog of the protein sequence given in SEQ ID NO 50660
  misc_feature: Useful for making plants with altered alkaloid content
  misc_feature: Useful for making plants with altered lignin content
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MEASSAASPDLSLHISLPSSAPGSGPSGGRATVGGAGGGGGGGAGGDPWRRLNGSTASTELSLSPPAEQERADALPWRHRPSAAGAPPSAATTSAGAALMPTMPMLQPLDGGGASAAAPIRGIPIYNGPGGFPFLPPAAGGDGGHHQKLGFYGSYHPATWPSSLGSTSPSPGAPPPAPQDPASAFLSPAAHHHHRMLSASGSLNGMLSDTLRGYGGGGGGLGGIGGHHHHHLHGAQPFGLGSRFMPKLPAKRSMRAPRMRWTSTLHARFVHAVELLGGHERATPKSVLELMDVKDLTLAHVKSHLQMYRTVKSTDKPAASSGPNDGGSGDEDFPGAGQAASGGDNMCGSGARPFGEHHRSTSEGAASSVGGGGGDMDQSSAGNTSTRWSNSSRDPWLSSNSCNMDAHRLAGLSSPIENAEPCRSSSSQVSNHELSSPSLEFTLGRPDWQGADHD

SEQ ID NO: 19716 - DNA, 2075 bp, Panicum virgatum
  misc_feature: Ceres CLONE 1806579
  misc_feature: Encodes the peptide sequence at SEQ ID NO. 19717
acacatgagcacaaaactaatgccttcctttgtaagtgaggcagcaaacaataagctcctctggcccccaagacgcgctctcttctctttgtccatttccaattactccagccgcatgcatgctctgccctctgtcgtagcttgatacttttatattcgaggacaaaagtctgcagtgtacgaggtgttcgagcggatggcgttctacggcatctcgtcgaacctggtgctgtacctgacgacgaagctgcaccagggcgtggtgccgtcggcgaacaacgtcaccaactgggtgggcaccatctggatgacgcccgtcatcggcgcctacgtcgctgacgcgcacctcggccgctaccgcaccttcatggccgcctccgtcatctacctctgcggcatgatcctgctgacgctggcggtgtcgctgccggcgctgcggccgcccaagtgcggcgacggcacggcggaccccaagtgcacgcacgaggcgacgagcgtgcagctgggcgtcttcttcctgggcctgtacatcctggccgtgggcacgggcggcaccaagcccaacatctccaccatcggcgccgaccagttcgacgacagccacccgcgggagcgccgccacaagctctccttcttcaactggtggatgttcagcatcttcttcggcacgctctttgccaacacggtgctcgtctacatccaggacaacgtcggctggtccgtcgggtacgcgctccccacgctgggcctcgccgtctccatcgccatattcaccgccggcacgccattctaccgccacaagcccacctccgagagccccttcgccaagatggccagggtcatcatcgcggccgccaggaagtgcgccgtcgcggcgcccgtggacccgcgcgacctgcacgagctcgacgacgcgcactacgccaagcgcaaggccgcccggctcccgcacacgcccaacctggccgtgctgagcaaggcggcggtgaagacgacgacgacgggcggcgcgtcgccgtggtcgctgagcacggtgacgcaggtggaggagacgaagcagatgctcaagatgctcccggtgctggccaccacgttcgtgcccagcgcgatgctcgcgcagatcaacacgatgttcgtgaagcagggcacgacgctggaccggcgcgtcggccaccacttcgagatcccgccggcgagcctccaggggttcgtgaccatctccatgctggtgtccgtggtgctgtacgaccgcgccttcatgcccctggcgcggcgcgcgacggggaacccgcgcggcatctcgctgctccagcgcatgggcgtcgggctggccatccacatcgccatcatgggcatcgcgtcggcgacggagcggcaccggctggcggtggcgcgggagcacggggtgctcgacagcaggggccccggcgccaccatcccgctcaccatcttcgtgctgctcccgcagttcgtgctcatgggcgtggccgacgcgttcctggaggtggccaagatcgagttcttctacgaccaggcgcccgagggcatgaagagcctgggcacgtcctacgccatgaccagcctcggcgtcggcaacttcctcagcagcgcgctgctgtccaccgtgtcgcgcgtcacgcagcgccacggccgggccggctgggtgctcaacaacctcaacgcgtcgcggctcgacaagtactacgccttcttcgccgtcctcaactgcgccaacctcctcgtcttcttcgtcgtgtgccggctctacgtctacaacgccgaggtctcccgcgtcgtcgacgccggcagcaacgccgccggggaggcggagaagaattcgaaccgggaggtcgggttgcagccggcaaacgtcggcgccgtggagtccaccatgtagggagggactgttagttgtttagttccatatatcactacacaaatgtacttcccaacttccccgtgcacatcatgtcgcgtaatctcagtcagtacgggacagcagaaaaacgccaatccggttcaagttcaggactaacagctgaatgaactccgtatcctgtcatgtggcttagagc

SEQ ID NO: 19717 - protein, 566 aa, Panicum virgatum
  misc_feature: Ceres CLONE 1806579
  misc_feature (54)..(463): Pfam Name: PTR2 Pfam Description: POT family
MAFYGISSNLVLYLTTKLHQGVVPSANNVTNWVGTIWMTPVIGAYVADAHLGRYRTFMAASVIYLCGMILLTLAVSLPALRPPKCGDGTADPKCTHEATSVQLGVFFLGLYILAVGTGGTKPNISTIGADQFDDSHPRERRHKLSFFNWWMFSIFFGTLFANTVLVYIQDNVGWSVGYALPTLGLAVSIAIFTAGTPFYRHKPTSESPFAKMARVIIAAARKCAVAAPVDPRDLHELDDAHYAKRKAARLPHTPNLAVLSKAAVKTTTTGGASPWSLSTVTQVEETKQMLKMLPVLATTFVPSAMLAQINTMFVKQGTTLDRRVGHHFEIPPASLQGFVTISMLVSVVLYDRAFMPLARRATGNPRGISLLQRMGVGLAIHIAIMGIASATERHRLAVAREHGVLDSRGPGATIPLTIFVLLPQFVLMGVADAFLEVAKIEFFYDQAPEGMKSLGTSYAMTSLGVGNFLSSALLSTVSRVTQRHGRAGWVLNNLNASRLDKYYAFFAVLNCANLLVFFVVCRLYVYNAEVSRVVDAGSNAAGEAEKNSNREVGLQPANVGAVESTM

SEQ ID NO: 19718 - DNA, 635 bp, Panicum virgatum
  misc_feature: Ceres CLONE 1806581
  misc_feature: Encodes the peptide sequence at SEQ ID NO. 19719
gcatttggacctccgcctccttcctcccctcctcttcactctcccttgcatcaccaacaagaaggctaacgcacaccaacccaagagcaaggaggggagagaaggaagaaaaaaaaaaggaattttgatcgcccagagtgtggtagtagaatagcaatttgatctctccttgttcgaggtcagtgcgcgaggcaataatggtggccgtggaggctgcggcggcggcggtggagggcccgatccgggcggaggccgaggtggaggtgaagggcgatgccccggccgtgggggaggccggggaggaggaggaggagaaggagtacaagagcgacatgaggaagctggaggagctcatgtccaagctcaacccctgcgcgcaggagttcgtgccgtcgtcgcgccgcgccgcggcgccggcggtgaagccggcggggggaggcgtgctctccgccgacgcgccggtgttcgtgtccgctgccgagtactacggcgctgccggcgggcacctgcaggtggccggtggcggcgctgccggcggtgggagcagggactccagcagcgacggatccagcaacggcagcggccaccctctgaatcgccggagaaggaacagcttcaaccaggggaggcggagg

SEQ ID NO: 19719 - protein, 145 aa, Panicum virgatum
  misc_feature: Ceres CLONE 1806581
  misc_feature (51)..(68): Pfam Name: PAM2 Pfam Description: Ataxin-2 C-terminal region
MVAVEAAAAAVEGPIRAEAEVEVKGDAPAVGEAGEEEEEKEYKSDMRKLEELMSKLNPCAQEFVPSSRRAAAPAVKPAGGGVLSADAPVFVSAAEYYGAAGGHLQVAGGGAAGGGSRDSSSDGSSNGSGHPLNRRRRNSFNQGRR

SEQ ID NO: 19720 - DNA, 705 bp, Panicum virgatum
  misc_feature: Ceres CLONE 1806586
  misc_feature: Encodes the peptide sequence at SEQ ID NO. 19721
gtcccatcgcccgccccctctcctctgtctccgtctcgcctcgtctcgcctcgaccccagaggcccagacgcatcaaaccggtctcctcctgtctcccctcgcaaccccaaagaagccgcactcgcaaaggcagcaaacgcgccgcgcaccggaagatcccagagagcggcacgaggggccccccattgcggcatggctgctgtggccgccggcgctggcgtcgggctccagctcattggcgcagccgcggccacgctcctagcggcggtccttgttgccgccgtgcttgggcgccgccgccggccgctggcccgggcgcctctggtggaagggaagcccgcgccggaggatggctgcgcggtcggcgacggcaagggcgccgccggtgacggtgggacggatgtcatcatcgttggcgctggagtagctgggtctgcgctggcatatacgctcggaaaggatggccgtcgggtacatgttattgagagagatttgacagaacctgacagaattgtgggtgaactgttgcaacctgggggttacttgaaattaattgagttgggtctcgaagattgtgtggaagaaattgatgcccaacgtgtccttggttatgctttattcaaagatgggaggaacacaaagctcgcttaccccctggagaaattccattccgaatgtgctggtaggagctttcacaatggaag

SEQ ID NO: 19721 - protein, 170 aa, Panicum virgatum
  misc_feature: Ceres CLONE 1806586
  misc_feature: SWISSPROT Homolog: EC 1.14.99.7 Squalene monooxygenase
MAAVAAGAGVGLQLIGAAAATLLAAVLVAAVLGRRRRPLARAPLVEGKPAPEDGCAVGDGKGAAGDGGTDVIIVGAGVAGSALAYTLGKDGRRVHVIERDLTEPDRIVGELLQPGGYLKLIELGLEDCVEEIDAQRVLGYALFKDGRNTKLAYPLEKFHSECAGRSFHNG

SEQ ID NO: 19722 - DNA, 654 bp, Panicum virgatum
  misc_feature: Ceres CLONE 1806586-R
  misc_feature: Encodes the peptide sequence at SEQ ID NO. 19723
cgcattttccccgtgcaaataccttgaatcattctatacattgcggaagccggttgcttcaacgataaacacattggctggtgctctgtataaggtcttcagtgcctcgcctgatcaagctaggaatgagatgcgccaagcttgctttgattacttgagccttggaggtgtcttctcaaatgggcctattgctctactgtctggtcttaatcctcggccattgagtttagttgcccacttctttgctgttgctatctatggtgttggccgactgatgctccctcttccttcacctaaacgaatgtggattggagccaggctgatttctggtgcatgtggcatcatcctccctatcatcaaagctgaaggtgtgagacaaatgttcttccctgctaccgtgcctgcatactaccgggctgctcctgctgcagagtaaactggaactaggaaccgactctttgctgctgatctgatggcaactgctgtttcacggatggcatttttccagcgttagtggtcgttcgtcgtcattagccggttgtactgattcgggttggaaatgtgttgggtttcttctgtacgcatgtcgattcctgcaagttgtatatgattctgttgaactagtgaagtgaatacgtcgtcgtctttcacgcc

SEQ ID NO: 19723 - protein, 144 aa, Panicum virgatum
  misc_feature: Ceres CLONE 1806586-R
  misc_feature (1)..(102): Pfam Name: SE Pfam Description: Squalene epoxidase
  misc_feature: SWISSPROT Homolog: EC 1.14.99.7 Squalene monooxygenase
  misc_feature: Functional homolog of the protein sequence given in SEQ ID NO 50878
  misc_feature: Useful for making plants with altered cell wall content and/or composition
AFSPCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPAAE

SEQ ID NO: 19724 - DNA, 1944 bp, Panicum virgatum
  misc_feature: Ceres CLONE 1806597
  misc_feature: Encodes the peptide sequence at SEQ ID NO. 19725
gataaacgccgcacggctcctctccgtctccggtctccgcgacgcgagcgctcctctcctctcgtcgcacccgtatccggcgccgccccacctcgtcgcccagagtcccagcccgcctcccgggcgggagctcctcgccggggtcgtggcctcgggcctcccctcatctccctccctcagctagaaaatatggacggaccagtagagaactttgtgggacatgatgttggcgggatgcctggaaatccttacgatggagaacaaccaaacccatatgaggatgtggaactggagaagcagtacggtgaagagctgggaaacacatatgccgaacaacctggtgcccagtacaatgatgggtctgggaatctgtacaatgaagagcagggaaacttgtacagcaaggaaaccgggaatcagtacaatgagaagccggcaaattcttaccaggaagagctggagaatgcatacactggggacaggagtcagcaggacaattcacagattaatgttgaggataacagatggcctggttggccaggagagagtgtttttcgtatactggttccagcccagaaggtaggggctatcattggccgcaaaggggagtttatcaaaaagatgtgtgaggagtccaaagcgcgcatcaaaatacttgatggcccacctggtgtaccagaaagagcagtaatgatttcagcaaaggatgaaccagatgcaccggtatctccagctatggatggcttacttagagttcataaaagaataactgatagttcagatggtgaatctggtcagcctcaacgaagtgctggtaatatcggaccgacacgacttctagtgccagcatcgcaagctggcagccttattggaaagcagggagcaactattaaatccatacaggattcttcaaagtgtgctgtacgtattgttgagaatgttcctcctgtcgcattaaatgatgacagagttgtggagatacaaggcgagtctcttggtgtccacaaagcagtggaattaatagcaagtcacttaagaaagtttcttgtcgaccgcagtgttcttccactatttgaaacacatatgaaaatgcacagtatgcagagggagcaaccaatgccacctccccagcactgggggcctcctcaaccctggggccctcctccaaacctacctccaggtggtccaggttttggtggaaattcgcaattcatgcctccaaggccgcaagacagttattatcctcctcctgatgtcccccctgtgcctgtggaaaagcagccacactatggtatttctgcatatggacgtgaggccccaccaagcggtgttcctgctgcaggaaatcaaccacgctctcatgcaggttctcaggtgacacataacatgcacattccccttgcctacgctgatgctgtgattggggcagctggtgctagtatcagctatatccgtaggcacagtggcgcaactgtaactattcaagaaagcagaggcgcacctggagagatgactgtggagataattgggactgcatcccaagttcaaaccgcccaacaactggtccagaatttcatggcagaagctgctcccccaggcccaccaccagcttctaaccctccagcaccgccagtagatccgagctacgcatcttacccaccaccatatggaggtgctccgtcctatggttcttcagctgccgctgggccgcctccgcagtacaacggagggagctatggtggcccgacctaccctcccagctatggttattagggagtagcagtaagctaagggtttgatttctctcttgtgttatggtaaggaatttgttgccgaataatgacaatgcagtgctgcatgccctcctgttaccttgtgtctgacaaagactaattacattggagacacgtttatgtggtgcatgattgattagtattctggggt

SEQ ID NO: 19725 - protein, 527 aa, Panicum virgatum
  misc_feature: Ceres CLONE 1806597
  misc_feature (213)..(278): Pfam Name: KH_1 Pfam Description: KH domain
  misc_feature (397)..(459): Pfam Name: KH_1 Pfam Description: KH domain
  misc_feature (121)..(186): Pfam Name: KH_1 Pfam Description: KH domain
  misc_feature: Functional homolog of the protein sequence given in SEQ ID NO 50722
  misc_feature: Useful for making plants with modulated flowering time
MDGPVENFVGHDVGGMPGNPYDGEQPNPYEDVELEKQYGEELGNTYAEQPGAQYNDGSGNLYNEEQGNLYSKETGNQYNEKPANSYQEELENAYTGDRSQQDNSQINVEDNRWPGWPGESVFRILVPAQKVGAIIGRKGEFIKKMCEESKARIKILDGPPGVPERAVMISAKDEPDAPVSPAMDGLLRVHKRITDSSDGESGQPQRSAGNIGPTRLLVPASQAGSLIGKQGATIKSIQDSSKCAVRIVENVPPVALNDDRVVEIQGESLGVHKAVELIASHLRKFLVDRSVLPLFETHMKMHSMQREQPMPPPQHWGPPQPWGPPPNLPPGGPGFGGNSQFMPPRPQDSYYPPPDVPPVPVEKQPHYGISAYGREAPPSGVPAAGNQPRSHAGSQVTHNMHIPLAYADAVIGAAGASISYIRRHSGATVTIQESRGAPGEMTVEIIGTASQVQTAQQLVQNFMAEAAPPGPPPASNPPAPPVDPSYASYPPPYGGAPSYGSSAAAGPPPQYNGGSYGGPTYPPSYGY

SEQ ID NO: 19726 - DNA, 701 bp, Panicum virgatum
  misc_feature: Ceres CLONE 1806609
  misc_feature: Encodes the peptide sequence at SEQ ID NO. 19727
atcttctcttcatctgtgagtagtcactagtcagcggagcaggagaagatgtctccttacgtgcttgccgccgtcggcgccgtgcttatcgtcttcctctatgtcgtcgagaaccgccggcgcggtaagctcccgccgtctcccccgccgctgccgctgattggccacctccacctcatcggccgcctcgcgcaccgctccttgtacgacttgcaacttcgatacggcggcggcggcggcctcctcttcctgcagctcgggcgcaggcggacgctggtcgtgtccacggccgcggccgccgcggacctgttcaggaaccacgacctcgccttcgcctcccgcccgcgcagcgtggcagcggagaagctgtcgtacggctgcctcaacgtgtcgttcgcgccgtacggcgagaactggcgccggaccaagaagatcgccgtggtccacctcctctccccgcgccgcgtggagtcgttcgcgcccgtgcgcgccgccgaggtggccgcgctcgtcgcccggacccgccgcgccgcggaggcgggggaggccgtggagctgagggagctcctgtacggctacgcgaacgcggtgatcacccgcgcggcgaccggtgccgccggggcaacagccgagaagatgaagcagctgatggggaactccgaggcgctgatggcgggcttccagccggaggacgtgctgcc

SEQ ID NO: 19727 - protein, 217 aa, Panicum virgatum
  misc_feature: Ceres CLONE 1806609
  misc_feature: SWISSPROT Homolog: EC 1.14.13.68 4-hydroxyphenylacetaldehyde oxime monooxygenase
MSPYVLAAVGAVLIVFLYVVENRRRGKLPPSPPPLPLIGHLHLIGRLAHRSLYDLQLRYGGGGGLLFLQLGRRRTLVVSTAAAAADLFRNHDLAFASRPRSVAAEKLSYGCLNVSFAPYGENWRRTKKIAVVHLLSPRRVESFAPVRAAEVAALVARTRRAAEAGEAVELRELLYGYANAVITRAATGAAGATAEKMKQLMGNSEALMAGFQPEDVL

SEQ ID NO: 19728 - DNA, 657 bp, Panicum virgatum
  misc_feature: Ceres CLONE 1806609-R
  misc_feature: Encodes the peptide sequence at SEQ ID NO. 19729
caggctggagtacctgaaggcgggttcaaagaggtgctccggctccacgcgccggcgccgctcctcgtcccgcacgaatcgacgacgccggcggtcgtgcaggggtacgagatcccggccaagaccgcgatcttcatcaacgcgtgggcgatcgggcgggaccccgcggcgtgggacgcgccggaggagttccggccggagcggttcgtgggcggcggcccccccgcggacttcagagggaccgagtaccagctcatcccgttcggcgccgcccggaggatctgccccggcatcaacttcgcgctgccggtcttggagctcgcgctcgccagcctcctgcgccacttcgactgggagctccccggcggcatgcgcccggcggacctcgatatgggcgaggcgccggggctgacgacgccgcggcgggttccccttgtcctagtccccaagaccaagacgctcgcctagccatcactctagtaggaatcggtgtgctgccaccagcaccaaatcggcatccttccatgggaattgggcaccgtggtttgtgcatgaactatgaagtagttgtcttgtggatcaaaactcttctctcgtgaatctatctgatgtgtaacaatttgattcatctattgcaatacgcatgttcccaagtcg

SEQ ID NO: 19729 - protein, 155 aa, Panicum virgatum
  misc_feature: Ceres CLONE 1806609-R
  misc_feature: SWISSPROT Homolog: EC 1.14.13.68 4-hydroxyphenylacetaldehyde oxime monooxygenase
  misc_feature: Functional homolog of the protein sequence given in SEQ ID NO 50304
  misc_feature: Useful for making plants with altered carbohydrate content
  misc_feature: Functional homolog of the protein sequence given in SEQ ID NO 50717
  misc_feature: Useful for making plants with altered lignin content
QAGVPEGGFKEVLRLHAPAPLLVPHESTTPAVVQGYEIPAKTAIFINAWAIGRDPAAWDAPEEFRPERFVGGGPPADFRGTEYQLIPFGAARRICPGINFALPVLELALASLLRHFDWELPGGMRPADLDMGEAPGLTTPRRVPLVLVPKTKTLA

SEQ ID NO: 19730 - DNA, 724 bp, Panicum virgatum
  misc_feature: Ceres CLONE 1806614
  misc_feature: Encodes the peptide sequence at SEQ ID NO. 19731
aacacacacaagaactttcttgctagctagagactagagagggagagaggctaggagacggtgctgccctcgcgcatggcggcggccatggagtatacaaacagtttcttgcccctggcggtcgcgggggcggcgctgctcctcgccgcctccatttccgcgtggctgcagcggccgcgccgcgtcgcggaggccttccgccggcagggcatcgacggcccgccgccgtcgtcgttcctgtcggggaacctctccgagatgcaggcgagggcggccgccgcggcggtggcggaggcgccggcggccggcggccgggacttcgagaaggaaggcttcgacgactactgcaagaggatcttcccctacttcgagaagtggaggaaagcctacggcgagacgtacctgtattggctgcggcggcggccggcgctgtacgtgtcggacccggaactgatccgcgagatcgggcgctgcgtgtcgctggacatgggcaagcccacctacctgcagaagggccaggagcccctcttcgggcgcggcgtcctcaaggccaacggcgccgagtggcaccgccagcgccgggtcatcgcgcccgagttctacatggccaaggtcaagggcatggtggggctgatggtgggcgcggcgcagccgctgctgcggtcgtgggaggccgaggccgccgccgcgccgggcggcgtcgcgaaggtcgacgtccacgacg

SEQ ID NO: 19731 - protein, 216 aa, Panicum virgatum
  misc_feature: Ceres CLONE 1806614
  misc_feature: SWISSPROT Homolog: EC 1.14.14.1 Unspecific monooxygenase
MAAAMEYTNSFLPLAVAGAALLLAASISAWLQRPRRVAEAFRRQGIDGPPPSSFLSGNLSEMQARAAAAAVAEAPAAGGRDFEKEGFDDYCKRIFPYFEKWRKAYGETYLYWLRRRPALYVSDPELIREIGRCVSLDMGKPTYLQKGQEPLFGRGVLKANGAEWHRQRRVIAPEFYMAKVKGMVGLMVGAAQPLLRSWEAEAAAAPGGVAKVDVHD

SEQ ID NO: 19732 - DNA, 656 bp, Panicum virgatum
  misc_feature: Ceres CLONE 1806614-R
  misc_feature: Encodes the peptide sequence at SEQ ID NO. 19733
ccccggacttygacgccatcgccaggatgcggacggtgcacgcggtggtgctggagacgctgcgcctcttcccgccgtcctcgttcgtggtgcgggaggcgttccgcgacatgcagctgggcaggctgcgcgcccccaggggcacctacctcttcgtgcccgtctccaccatgcaccacgacgcctccatctggggccccgccgcgcgccgcttcgaccccggccggttccgcgacggcgtggccgcggcgtgcaagcacccgcaggcgttcatgcccttcgggctcggcgcgcgcacctgcctcggccagaacctcgcgctcgtcgaggtcaaggcgctcgtcgcgctcgtcctcgcgcggttcgcggtcgccctgtcgccggactacaggcacgcccccgcgttccggttcatcatcgagcccgagttcgggctgcgcctccgcgtccgccgcctcgctcacgacggccgccactgatggtgatgcgtgcaagtgtttggagttgcgttttgtaaaggcgtacactagctgacacgtgaaaggaggacaaggacttaccagttaccacgacaccaatgaacacacgagcaataacaggattgtatgtacatgaaggatatgcactagtaatatactgaagaacgaactcgtcgg

SEQ ID NO: 19733 - protein, 158 aa, Panicum virgatum
  misc_feature: Ceres CLONE 1806614-R
  misc_feature: SWISSPROT Homolog: EC 1.3.3.9 Secologanin synthase
  misc_feature: Functional homolog of the protein sequence given in SEQ ID NO 50879
  misc_feature: Useful for making plants with modulated biomass
  misc_feature: Useful for making plants with modulated flowering time
PDFDAIARMRTVHAVVLETLRLFPPSSFVVREAFRDMQLGRLRAPRGTYLFVPVSTMHHDASIWGPAARRFDPGRFRDGVAAACKHPQAFMPFGLGARTCLGQNLALVEVKALVALVLARFAVALSPDYRHAPAFRFIIEPEFGLRLRVRRLAHDGRH

SEQ ID NO: 19734 - DNA, 1268 bp, Panicum virgatum
  misc_feature: Ceres CLONE 1806617
  misc_feature: Encodes the peptide sequence at SEQ ID NO. 19735
aagcactgccacaaagtgaccaggctcgctcctgctcacgtccttcctccgcctcgccatcgccgggccacggctgccgtcagtaagtcccgctcgggagcccggatggcgtcggagaagagcaagatcctggtggtcggcggcacggggtacctgggccggcacgtcgtcgcggcgagcgcgcggctgggccacccgaccttcgcgctcgtcagggacgcggcgccgtccgacgcggccagggcggcgctgctcaagagcttccaggacgccggcgtgacgctcgtcaagggcgacctctacgaccaggccagcctggtgagcgcggtcaagctcgcggacgtggtcatctccacggtcggggcgccgcagctcgccgaccagaccaggctcgtcgacgccatcaaggaggccggcaacgtcaagaggttcatcccgtcggagttcggcctggacgccgaccgctcgggcgccgtggagccggccaggtccacgttcatcaccaccaaggcggccatccgccgcgccgccgaggccgccgccgtcccctacacgctcgtgtggacgggctacttcttcggctacgggctgccgggcatcgggcaggccgtggcccagtcgcccccggccgacaaggctgtcgtcctcggcgccggcgacgccagggcgtcgttcgtggacgagggcgacatcgggacgtacacggtgctggccgctgacgacccgcgcgcggcgaacctcacgctgtacgggaagccgccggccaacacgctgtcgcacagcgagctcctggcgctgtgggagacgaagaccggcaaggcgttcgagcgggtgcacatcccggaggacgccgtgctccagcagatccaagaagctccgaccccgcgggacaaaatcctactgtcgatcgggcacgcagtgcacatcaggggggagcacgagttcgagatcgacccgtcgtcaggggtggaggccaccgagctgtacccggacgtgaagtacaccaccgtcgacgagtacctgaacaggttgctctgaatttatagtgcgtcctcggtggtccgatgatcgtgtgcgtcaggtagtcaccggtgatgcgtcggccaccgcgccgtgctgctccccggcgttgcgccgacacgtgcagccagcgaccttgaaaccctgtaacagattagcggatactagtaatcttgtttctgattctgatccgctcttacttttgaggagtcgatcacaattcacaatccagtaaggtgggatgttag

SEQ ID NO: 19735 - protein, 310 aa, Panicum virgatum
  misc_feature: Ceres CLONE 1806617
  misc_feature (8)..(301): Pfam Name: NmrA Pfam Description: NmrA-like family
  misc_feature: SWISSPROT Homolog: EC 1.3.1.45 2'-hydroxyisoflavone reductase
MASEKSKILVVGGTGYLGRHVVAASARLGHPTFALVRDAAPSDAARAALLKSFQDAGVTLVKGDLYDQASLVSAVKLADVVISTVGAPQLADQTRLVDAIKEAGNVKRFIPSEFGLDADRSGAVEPARSTFITTKAAIRRAAEAAAVPYTLVWTGYFFGYGLPGIGQAVAQSPPADKAVVLGAGDARASFVDEGDIGTYTVLAADDPRAANLTLYGKPPANTLSHSELLALWETKTGKAFERVHIPEDAVLQQIQEAPTPRDKILLSIGHAVHIRGEHEFEIDPSSGVEATELYPDVKYTTVDEYLNRLL

SEQ ID NO: 19736 - DNA, 2421 bp, Panicum virgatum
  misc_feature: Ceres CLONE 1806627
  misc_feature: Encodes the peptide sequence at SEQ ID NO. 19737
atcccagcacgagcagctcgttcatcaccgaccctcaccgtctcgtctccctgctccgctccccgcacgcgctcgcccctccctccctctctcccctcctcaccgccgctcgcgccccgtgccgtttccgccatgtgtggcatcttcgccgtgctcgggtgcgccgactgctcccaggcccagagggcgcgcgtcctcgcctgctcccgcaggctgaggcaccggggacccgactggtcgggggtgtaccagcacgagggcaacttcctcgcccagcagcggctcgccgtcgtctccccgctgtccggcgaccagccgctcttcaacgaggaccgcaccgtcgtcgtcgtggccaatggggagatctacaaccacaagaagatccgaaagcagttcaccggcaagcacaccttcaccaccggcagtgactgcgaggtcatcatccctctgtacgaggagtacggcgagaacttcgtcgacatgctggacggcgtgttcgccttcgtgctctacgacacccgcaacaagacctacatggcggcgcgcgacgccatcggcgtcaaccccctctacatcggctggggcggcgacggtaggcgtccccctcctcatctctctgctggctctccgtgcgctgcccgttcacgtttctgttcccgtcgccctgcatgtgcgttcggattcagacaaagcgtggcaggcagggctcgcactcgcacacgacgatatggatagatgaccgatcgatctttgcctcgtctcgtcttgaatgccttcctccgctgcactgcaggttccgtctggttcgcctccgagatgaaggcgctgagcgaggactgcgtccggttcgagcacttcccgccggggcacctctactccagcgccgccgcggggttccgccgctggtacaacccggcctggttcctcgagcaggtgccggcggcgccgtacgacccgctcgtgctcagggcggccttcgagaaggcggtcgtcaagaggctcatgaccgacgtgcccttcggcgttctcctctcgggcggcctcgactcctccctcgtcgcctccgtgaccaagcgccacctcgtcgagaccgaggcggccaagaagttcggcaccgagctccactccttcgtcgtcggactcgagggatcccctgacctgaaggccgccagagaggtcgctgactacctcggaaccgtccaccacgagttccatttcaccgtacaggacgggatcgacgcgatcgaggaggtgatctatcacgacgagacctacgacgtgacgacgatccgggccagcacgcccatgttcctgatggcgcgcaagatcaagtcgctgggcgtcaagatggtgctctcgggggagggctccgacgagctcctgggcggctacctctacttccacttcgcgcccaacaaggaggagttccacaaggagacctgccgcaaggtcaaagctctgcaccagtacgactgcctgcgcgccaacaaggcgacctcggcctggggcctcgaggtccgcgtgccgttcctcgacaaggagttcatcgacgtcgccatgggcatggaccccgaatggaaaatgtacgacaagagtctcgggcggatcgagaagtgggtcatgaggaaggcgttcgacgacgaggagcgcccgtacctgccgaagcatattctctacaggcagaaagagcagttcagcgacggtgtcggctacagctggatcgatggcctcaaggccttcaccgagcagcaggtcacggacgaaatgatgaacaacgctgccaaattgtacccctacaacacgccggtcaacaaggaggcctactactacaggatgatcttcgagaggatcttccctcaggactcggcgagggagacggtgccgtggggcccgagcatcgcgtgcagcacgcccgcggccatcgagtgggtggagcagtggaaggcctccaacgacccttccggccgcttcatctcctcccacgacgccgccaccggccacggcgccggcggcgcgcacgctaacggcaacggcgtggcggccgtggcgaacgggcacggcccggccaacggcgcggtcaacggcggcgaggtcgccgtggcgaacggtcacggcgcggcgaacgggaacgaggtcgccgtcgcgatcgcggtgtgactttgtgggctcatcagggataaggacgacgagtaggttgcggcgtggcgtgtcagccggtcgccatgacatggtgcggtggcacacgtgctactagcctactattgtttttacgcggtgttgtactgtcactagcgtaagtgcgcgtgtgtgagcgagcgagcgagccatggaggcatgtgtgtgttgtgccgggttgatgtcctcgaactcgatctttctaaagacttgggctacggatcaatctaaagatgttttgtttag

SEQ ID NO: 19737 - protein, 473 aa, Panicum virgatum
  misc_feature: Ceres CLONE 1806627
  misc_feature (76)..(317): Pfam Name: Asn_synthase Pfam Description: Asparagine synthase
  misc_feature: SWISSPROT Homolog: EC 6.3.5.4 Asparagine synthase (glutamine-hydrolyzing)
MTDRSLPRLVLNAFLRCTAGSVWFASEMKALSEDCVRFEHFPPGHLYSSAAAGFRRWYNPAWFLEQVPAAPYDPLVLRAAFEKAVVKRLMTDVPFGVLLSGGLDSSLVASVTKRHLVETEAAKKFGTELHSFVVGLEGSPDLKAAREVADYLGTVHHEFHFTVQDGIDAIEEVIYHDETYDVTTIRASTPMFLMARKIKSLGVKMVLSGEGSDELLGGYLYFHFAPNKEEFHKETCRKVKALHQYDCLRANKATSAWGLEVRVPFLDKEFIDVAMGMDPEWKMYDKSLGRIEKWVMRKAFDDEERPYLPKHILYRQKEQFSDGVGYSWIDGLKAFTEQQVTDEMMNNAAKLYPYNTPVNKEAYYYRMIFERIFPQDSARETVPWGPSIACSTPAAIEWVEQWKASNDPSGRFISSHDAATGHGAGGAHANGNGVAAVANGHGPANGAVNGGEVAVANGHGAANGNEVAVAIAV

SEQ ID NO: 19738 - DNA, 689 bp, Panicum virgatum
  misc_feature: Ceres CLONE 1806636
  misc_feature: Encodes the peptide sequence at SEQ ID NO. 19739
gatgaagccgatggccaccaatggcatggccccctccttcttccccgcaaacttcctgctccaaatgcagcagcccctccctcaccatccccagcagcaggaccaccaccaccatgacgccggccaccacgagcacaaggcggcgcaccatctcctcgctccccctccccccgccctcgtcagccccttcctccacgacttcggcggcgccatggccgcgccgccaatgctgggcggcggcctcggcaagcgcatgtaccccgacggcgcgggcgacgacagtaacagcctgcagcagcacgcggcggcggcggatccgcagcagcaggacggcggcgcggggtcggacgacgaggaaggctccgccgcggcgggaggcgggtgcggcggggagcggaagcggcggctgagcgtggagcaggtgcgcacgctggagcggagcttcgaggtggccaacaagctggagccggagcggaaggcgcagctggcccgcgcgctggggctgcagccccggcaggtggccatctggttccagaaccggcgcgcgaggtggaagacgaagcagctggagaaggactacgacgcgctccgccgccagctcgacgccgcccgcgccgagaacgacgccctcctcgcccacaacaagaagctccacgccgaggtcatggcgctcaagggaggcggaggcg

SEQ ID NO: 19739 - protein, 159 aa, Panicum virgatum
  misc_feature: Ceres CLONE 1806636
  misc_feature (62)..(116): Pfam Name: Homeobox Pfam Description: Homeobox domain
  misc_feature (117)..(159): Pfam Name: HALZ Pfam Description: Homeobox associated leucine zipper
  misc_feature: The sequence is a functional homolog of SEQ ID NO 577 in the 11/479,226 US patent application
  misc_feature: Functional homolog of the protein sequence given in SEQ ID NO 50880
  misc_feature: Useful for making plants with altered lignin content
  misc_feature: The sequence is a functional homolog of SEQ ID NO 260 in the 10/412,699 US patent application
  misc_feature: The sequence is a functional homolog of SEQ ID NO 571 in the 11/479,226 US patent application
MAAPPMLGGGLGKRMYPDGAGDDSNSLQQHAAAADPQQQDGGAGSDDEEGSAAAGGGCGGERKRRLSVEQVRTLERSFEVANKLEPERKAQLARALGLQPRQVAIWFQNRRARWKTKQLEKDYDALRRQLDAARAENDALLAHNKKLHAEVMALKGGGG

SEQ ID NO: 19740 - DNA, 558 bp, Panicum virgatum
  misc_feature: Ceres CLONE 1806636-R
tgcggcgccgtggtcgacgagcagccgccgttctggccctgggccgacggccaccacaacttccagtgatcgctcgcacatcctccgatccgcgcgaggatgattgatcgagacaatgcatgcgtgtcacgaatgaatctgatcaccggatacattcaactaagagtaatcgatcggtgtggctgctctccattttgttggcatcgatcgaggccagcaggaggagagatcgccgatatcagaatgagttagttgttgaacaaattgatgtgatgaagcaagtgatgggatgatccgctttgagttaagatgaggaggaatgagccatgaatgattggagtacgttggatgggtcatgtgtcagtctaggtagattttggattcaagtagtaagcttttttttcctctttttttcccatttctctttttgtttaatttttccttgatcactatttttctgtttaatatttatatataggtgattacatttgtgaggcagtggtgatattattgtgtataggattggtgtggtaccttgtgagtaccaacaagtttcgc

SEQ ID NO: 19741 - DNA, 1919 bp, Panicum virgatum
  misc_feature: Ceres CLONE 1806652
  misc_feature: Encodes the peptide sequence at SEQ ID NO. 19742
gagaactcccttctccgccgctacccaagcctcgcccctgtacccccacccgccgccgctgctgctagggagcttccacccgcgcgcctacaacaagagctagcagcagcaagcggtcgctatcgggtgccgctccggccgtaccagtgtgctcgcgaaccctaacccccgatgccgtatatggtgggggccgccgaccagatcgccgccggctcggcggccgagcggccggcgggcctgccgaggagcggctcgcccagccgcctcaacgcgcaggcgccggagttcgtgccacggggcccgccgtcgccggcgcccgcggtcgtcgtgccaccgccaccgccgcaggtgatccgagtgttcgccgcgccgcctccgccgccgcgcgccgccttcttcgcggcgcccccgccccggccgttcgagtacttcgcgccggtggggggacgcgccggatttaccaccaaggagcagcaggtgcccaagccagagccggatgtggagctgatcccgcccgcggcgcaggcggagccggtggtggacgggctccaggatgaggtggtgcacaagatcaccaagcaggtggagtactattttagtgatataaacctggctaccacagaacatttgatgagattcatcagcaaagatcctgagggatatgtgccaatatcagttattgctggcttcaagaaagtaaaagtttctgtgcgtaataactccatgcttgctgcagctctccgagcctcatcaaaacttgttgtaagtgatgatggaaaaagggtcaaacgtcaagaaccatttactgaatctgatttgctggagctcaagtcccgaattgttgttgcagaaaatcttcctggtgatccttcctaccagaatcttaagaagttattttcagctgttggcagtgtgatttcaattcgcacttgctatcctcaggctccaaatggctctggtcctgcaactaatagatctgccaagctagatatgctttttagtaacaagctgcatgctttcgtggagtatgagacacctgaggatgctgagaaggcaattgtggcacttagtgatgaggaaaactggagaaatggacttagagtccgcttgctgaatacttgctcggcaaaggggacaggcaaaggcaaaaaggaagcacatgaatctaatggaaatggtgaggaagatgtctccatttcgaaccaatcaaatgagcaacagtctgaagaatcctctcaactgttagatgtgttgccagagcacttgtttgacgagaccttcaatgagaaggaagttccaaaacgtggcagaggacgcggtcgaggtggcagggggcgtgggcgtggcaaccaccagtacaacaatcatcaccagtacaacaaccagcactaccagaaccaccagccgcactacaatcaccacagcagcaacaaccacggcggcaaccgtggtggtgcccacccggttggaactccgccgcacaacctgataaacaagcccgagcagcaccagcagctgccgatcggggccagcaagcttcctccgggcccccgcatgcctgatggtacacggggtttcaccatgggcagagggaagccacaagctgtgctgccaggtctgtgtgctgttggcgagccttaatgttggtggtgagcgagtggcattgattattgctgctcttgtttgtataccttatggcgggtggatttctgtgtcaaaagacttgtttccagttggatgcgtgcgtagtgtttggatggccttttttatgtaagcatgtacggtgagtcggtgttttgttcgtccagacaagattctacctctgtagttgtctctatttttttttctgtcttggggtggagtgcgttggttccaaataagtcatctgctcataagtgaaaaaagtgatttattttgtc

SEQ ID NO: 19742 - protein, 489 aa, Panicum virgatum
  misc_feature: Ceres CLONE 1806652
  misc_feature (134)..(193): Pfam Name: La Pfam Description: La domain
  misc_feature (27)..(44): Pfam Name: PAM2 Pfam Description: Ataxin-2 C-terminal region
MPYMVGAADQIAAGSAAERPAGLPRSGSPSRLNAQAPEFVPRGPPSPAPAVVVPPPPPQVIRVFAAPPPPPRAAFFAAPPPRPFEYFAPVGGRAGFTTKEQQVPKPEPDVELIPPAAQAEPVVDGLQDEVVHKITKQVEYYFSDINLATTEHLMRFISKDPEGYVPISVIAGFKKVKVSVRNNSMLAAALRASSKLVVSDDGKRVKRQEPFTESDLLELKSRIVVAENLPGDPSYQNLKKLFSAVGSVISIRTCYPQAPNGSGPATNRSAKLDMLFSNKLHAFVEYETPEDAEKAIVALSDEENWRNGLRVRLLNTCSAKGTGKGKKEAHESNGNGEEDVSISNQSNEQQSEESSQLLDVLPEHLFDETFNEKEVPKRGRGRGRGGRGRGRGNHQYNNHHQYNNQHYQNHQPHYNHHSSNNHGGNRGGAHPVGTPPHNLINKPEQHQQLPIGASKLPPGPRMPDGTRGFTMGRGKPQAVLPGLCAVGEP

SEQ ID NO: 19743 - DNA, 2683 bp, Panicum virgatum
  misc_feature: Ceres CLONE 1806660
  misc_feature: Encodes the peptide sequence at SEQ ID NO. 19744
attcctatgagtgtttacagcctcaccacctacacacacacacacacacaccatgcttctcctcgccttcaagatgtcactacttttgcttcttgctttactactactcccccgtgcaaattcgaagacggtgatgcagctcgatagagaagcagaagcccttcttcgatggaaatccaacttcgacgatgtctccggggcttcaggctgcctcaagtcatggagccagcacatcagcccgtgcaactggactggtgttgactgcatcaccacggtgcctcatggccgtggctggagtggcggcgatgctgtcccagtcccagtcgtgggcagcatctctcttcccatgtgcaacctctctggccggttagatgggctcgactttgcggcgttgcctcgtcttgctcatctggacctcaacgacaacaacctctcagggccgatcccgccgagcatcggtacacttgatgaactcattttactggatctctcaagcaatgccctctccggaccgatcccaccctccataggtaatcttaccagcctgacataccttgatctctcacagaattatcagttcctgaacggacacctcccttccacacttggcatgctacacaacttgaacaagcttgatctgtgtcgtaatagctttactggcccgatacctcccagtttgggaaatttgacctcgttggatttcattggccttagcttcaacaatttatcgggtagcataccacatgagttggggatgctccataggctatcgttcctgcatctgcttgggaatagaatcactggctccattcctggaagctttgggaatctaacaaggctagaattactggatgtttcagacaatcatatagttggctccatcccttccaccttctggaatctgaaatctctaaaaaagcttgtactagcttccaaccggattaatgggctgctgccacaagaaatagggtttctagtgaacctcactcatctagatctaagcagcaatcagtttacaggaccaattccacctcaaataggacagtgccgccatttgttgcagttgcgcatatcagataatttattgacaggaccaataccacaagatcttggggggtgtactggcctgtacgagctggatttcagcaggaataatctaagtggcaccatcccaatcattcttgcacagctttaccaactgcacaacctgaatctgtcatacaacagtttggttggcagatttgggggcacatctctcccttcagccttagtttctcttgaccacaatattgatatctgtggtgacaaacggtatggcttaacaccatgtgaagcattggagctcgatggaagaaataaggggaaaagacacaataaacgcctttttttggcgctacttcttgctttgggtctcttttgcttcattgctctggcagtaggaagcttggcacttttttgttggaggaaaaaatttaagaaatgcaggaccaaaagcaagcccggagatatgttctccatatggaatttcaacgggaagattgcattccaagacatactcgatgcaacagaaaattttgatgaaaaatattgcattggttctggaggacacgggtctgtcttcagagctgaggttcgtggaagtgtctttgcagtcaagctgctccactcgatggaagactacacagatgaaggaacatttcatgctgagatcgatgtgctaaccaaaacaaggcatcgatgcatagtgaagctgtatgggtactgctctcactcccagtgcagatttctggtgtacgatctcatggaaaggggaagcttagcatccattcttcacgaggaacaacttgcaagggagcttgactggcccaaaagagtttccattgtgagggatgtagctcaagctctctcttacctgcaccacgattgtgatgaacccatcatacatcgtgacatcaaaagtaacaatatcttattagaccgtgattttaaaggatatgtctcagattttggcatggcaaggaagttgaagcatatttactcgagttcaagtactatctttgcagggacatgcggctacatggcaccagaattatcttctacaatggtgttgacagagaagtgtgatgtatatagctttggtgtagttgtcatggaagtggtgatgggaaagcacccaggagatcttctgcttccattcttttgccaaacacagcagcatacaaagctcaaggatatcctggaccagcgcattattgtagagccaacaagcagtgaagaaaaggatattattctgctcgttcttgtggcctttgggtgtttgcaaatctgtccaaaagctcggccaacgatggagcaggtgtgtcaagccctcacaaacggaagttgcccagcagccatcctgaagccacttcacgaagttacgctacaagatttgcatgatttctgcagcaccatacagaatatatgatggccctatagtctcaagagtcgggaacattttggcttgtgcatttgtgtacatatcttattatctaaagctgcttttgatattatttggccctgtaatctcttttgtttctccttttttttatcctttttgtacagtttgaacctgatgtgtgttctttttccttcgttttaatacaactattattcagtagggggtctgcccctccttttcttt

SEQ ID NO: 19744 - protein, 797 aa, Panicum virgatum
  misc_feature: Ceres CLONE 1806660
  misc_feature (501)..(766): Pfam Name: Pkinase Pfam Description: Protein kinase domain
  misc_feature (23)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MSLLLLLALLLLPRANSKTVMQLDREAEALLRWKSNFDDVSGASGCLKSWSQHISPCNWTGVDCITTVPHGRGWSGGDAVPVPVVGSISLPMCNLSGRLDGLDFAALPRLAHLDLNDNNLSGPIPPSIGTLDELILLDLSSNALSGPIPPSIGNLTSLTYLDLSQNYQFLNGHLPSTLGMLHNLNKLDLCRNSFTGPIPPSLGNLTSLDFIGLSFNNLSGSIPHELGMLHRLSFLHLLGNRITGSIPGSFGNLTRLELLDVSDNHIVGSIPSTFWNLKSLKKLVLASNRINGLLPQEIGFLVNLTHLDLSSNQFTGPIPPQIGQCRHLLQLRISDNLLTGPIPQDLGGCTGLYELDFSRNNLSGTIPIILAQLYQLHNLNLSYNSLVGRFGGTSLPSALVSLDHNIDICGDKRYGLTPCEALELDGRNKGKRHNKRLFLALLLALGLFCFIALAVGSLALFCWRKKFKKCRTKSKPGDMFSIWNFNGKIAFQDILDATENFDEKYCIGSGGHGSVFRAEVRGSVFAVKLLHSMEDYTDEGTFHAEIDVLTKTRHRCIVKLYGYCSHSQCRFLVYDLMERGSLASILHEEQLARELDWPKRVSIVRDVAQALSYLHHDCDEPIIHRDIKSNNILLDRDFKGYVSDFGMARKLKHIYSSSSTIFAGTCGYMAPELSSTMVLTEKCDVYSFGVVVMEVVMGKHPGDLLLPFFCQTQQHTKLKDILDQRIIVEPTSSEEKDIILLVLVAFGCLQICPKARPTMEQVCQALTNGSCPAAILKPLHEVTLQDLHDFCSTIQNI

SEQ ID NO: 19745 - DNA, 2547 bp, Panicum virgatum
  misc_feature: Ceres CLONE 1806665
  misc_feature: Encodes the peptide sequence at SEQ ID NO. 19746
attgcaactctgcaaattttctctctctccatttttccccattccccgtgctgccgagcccccttccggcctttccctgctctccccatccccgaccaccgtccccgtcttcgccggccatctcatccgcagccggggaccaaaccctaacccagtgcaaccgcgtctcagccgatatccgctcgcctccctgcccgatctaccctccggacgcggggccgtggggctgagtccgagacggatgccagcgccccgcggttgcgcgctccgaggccgtggagggcagcggcagaggaatccggtcgccgagccacgagccgcgaggtctctggtgctatagccgcagccgcagcaacagcagcagcagcagcagtgcgaagaggacgagcaggagggagggggaggcgaagggatggacgacttcgacagcggcggccggagcggggacaaggcaggcgccggcgcgggcgacgacgggggcgccccgccgctgccccagacggtacaaattggaaattcaccaacctataagcttgaaaggaagcttggaaagggaggatttggacaagtatatgttggtcgacgtatttctgcccctcgtctcagtgaccggaaccctggttcaaatgctttagaggttgcactgaaatttgaacatcaaaccagcaaaggatgcaactatggagctccttatgagtggcaagtttacaacactcttagtggaaaccatggtgtcccacgggtacactacaaaggaaagcaggccgagttttatatcatggttatggatatgctgggaccaagcctatgggatgtttggaataacaattcccactcaatgtctgttgagatggttgcttgcataggcatagagggaatctccatactggagaagatgcactctaaagggtatgtccatggtgatgtgaaacctgagaacttcttgcttggtcctcctggtaccccagatgagaagaagctttttcttgttgacctcggactggcaactaaatggaaggatgctggtacggggcaccatgtcgaatatgatcagagacctgatatctttaggggtactgttcgctatgctagtgtgcatgcccacttgggaaggactgggaccaggagagatgaccttgaatccctcgcatacacacttatttttcttctccgtggtcgcctcccttggcaaggataccagggagagaacaaaggttttcttgtctgcaagaaaaagatggcgacatctccagagtctttgtgtggaatttgcccacaacctttccgacattttgttgagtatgttgtgaacttgaaatttgacgaagaaccaaactatgcaaagtgtatttctctttttgatggcattgttggcccaaatccagacataagaccgataaacacagatggtgctcagaagctaatataccaggttggccagaagagaggccgcttaatagtggatgaaaatgatgatgagcaacctaagaagaagatcagaatggggatgccggcaactcagtggattagtgtgtacaatgcccgtcgacctatgaaacagaggtaccactacaatgtagctgataatagattactacagcatattcaaaagggaaatgaagatggcttgtttattagttcagttgcctcatgctcaaatctgtgggctttaattatggatgctggaactggttttacatctcaagtatatgaactctctcatcactttcttcacaaggaatggataatggagcagtgggagagaaatttctatatcacctcactggccggtgcaaataatggcagctctctggtgatcatgtcaagaggaacgcagtatgcacagcagtcctacaaagtaagcgattcatttcccttcaaatggataaacaaaaaatggaaggagggcttttatgttacggctatggcaacggctgggagccgatgggcagctgtcatgtcccgcaatgctggtttcagtgctcaggtagtggagcttgacttcttatatccaagtgagggcatccacatgcgttgggacaatggttatcgcatcacggccacggctgccacgtgggaccaggcggcctttatcttgagtgtccctaggagaaagcctactgatgaaacacaggagaccctgagaacatctgccttccccagacagcatgtgaaggataaatggtccaataacctctaccttgcttccatttgctatggaagatccgtatcgtgaagcccgttttctcatgtaagatatactaatatgaaccacaggtggttctatgataagaggtgggggattttgaatctcaaaactttgctaacctacttacccgcagctaacaaaaggtaacctatatgagagaaagaaaagctggttgtgtttggttagcatgcagcaaagaacagtgtggtctgttttttttttgtcggttgtgtataaattatccaaagcattagagtgtgttgtaaagaatgtataggtgtacctgctgaaccgttgccatgtacagaaagttagctttacaaggttgtttggctccc

SEQ ID NO: 19746 - protein, 607 aa, Panicum virgatum
  misc_feature: Ceres CLONE 1806665
  misc_feature (39)..(316): Pfam Name: Pkinase Pfam Description: Protein kinase domain
  misc_feature: SWISSPROT Homolog: EC 2.7.11.1 Non-specific serine/threonine protein kinase
MDDFDSGGRSGDKAGAGAGDDGGAPPLPQTVQIGNSPTYKLERKLGKGGFGQVYVGRRISAPRLSDRNPGSNALEVALKFEHQTSKGCNYGAPYEWQVYNTLSGNHGVPRVHYKGKQAEFYIMVMDMLGPSLWDVWNNNSHSMSVEMVACIGIEGISILEKMHSKGYVHGDVKPENFLLGPPGTPDEKKLFLVDLGLATKWKDAGTGHHVEYDQRPDIFRGTVRYASVHAHLGRTGTRRDDLESLAYTLIFLLRGRLPWQGYQGENKGFLVCKKKMATSPESLCGICPQPFRHFVEYVVNLKFDEEPNYAKCISLFDGIVGPNPDIRPINTDGAQKLIYQVGQKRGRLIVDENDDEQPKKKIRMGMPATQWISVYNARRPMKQRYHYNVADNRLLQHIQKGNEDGLFISSVASCSNLWALIMDAGTGFTSQVYELSHHFLHKEWIMEQWERNFYITSLAGANNGSSLVIMSRGTQYAQQSYKVSDSFPFKWINKKWKEGFYVTAMATAGSRWAAVMSRNAGFSAQVVELDFLYPSEGIHMRWDNGYRITATAATWDQAAFILSVPRRKPTDETQETLRTSAFPRQHVKDKWSNNLYLASICYGRSVS

SEQ ID NO: 19747 - DNA, 1971 bp, Panicum virgatum
  misc_feature: Ceres CLONE 1806686
  misc_feature: Encodes the peptide sequence at SEQ ID NO. 19748
acaaccattctacaatccacacaagccaacgcacgagcagcagattctatcaagagtctcgtacgaaccaccagacagatccagcaaagcaatccagcacgcagccagccagacacagagaagatcgacttcctcctcgccggccgtacgtgccaagtgtgatcgagtgagtgagtgacctcccgcgcggcgcgccatgggcggtctggcatggatggtggccgcggccgccgccgcggtggcggcgtcgtgggcgctcaacgcgctgctgcacctcgtctggcgcccctacgccgtcacccggaggatggccgcgcggggcgtgcgcgggccggcctacaggttcttctccgggaacctcggcgagatgaggcgcctccgcgccgaggccgcgggcgccacgctcgccgtcggcgaccacgacttcgtccccctagtgcagccctaccaccgcaagtggatctcgatctacggccggttgttcttgtactggaacggggcgacgccgaacatgtgcgtggcggacgtgaacgtcgtcaggcaggtgctctccgaccgcaccgggctctaccccaagaacctctcgaacccgcacgtcggccgcctgctcggcaaggggctcgtcttcaccgaaggcgacgactggaagcgccaccgcaaggtcgtgtacccggcattcaacatggacaagctcaagatgatgacggcgatcatgtccaactgcgctcgctctatgatgtccgagtgggaggcgcagctggccaaggcgcccggcggcgtggagatcgagctgagcagccggttcgaggagctcaccgccgacgtgatctcgcacacggcgttcgggagcagctacaaggaggggcggcaggtcttcctggggcagagggagctccagtttctcgccttctccacgaccttcagtgtccagatcccggcattcaggtacctcccaacggagaagaacctgcgggcatggaagctggacaggaaggtgaggaccatgctcatggacatcatccagagccgcctcgcctccaaggacaccgccggctacgggaacgacctgctcgggctgatgctggaggcgtgcgcgccggagcatggcggcgagagcccggtgctgagcatggacgagatcatcgacgagtgcaagaccttcttcttcgcggggcacgacaccacctcgcacctcctcacctgggcctccttcctgctgagcacgcacccggactggcaggacaagctccgggaggaggtgcggcgggagtgcggcgacgaccaggagcccaacggcgacatgctcaacaagctcaagctggtgaacatgttcctcctggagaccctgcggctgtacggccccgtgtccatgatccagaggaaggcgagctcggacctcgaccttggtggcatccgggtgcccgagggcaccatcttgtcgatcccaatcgcgacgatccaccgtgacaaggaagtctggggcgaagatgctggtgagttcaagcccgagaggtttgagaatggggtgacaagggcagccaagcaccccaacgcgctgctatccttctccagcgggccgaggtcgtgcattgggcagaacttcgccatgatcgaggccaaagctgtggtcgccatgatcctgcagaagttcaagctcgagctgtcacccaagtacgtgcacgcgcccatggatgtgctcacgctgcggcccaggcatgggctccccatgatcctcaagcgtctggaggcgtcgtaagagtcgcgtgctacacatgcatgctgcatacggagtatctgtccgtttgaaaaaaaaattaattcattttcatttgattgtgtaatatatactttttttttttgcaaaaggatgtgtaatatgtactacagcctgtatatgtaagttctagattgtaatgttaaattattgtagaagttttgaaatttctcttgcatcacacaatttactgtttt

SEQ ID NO: 19748 - protein, 519 aa, Panicum virgatum
  misc_feature: Ceres CLONE 1806686
  misc_feature (58)..(511): Pfam Name: p450 Pfam Description: Cytochrome P450
  misc_feature: SWISSPROT Homolog: EC 1.3.3.9 Secologanin synthase
MGGLAWMVAAAAAAVAASWALNALLHLVWRPYAVTRRMAARGVRGPAYRFFSGNLGEMRRLRAEAAGATLAVGDHDFVPLVQPYHRKWISIYGRLFLYWNGATPNMCVADVNVVRQVLSDRTGLYPKNLSNPHVGRLLGKGLVFTEGDDWKRHRKVVYPAFNMDKLKMMTAIMSNCARSMMSEWEAQLAKAPGGVEIELSSRFEELTADVISHTAFGSSYKEGRQVFLGQRELQFLAFSTTFSVQIPAFRYLPTEKNLRAWKLDRKVRTMLMDIIQSRLASKDTAGYGNDLLGLMLEACAPEHGGESPVLSMDEIIDECKTFFFAGHDTTSHLLTWASFLLSTHPDWQDKLREEVRRECGDDQEPNGDMLNKLKLVNMFLLETLRLYGPVSMIQRKASSDLDLGGIRVPEGTILSIPIATIHRDKEVWGEDAGEFKPERFENGVTRAAKHPNALLSFSSGPRSCIGQNFAMIEAKAVVAMILQKFKLELSPKYVHAPMDVLTLRPRHGLPMILKRLEAS

SEQ ID NO: 19749 - DNA, 380 bp, Panicum virgatum
  misc_feature: Ceres CLONE 1806708-R
  misc_feature: Encodes the peptide sequence at SEQ ID NO. 19750
aggctgaccatggctgggttcaagccgtacccgctaagctcatacgtgaactcggtgatcaggaggctcctcgcatgctactctgacaagtacaccctggaggagaaggacggcgcgatgctgctcggctggaagaataggaaattgatatcaacttttgcgtggcactgacaataagttttcagaagaacataagtaaacaccttctcttacatataaatatatatagtgaattccctggtctgctttcccagcaaaggttctttttgttgtgtacatgtacaggatgttgcatccttagttttttcccccctaaattgtaaaccaggataaacattgacattagattctagctgtatgataattacaattttcccggg

SEQ ID NO: 19750 - protein, 56 aa, Panicum virgatum
  misc_feature: Ceres CLONE 1806708-R
  misc_feature: The sequence is a functional homolog of SEQ ID NO 474 in the 10/666,642 US patent application
  misc_feature: Functional homolog of the protein sequence given in SEQ ID NO 50758
  misc_feature: Useful for making plants with modulated light quality sensitivity
  misc_feature: Functional homolog of the protein sequence given in SEQ ID NO 50759
  misc_feature: Useful for making plants with modulated low light sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
RLTMAGFKPYPLSSYVNSVIRRLLACYSDKYTLEEKDGAMLLGWKNRKLISTFAWH

SEQ ID NO: 19751 - DNA, 179 bp, Panicum virgatum
  misc_feature: Ceres CLONE 1806708
cggcggactcggatccgcctgtgcggatccgaggaggccccgagcagcttctgccccttcatttactatggacttgcaccacctgatcacgtacagattaactggtgctcacgccttctccgacttccctacccaaaacaacttaacaaccactccctggccagtgaaccccctgccgg

SEQ ID NO: 19752 - DNA, 612 bp, Panicum virgatum
  misc_feature: Ceres CLONE 1806731
  misc_feature: Encodes the peptide sequence at SEQ ID NO. 19753
gtccagtccccctcctttcttactctattcgagtcctaccagtagcggccgagagagaggagggggtggtggtggtggtggaggagcggacggagccgccgcttgctgcgagatctaggcgaacgcggccatgggtgctcgctgctccaagctctccgtgtgctggtggcctccccacttcaagtcgccgatgcttgagcatggcgccgccgacgatgacggcagcggcgtgccggtgttcgcccagtacagcctcgacgagctccgggcggccaccgacggcttcgcgccggaccgcatcgtgtcggagcacggcgagaaggcgcccaacatcgtctaccggggcacgctcttcagctccggccgcaccgtcgccatcaagcgcttcggccgctccgcctggcctgactcccgccagttcctggaggaggcgagggctgttgggcagctgcgcagtggccggctggccaacctaattggttgctgctgcgagagcggggagcggctgcttgttgccgagttcatgccacatgagaccttggcaaagcatctcttccactgggaaaccaaccccctgatctggacaatgaggatgagggctgcgctttatgt

SEQ ID NO: 19753 - protein, 160 aa, Panicum virgatum
  misc_feature: Ceres CLONE 1806731
  misc_feature: SWISSPROT Homolog: EC 2.7.11.1 Non-specific serine/threonine protein kinase
MGARCSKLSVCWWPPHFKSPMLEHGAADDDGSGVPVFAQYSLDELRAATDGFAPDRIVSEHGEKAPNIVYRGTLFSSGRTVAIKRFGRSAWPDSRQFLEEARAVGQLRSGRLANLIGCCCESGERLLVAEFMPHETLAKHLFHWETNPLIWTMRMRAALY

SEQ ID NO: 19754 - DNA, 614 bp, Panicum virgatum
  misc_feature: Ceres CLONE 1806731-R
tgccgttggggggtactccaggttccttgaatcgggggcagcggtggtttccacaaagctggcggggcggggctttgcataagtagtgggtggcaagttgcaggaaggcctagaggatgcaaagagggttgagggccttgcccctggggggccaatgggaccctatttgccggggttggccctccatagcctgggaaggggggcagaaagcaaagaagcgctaaagaaaggccctgggttggaaggtgaaagaaatagtagagctacaaaagtatagccgccccgaaagggggaaggttttgctttttttgcttgtacttatattgcctgccttttgggggcctggtccaaagctttgccgcccgtaggggtatttttggtattccctaacaagtatcggtatttccaacggttacaagttttaaaactcctaggttgggtgtttttacccctccatattccagaatacggaaaagggcaaatagtatcgcgaaagccttttgttgatggtgggattgtaaagggacaaaattttcattttatttcaacagattcaaggatatacaaacttttgaatttttatcaggtttaaaacttgagatatttgatcggtc

SEQ ID NO: 19755 - DNA, 1701 bp, Panicum virgatum
  misc_feature: Ceres CLONE 1806742
  misc_feature: Encodes the peptide sequence at SEQ ID NO. 19756
cccaaagtcccccactccaccctgccgaggctcgcgacgcctctgcaactgctaccgcagccccacgccccaaaccctagccccctccaccgccaccgccatggccgacttatccgctgccgccgtcaccgccgtggaggtcggggagcccgattcgctgcccccgccggtcgcagaggaggctgatgccgccgcggcggaggaggccgcggcggccgcgaagaagtggccaggttggcccggggacagcgtgttccggctcgtggttccggtgctcaaggtcgggagcatcatcgggcgtaagggcgagctcatcaagcgcctcgtcgaggagactaaggccagggtccgcatcctggaggggcccgtcggagcaaccgagcgcattgtcctggtgtctggaaaagaagatccaagcttggagcttcctccagctatcgatgctctagtgagagtttttaaacgtgtcattggaatagcagatggagctgctgatggcactcaggcagctgctgcacctggtgtatgtgctgcccgactgctggttcctggagctcaagctattaacctaattgggaagcaaggtgccacaatcaagtcaattcaggagagcactggtgctacaatccgggttatatcagtagatgaacgagagcggccattctatgtaactgatgatgaaaggatagttgagatacaaggtgaaacaaagaaagttctaaaagcacttcaagcagtttctaaccatcttcggaagtttttggttgaccatagtgtactcccattatttgaaaagactaatactacagtgagccaagatcgcagcggtgatggttggagtgatatgtcacatcctcctattggttctgcacaagtaaatcaaccacctccggtagttgacgaatatattcttccagcgaagagggacactttgtatcttgaacgagaacctctagtagatcatagcattcatcgctcaggagtgtcactttatgggcgtgatcctgccttgtcaacattacgaccctctgggatgcatggtgctgggcctctacttacacagataactcaaaccatgcaaatcccacttacctatgcagaggacattataggagtcaaaggagcaaatattgcgtacatacgagctaatagtggggctgttgtgacaattcaggagagtttgggcagccctgatgatattactgttgaaataaaggggacgtcttcacaagtacaagctgcccaacagctcatccaggactccttagctgcacaccgagaacctgtcagaagcagctatgtgggagcaggattagatccagtgtacaggcccagctactcacaatatggcagctccacttattcgtcgtcatcgctgccatcttattctagcattgatgatggtagatatccatcttcaggcatgggtggctatgggtcaagttaccggtactagtagcagttcatcgttaggaatgcatcctgtatttgttcctgaatgatcagtacaagttggcaagtttcctgctgaccctgtgcttccgggtgggaatccggtagatcgtattgtatctctgtacgcatttcagggtatgctatgctctgttagagtgacaaacagacagtaggttctcgtcgatggaattgaaatctgtactggcttcccgtggtttaacggtgcctgtttttggtgaactgcag

SEQ ID NO: 19756 - protein, 451 aa, Panicum virgatum
  misc_feature: Ceres CLONE 1806742
  misc_feature (323)..(385): Pfam Name: KH_1 Pfam Description: KH domain
  misc_feature (144)..(213): Pfam Name: KH_1 Pfam Description: KH domain
  misc_feature (51)..(113): Pfam Name: KH_1 Pfam Description: KH domain
MADLSAAAVTAVEVGEPDSLPPPVAEEADAAAAEEAAAAAKKWPGWPGDSVFRLVVPVLKVGSIIGRKGELIKRLVEETKARVRILEGPVGATERIVLVSGKEDPSLELPPAIDALVRVFKRVIGIADGAADGTQAAAAPGVCAARLLVPGAQAINLIGKQGATIKSIQESTGATIRVISVDERERPFYVTDDERIVEIQGETKKVLKALQAVSNHLRKFLVDHSVLPLFEKTNTTVSQDRSGDGWSDMSHPPIGSAQVNQPPPVVDEYILPAKRDTLYLEREPLVDHSIHRSGVSLYGRDPALSTLRPSGMHGAGPLLTQITQTMQIPLTYAEDIIGVKGANIAYIRANSGAVVTIQESLGSPDDITVEIKGTSSQVQAAQQLIQDSLAAHREPVRSSYVGAGLDPVYRPSYSQYGSSTYSSSSLPSYSSIDDGRYPSSGMGGYGSSYRY

SEQ ID NO: 19757 - DNA, 2460 bp, Panicum virgatum
  misc_feature: Ceres CLONE 1806749
  misc_feature: Encodes the peptide sequence at SEQ ID NO. 19758
atctctttcttatcgaccgacgctgtggccgccgagccgcccacgtcgcccctctccccaaccccaccccccgacctctctccttcggcgagataatccccacgcaaccgcgcaccgggagcctgaacaagcggagggggagctcgaaaaatctgcgccccctacgcctcgccagtgtgctcgcctacttatacactccgcccgctccctccgtcccctagttcctcggcttccccctcctccaggctccggctccggtccacacgcacagtgagcaaagatggtgccgccatctatgagccttgcttcaaaggcggtgcttcccttctcagtacttacttcaagcggcgttacgcaaaggccggtgtcagtgactgcttccttggagaacaagacgagtgatggcagaaggaagttccttaaacttgcgcttgggaaccttggagttgggctgcccaccctgttgggtgctaagaaagctcttgctgatgagcagggtgtctcttcctcaaggatgtcttactcgaggttccttgagtatcttgacaaggacagagtgaagaaggttgatttgtttgagaatggaacaattgctatcgtggaggccatctctcctgagctcggcaatcgtgtgcagagagtccgtgtgcagcttccaggtctaagccaggagcttcttcagaagttgagggaaaagaacattgacttcgccgcacacagcaaccaggaggactctggttcccttctgttcaaccttatcggaaatttggcattcccccttatcctcattggtggtctatttttgctgtcaagaagggcacaaggtggccttggtggacccaatggtcctggctttccccttggttttggtcaatctagggccaagtttcagatggaacccaacactggtgttacatttgatgatgttgctggcgttgatgaagcaaagcaagacttcatggaagtggtcgagttcttgaagaagcctgaaagattcactgctgttggtgctcgcattcctaaaggtgttcttcttgttggtccacctggaactggtaaaactttgcttgccaaggcaattgctggagaggcgggtgtgccatttttctcaatttcgggctctgagtttgtggagatgtttgttggtgttggtgcttctcgagtccgtgatcttttcaagaaggcaaaggagaatgctccttgcatagtgtttgttgatgaaattgatgctgttggtaggcaaagaggtacaggtattggtggtggaaatgatgaaagggagcagactcttaaccaactgttgactgagatggatggttttgagggaaacactggaattattgttattgctgccactaaccgagctgacatattggattctgctttacttaggcctggacgctttgacagacaggtgtctgtcgatgttcctgatgtacgtggaaggacagagattctgaaagtgcacggtggcaacaagaagtttgatcctgatgtttctcttgatgtcatagcaatgagaacccctgggttcagtggagcagacttggcaaaccttctgaatgaagcagccatactggcaggccgacgtgggaggacagcaatttcttcaaaagagattgatgattcaattgacagaatagtggctggcatggaaggaactgtgatgacagatgggaagagcaaaagtcttgttgcttaccatgaagttgggcatgcgatttgcggaactttgacacctggccatgatcccgtccaaaaggttaccttagttccaaggggtcaagctcgcggtcttacatggtttatcccgatggatgacccaacgctgatctccaggcagcaactctttgccagaattgttggtggtcttggtggtagagctgccgaggaggtcatatttggagagcctgaggtgacaacgggagcagctggtgacttgcagcaaatcaccggcttagccaagcagatggtcgtaactttcggtatgtcagagatcggcccatggtctctgatggagggtggagcacagagtggggatgtcataatgagaatgatggcaaggaactccatgtcggagaagctcgcggaggacattgattcggctgtgaagcggttgtcagatgaggcctatgagatcgctttgagccacattaggaacaacagggaagcgattgacaagatcgttgaggtgctcattgagaaggaaacattgaccggagatgagttccgagcaattctttccgagtttgtggagatccctgtcgagaacagggttcccccagccacaccggcggcagctctccctgcctaaattcttagttttgtaggggaaatttgttgttgtaagatgttcatattttggattcttggtgtacactaactctacttcaccagccggatttttggtacactacatgtaacttactcatggtgaattatagtaactgtaattagctt

SEQ ID NO: 19758 - protein, 677 aa, Panicum virgatum
  misc_feature: Ceres CLONE 1806749
  misc_feature (443)..(653): Pfam Name: Peptidase_M41 Pfam Description: Peptidase family M41
  misc_feature (249)..(436): Pfam Name: AAA Pfam Description: ATPase family associated with various cellular activities (AAA)
  misc_feature (77)..(223): Pfam Name: FtsH_ext Pfam Description: FtsH Extracellular
  misc_feature: SWISSPROT Homolog: EC 3.6.4.3 Microtubule-severing ATPase
MVPPSMSLASKAVLPFSVLTSSGVTQRPVSVTASLENKTSDGRRKFLKLALGNLGVGLPTLLGAKKALADEQGVSSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGGNKKFDPDVSLDVIAMRTPGFSGADLANLLNEAAILAGRRGRTAISSKEIDDSIDRIVAGMEGTVMTDGKSKSLVAYHEVGHAICGTLTPGHDPVQKVTLVPRGQARGLTWFIPMDDPTLISRQQLFARIVGGLGGRAAEEVIFGEPEVTTGAAGDLQQITGLAKQMVVTFGMSEIGPWSLMEGGAQSGDVIMRMMARNSMSEKLAEDIDSAVKRLSDEAYEIALSHIRNNREAIDKIVEVLIEKETLTGDEFRAILSEFVEIPVENRVPPATPAAALPA

SEQ ID NO: 19759 - DNA, 2336 bp, Panicum virgatum
  misc_feature: Ceres CLONE 1806756
  misc_feature: Encodes the peptide sequence at SEQ ID NO. 19760
aagactcgttcccaccgcaccggtggccgcatctgacttgcgttctctcttctacaggaaacaggatgcagctactaggctagctcctcctaaaatcctcttcgtccgccgccgcgatccgcacaagctccacacgcaacctcgtcgaccattcaagtcaattaccagcttgatttctttacaattttcgcggggcgaagaagcagctggtaatcaatcagtagacaggcatgccgagaagccccggcaggcgtccgggcctcggcggcggtgagggggacttcttcgccgggcgctcgatcgggcccacgtgcgagcggaacccggcggtgaccacggcatcgtgcacgcaccagtggaagggcggctgacgcatggccgcggccgccgcctcgcactcggggcacgccggccgcggcgaccacatcgccgggtcctccagctccggcaccagcgggaggaggtacggatccgccgccgcggcggtgctcatgaggtaccagtcgcgctgccgctgcagctgcgcctcgtagtcccagccgccgagcatggcggcgggggccaccatggacgccagatccgtgggcgggaggcgcttgaggatggtcttctcaggcgggggagcggcgtccgcggcggaggccttgtgcttgtcgcggcgggcgcggccgccccggcgcgcgcggcggagggacgcgaggacgtagcagccggcgccctcgcgcgcggcggcggcggcgaggtcggccccctcgtcgaggggcacgcggcgcgcgcgccggggccgcgcgagcacggccgagatctggtgcggcgcgacgccgacgcggtcggccacgacggcctgcagcttcttgacggcgagcgacgggtgcacggtgacggtgccgaggtcgacggtgcggtcgccgtcgacgaagagcaccggcaggacggcggggggcgggggcgagggcgccgcggcgaggtccgccatctcgatctctcgagttcagcaggcgattgttggcagggcggaggccacaagcatcgaatcgaatcgaacccaatccaatccaaccggggggcgggttaattagtactagaggggaacaagagagaaaggccgcgagagggtttggttttatagcgaggagttaaggcggttcggtaatttgggcggtgaggtgtgcgagagaagacaagggcaagagaaccggtctgtcctcctcctggctttccttggcaaccaaggcagcgacctgcagcgcggggcccacccacccagccccgttgtccggcgtgggacttgcaacagtggaggagaacgtgggagggacggcccgggccggagaaaaggaaacgggatactagtagatttttcgccggggtttcatttagcaggaggagcccacgggccacgggccgactaatcttcttggtggtccatagaacaaggtccgagaggaggagcccacgggccacgggccgctgaattggagggctgacactttgggcccgccctccattaatccatgttccatggtcctgcaccacccccgactgcgatggtggtggccgccgcatctgcacgctgcttggtcatcgttccccacagccgccccgccgccgcgctccgccttccacgacgaatcaccaggcccccgctctcctgctcgacctctgcctcgccgctcgtcaccgtcgcatccatggacgcgccgccgcagggctaccgcaccaacgtcggcatctgcctcgccaacccctccctcaccaagattttctcggcttctaggatcgacattcctagcgcgtggcagatgcctcagggtggtatcgatgcaggggaagaaccgagagcagctgctattagggaattgagagaagaaactggcgtcacatctgcagagatcgtggctgaggctcctaactggttaacacatgatttcccgccggatgtgagagaaaaactgaatgctaggtggggaacagattggaaaggccaggctcaaaaatggtttttatttagatttactggaaatgatgatgagattaaccttaatggtgatggatctgagaagccagaatttgctgaatggacatggatgacaccccaggaagttattgaaaaggcagttgagttcaaaaaacctgtatatgaggaagcactgaaacactttaccccctatctacagtcagatccaactccttcatcttagattcaaccagtttgcatatatttatttttatttggagctaccctgttgtaccgaaaccccaataatttgtcatgatgtgatggaggtatgctagtattttataatggatggcctattgtggtcaattattatgtc

SEQ ID NO: 19760 - protein, 169 aa, Panicum virgatum
  misc_feature: Ceres CLONE 1806756
  misc_feature (8)..(156): Pfam Name: NUDIX Pfam Description: NUDIX domain
  misc_feature: SWISSPROT Homolog: EC 3.6.1.52 Diphosphoinositol-polyphosphate diphosphatase
MDAPPQGYRTNVGICLANPSLTKIFSASRIDIPSAWQMPQGGIDAGEEPRAAAIRELREETGVTSAEIVAEAPNWLTHDFPPDVREKLNARWGTDWKGQAQKWFLFRFTGNDDEINLNGDGSEKPEFAEWTWMTPQEVIEKAVEFKKPVYEEALKHFTPYLQSDPTPSS

SEQ ID NO: 19761 - DNA, 1277 bp, Panicum virgatum
  misc_feature: Ceres CLONE 1806761
  misc_feature: Encodes the peptide sequence at SEQ ID NO. 19762
atgcgattccgcccccagctcatcttctcctcactcccccgctccatccctaaacccagaaccccgcccgccgcaaccctagccgccgccgccgccgcgcgccgccgacaccacaccaccgtcgtcgccacctccatggccgcgacgtcggaggacgcgctgcggcgcgcgctcgccgagcgccaggccgccgtggacgcgcaggccgaggccgtgcgcgcgctcaaggccggcggcggcgcgtccaaggccgatgtggacgcggcggtcgaggcgctgaaggcgctcaaggtcgaggccggcgccgccgcgcgccggctgcagcaggccgtcggggcgggcgcgggcggcgccgcgagggaggagctgcggcaggccgtggtgaacaccctggagcggaagctgttctacataccctcgtttaagatctaccgcggggtggcggggctctacgactacgggccgcctgggtgccgcgtcaaggcaaatgttctttccttctggcgccagcactttgttctggaagagaacatgttggaggttgactgcccctgtgtcacacctgagatcgttctgaaggcatcaggccatgttgagaagtttactgacctcatggttaaagatgagaagacaggcacatgctaccgtgctgatcacttgttgaaagatttttgcaaggagaagcttgagaaagaccttaccttgccccaagaaaaggctgatgaatttaagcgtgttcttgccatcttggatgacctctcagcagaggagcttggtgcaaagattaaggaatatggcatcgttgcccctgatacaaagaacccgctttctgatccctatccatttaatcttatgttccagacatctattgggcccactggtctaagcgtggggtatatgcgacctgagactgcgcagggcatttttgtaaacttcaaggacctttactactacaatggccaaaagcttccctttgcagcagctcaaattgggcaggcttttagaaatgagatctcaccacgacaaggtcttctccgagtgcgtgaattcacattggcagagattgagcattttgtggacccagaggataaatcacacccaaagttcgttgatgttgctgatttggagttcttgatgttcccaagagagctgcaactctcaggggagtcagccaagttaatgaagcttggggatgcagttttcaagggaactgttaataacgagacacttggttacttcattggaagggtctattcttttctgacacgcttgggaat

SEQ ID NO: 19762 - protein, 380 aa, Panicum virgatum
  misc_feature: Ceres CLONE 1806761
  misc_feature (115)..(367): Pfam Name: tRNA-synt_2b Pfam Description: tRNA synthetase class II core domain (G, H, P, S and T)
  misc_feature: SWISSPROT Homolog: EC 6.1.1.14 Glycine--tRNA ligase
MAATSEDALRRALAERQAAVDAQAEAVRALKAGGGASKADVDAAVEALKALKVEAGAAARRLQQAVGAGAGGAAREELRQAVVNTLERKLFYIPSFKIYRGVAGLYDYGPPGCRVKANVLSFWRQHFVLEENMLEVDCPCVTPEIVLKASGHVEKFTDLMVKDEKTGTCYRADHLLKDFCKEKLEKDLTLPQEKADEFKRVLAILDDLSAEELGAKIKEYGIVAPDTKNPLSDPYPFNLMFQTSIGPTGLSVGYMRPETAQGIFVNFKDLYYYNGQKLPFAAAQIGQAFRNEISPRQGLLRVREFTLAEIEHFVDPEDKSHPKFVDVADLEFLMFPRELQLSGESAKLMKLGDAVFKGTVNNETLGYFIGRVYSFLTRLG

SEQ ID NO: 19763 - DNA, 617 bp, Panicum virgatum
  misc_feature: Ceres CLONE 1806761-R
  misc_feature: Encodes the peptide sequence at SEQ ID NO. 19764
ctactgctatatccattgggaggcggtatgcgaggacagatgagattggtgttccatttgctgtaacagttgattccacaacaaacgtgactatccgggagagggacagtaaagaacagatccgggtggacatcaacgaggtcgcatccgtggtgaagcaactgacagaaggccaaagcacctgggctgatgtttctgcaaagtatcccgcccatgttggcccccaaggtgaccaggagtgaattctggccaaccaccaacatgtccagccatcgcttaagaagtgttcatcattctccaattgcccagaatctgactagctaaacacagccagttttggtattgacggaatccagcaaggcagtttccccctcatacatacatgatacctgctatagcggttggatgaaatgaaacttgcatatttccccattgtttttgctccttttaaaggtcgttttcttgatatgtggcctgacccatacaaaacttgaccatttgagttacttctcaaccgaaagcccttgtaaggtcatactgagaattgttcagctacttacctcagtacttgtcccggttctcagttggtatggattgaaatttcagttacttgtccc

SEQ ID NO: 19764 - protein, 79 aa, Panicum virgatum
  misc_feature: Ceres CLONE 1806761-R
  misc_feature: SWISSPROT Homolog: EC 6.1.1.14 Glycine--tRNA ligase
TAISIGRRYARTDEIGVPFAVTVDSTTNVTIRERDSKEQIRVDINEVASVVKQLTEGQSTWADVSAKYPAHVGPQGDQE

SEQ ID NO: 19765 - DNA, 2607 bp, Panicum virgatum
  misc_feature: Ceres CLONE 1806769
  misc_feature: Encodes the peptide sequence at SEQ ID NO. 19766
atccggaagcccacgctgctttctctgctctgctcggctcggctcccccacccgccgccgcgccatggccgccatggcgccctcctcctccgccccctcgctccccgcccgcctcccccgcagagtgcacgcccgcctgctaggccgcaaggccccgcccgcctccgtcccgcgcccgctcctcctctcgttccccgggctccgcgctccagccgcgcagcaacgctccgccgagtgccagtttggcgaagatgacggcgaggatgaggaggagtacgggtatgacggcgaggaggatgatgatgaagacgaggtggaggaggagatggacgtggaggccatggaggaggaggcgcgcggcgccgccgccgacctcgccgagcgcctcgcccgggagctccacatcgatgatgatgtccgggagaaacgaaaaaacatcagggaatccgtgtctaaacatatcccagatagtcttcttccaaaggtggcaattattgggaggccaaatgttggtaaatctgcattgttcaaccgtcttgttgggggaaacagggctatcgttgttgatgaacctggtgtgacaagagatcgcttgtatggacgatcttattggggtgatcaggagttcatggttattgatactggtggggtaattactttatcaaagtctcaggcgggtgtcatggaagaacttgctgtcaccactactgttggtatggacgggattcctctcgccactagagaagctgctattgcgaggatgccatcaatgattgaaaaacaagcagttgcagctgttgatgaagcagccgtcgtactattcgtcgtggatggtcaggctggtcttgtggcagctgatatagagatttctgattggttacgacgcaactactctgacaagtgtgttatacttgctgtcaataagtgtgaatctccacggaaagggcaaatgcaagcattagatttttggtcactagggttttctcccctgccaatttctgctattactggcacaggaaccggagatctccttgatctggtgtgtgcagagctgagaaaatttgagggattggatggagttgaagaagagaaaaataaggttcctgctattgccattgtgggaagaccaaatgtggggaaaagtagtattctaaatgctttggttggagaagatagaactatcgtgagcccagttagtgggacaacacgtgatgctatcgatactgagtttagtacagcagatggagagaagtacaaactcattgacactgctgggatccgacgccgggcagcagttgtttctgctggcagcacaaccgaatcactttcggtaaaacgtgcatttcgagcaattcgccgctctgatgtggttgcccttgttattgaagcgatggcctgtgttacagagcaggattataaaattgcagagaggattgagaaagaaggaaaggcttgtgtcattgttgtgaataaatgggatacaatcccaaacaagaaccatgagagtacgacacattatgagcaagatgtaagagaaaagcttcgcatacttgattgggcacctattgtctactgttctgcgacaaatggaaccagtgttgaaaagataatttctgctgctgctttggttgagaaggaaaggtctagaagactcggtacctctattcttaatcaagttgtcagagaagctatagcattcaaaccaccaccacggacaagaggtggcaaaagaggtcgtgtatattacacaacacaggctgccgtgggtccaccgacatttgttctatttgtgaatgatgcgaagctcttttctgatacataccgccgttacatggaaaagaaactccggtcagatgctggatttccaggcacccctattcggttactatggcgcagcaggaggcggccggacaaacgaggtaaatctgcagatagtaagttgcagagcccaggagctcctagcagaatggttgtagctgcctgatcgagcaacctccatagactccgttcggatttgagtatgtagccgtggctgatgcaatacacgcggagtggagtttgagattcagaaatgaacttttgcgacttcgaactgtcagagtgggaggagatgccctagtgctgaagtggcagcggatgatgatgaggaagatagtattatacggaaggaaactagtggaaaagagtatggtggacacatctgatgcagcacaaggtcatcacggccgagggtcccaagtcttgaaaacggatgatagatggatggtgcggcgtgtcttgaaaacggatgatagatggatggtttcggctggatatgcgtatgtagtcgacgtcatccgtgttatctttatagaaaaatggcagagatcgatcgagttgggtgctttcagttgagcccaccccatgggcgttaggcacgtccgcacgagccgtgccggccacgcgctaccaagctgggaatattagaccaatctcagtgtcagaggagtattatgatgataattcttctcttattctaaaaaactctctccactcataaataattctgtcatgtttgcaaatttgatgatgtgatatgatatttaatgcttatggcgttcttatagt

SEQ ID NO: 19766 - protein, 639 aa, Panicum virgatum
  misc_feature: Ceres CLONE 1806769
  misc_feature (139)..(289): Pfam Name: MMR_HSR1 Pfam Description: GTPase of unknown function
  misc_feature (347)..(472): Pfam Name: MMR_HSR1 Pfam Description: GTPase of unknown function
  misc_feature: SWISSPROT Homolog: EC 2.7.4.8 Guanylate kinase
MAAMAPSSSAPSLPARLPRRVHARLLGRKAPPASVPRPLLLSFPGLRAPAAQQRSAECQFGEDDGEDEEEYGYDGEEDDDEDEVEEEMDVEAMEEEARGAAADLAERLARELHIDDDVREKRKNIRESVSKHIPDSLLPKVAIIGRPNVGKSALFNRLVGGNRAIVVDEPGVTRDRLYGRSYWGDQEFMVIDTGGVITLSKSQAGVMEELAVTTTVGMDGIPLATREAAIARMPSMIEKQAVAAVDEAAVVLFVVDGQAGLVAADIEISDWLRRNYSDKCVILAVNKCESPRKGQMQALDFWSLGFSPLPISAITGTGTGDLLDLVCAELRKFEGLDGVEEEKNKVPAIAIVGRPNVGKSSILNALVGEDRTIVSPVSGTTRDAIDTEFSTADGEKYKLIDTAGIRRRAAVVSAGSTTESLSVKRAFRAIRRSDVVALVIEAMACVTEQDYKIAERIEKEGKACVIVVNKWDTIPNKNHESTTHYEQDVREKLRILDWAPIVYCSATNGTSVEKIISAAALVEKERSRRLGTSILNQVVREAIAFKPPPRTRGGKRGRVYYTTQAAVGPPTFVLFVNDAKLFSDTYRRYMEKKLRSDAGFPGTPIRLLWRSRRRPDKRGKSADSKLQSPGAPSRMVVAA

SEQ ID NO: 19767 - DNA, 2569 bp, Panicum virgatum
  misc_feature: Ceres CLONE 1806781
  misc_feature: Encodes the peptide sequence at SEQ ID NO. 19768
accaccgcctgcctccgcctccacattccccatccccaccacatcacacatctgccccccacaccaacccgaaccctagccagcgtcccggtcgcggtgccagccaccgcgcgccgcagcgtcggtctcccccctcctcagcttcagagcttctccacgagatcggcggcggaatctcaggaggtggtggcggcggcggggccctggggctccatggctgaggatgcctgtgctgcgtagcgcggtgcggagggcccgagaggcgcaggggagtccggcggcggcggcgggagctccggaggcggcagcaccggcaccggtgccaccgccagcagacacgaggcggagggcgacgagggccgccgcaagaacggaagagagggagcgggaggagatcaggcccgcggaggtcgtcgcgggggaaggcggcggcgacggagacgagggggagcgtgggatgggtgacccggacagcggggggcgcagcgccgacaagctggtagccgatgacgagggcggccctcctgtccctgacacggtccaggtgggcaattcaccaaagtatagagtggacagaaagcttgggaaaggaggttttggccaagtatatgttggccaccgcatgtcagctactggtcctggtgcagttgaggtggcattgaagtttgagcataggaccagtaaaggatgtaactatgcccctccttatgagtgggcagtctacaatgccgttggtggcattcatggggttcctcgagtccactacaaaggacgccaaggggagttctatgttatggttatggatatgcttggacccagtctatgggatgtttggaataataactctcacacaatgtcagttgagatggttgcttgcatcgctattgaagctatctccatacttgagaaaatgcattcaaaagggtatgttcatggggatgtcaaaccagaaaatttcttgctagggactgcagggacacctgaagaaaaaaaactcttccttgttgatcttggattagctacgaagtggaaggacagtgcgacaggactccatgttgactacgatcaacgacctgatgttttcaggggaacagttcgctatgctagtgttcatgcacatcttgggagaacaggtagcaggagagatgatttagaatctctagcatatacactagtctttcttctacgaggacgtctaccttggcaaggttatcagggtgaaaacaaaggcttccttgtctgcaagaagaaaatggccacatctccagaatctctctgttgcttctgcccacaacccttcagggagtttgtagagtatgtggtcaacttgaagtttgacgaggaacccaactatgcaaagtatgtgtcgctttttgatagtgtagtgggcccaaacccagatatcaggccacttaacactgatggtgctcagaagcttatacatcaagttggccaaaagagagggcgtttattgatagaggaagaggcagatgaacaaccaaagaagaagatcaggatgggaatgcccgcaacacagtggataagtgtttataatgctaggcggcctatgaaacaaaggtaccattacaatgttgcagattcaaggcttgtacagcatattgaaaaagggaatgaagatggcctctttatcagttgcataacatcttgctccaatctctgggctctaatcatggatgctggcactggattcagttctcaagtttatgagcttacaccgcatttccttcacaaagaatggataatggaccagtgggagaggaactactatataactgcacttgctggagcaaacaatggcagctccctggtagtgatgtctaaaggcacaacgtatactcaacagtcttacaaagttagtgatacttttccctacaaatggataaacaagaaatggcgagatggtttctatgttacttccatggcaactgctggaagtagatgggcagttgtcatgtctcgtaatgcaggtttttctgagcaggttgttgaactggacttcttgtatcccagtgagggaattcataagaggtggggctatggttaccggataaccgcgactgctgcaacttgggatcaggctgcatttgttttaagtgtgccaaggagacggcctactgatgaaacccaagagacattgaggacgtctgcgtttcctagtcaacacgttaaggagaaatggtccaagaatctctacctagcatcagtatgctatgggcgtactgtatcctaggaatcttttcgcgcggtttggagccattttgtgccgagtcctgtcggcgtattcttttggtctagctagctcagtgtagcagctcctatgtgcggtctagttctgaatgcgactcagccttaccctgaccgttgttgcgcggctcattgttcccgattatagagtagcatgtacagtagtaaatgttttttttagttcgtgttagttgttaatttagccaactattagctgtagtgtaaggcttgccagatatgtacacctgaccagtttggtcaccgactgcccggagtgaaaatgcaaatatgactgtctttattc

SEQ ID NO: 19768 - protein, 675 aa, Panicum virgatum
  misc_feature: Ceres CLONE 1806781
  misc_feature (114)..(384): Pfam Name: Pkinase Pfam Description: Protein kinase domain
  misc_feature: SWISSPROT Homolog: EC 2.7.11.1 Non-specific serine/threonine protein kinase
MPVLRSAVRRAREAQGSPAAAAGAPEAAAPAPVPPPADTRRRATRAAARTEEREREEIRPAEVVAGEGGGDGDEGERGMGDPDSGGRSADKLVADDEGGPPVPDTVQVGNSPKYRVDRKLGKGGFGQVYVGHRMSATGPGAVEVALKFEHRTSKGCNYAPPYEWAVYNAVGGIHGVPRVHYKGRQGEFYVMVMDMLGPSLWDVWNNNSHTMSVEMVACIAIEAISILEKMHSKGYVHGDVKPENFLLGTAGTPEEKKLFLVDLGLATKWKDSATGLHVDYDQRPDVFRGTVRYASVHAHLGRTGSRRDDLESLAYTLVFLLRGRLPWQGYQGENKGFLVCKKKMATSPESLCCFCPQPFREFVEYVVNLKFDEEPNYAKYVSLFDSVVGPNPDIRPLNTDGAQKLIHQVGQKRGRLLIEEEADEQPKKKIRMGMPATQWISVYNARRPMKQRYHYNVADSRLVQHIEKGNEDGLFISCITSCSNLWALIMDAGTGFSSQVYELTPHFLHKEWIMDQWERNYYITALAGANNGSSLVVMSKGTTYTQQSYKVSDTFPYKWINKKWRDGFYVTSMATAGSRWAVVMSRNAGFSEQVVELDFLYPSEGIHKRWGYGYRITATAATWDQAAFVLSVPRRRPTDETQETLRTSAFPSQHVKEKWSKNLYLASVCYGRTVS

SEQ ID NO: 19769 - DNA, 614 bp, Panicum virgatum
  misc_feature: Ceres CLONE 1806801-R
  misc_feature: Encodes the peptide sequence at SEQ ID NO. 19770
gttcaagattttatgtgtttccaatactctggaagtgttgaggatggtttcccaactatcaccttccattttgaggacgatctcgcactgcatgtctatccacatgagtactttttcccaaatgggaatgacatatactgcgtgggatttcaaaatggtgcattacaatcaaaggatggaaaggacattgtgcttttgggagatcttgttctttcaaacaagttagttgtctatgacttggaaaatcaagtcatcgggtggaccgtctacaactgttcatcgagcattaacattaaggatgacaagacaggcgcaacatataccgtcaattcacacaatatctcctccggatggagattccactggcacaagtccgtggttctgttgttggtaacagttttatgcagctatttaatatgctaactctgttgtacaacacgaacacggacccactgatggaaattcatttgattcatattcttttcacgaaagaaaaggaaatgtaggcccttagactgttgttgtttgaccacggaaaacattgaaaacagaaacattgtacactacaatgttagcctttgtatgattagtgtaatgctgaagtggtttcccat

SEQ ID NO: 19770 - protein, 140 aa, Panicum virgatum
  misc_feature: Ceres CLONE 1806801-R
  misc_feature: SWISSPROT Homolog: EC 3.4.23.12 Nepenthesin
VQDFMCFQYSGSVEDGFPTITFHFEDDLALHVYPHEYFFPNGNDIYCVGFQNGALQSKDGKDIVLLGDLVLSNKLVVYDLENQVIGWTVYNCSSSINIKDDKTGATYTVNSHNISSGWRFHWHKSVVLLLVTVLCSYLIC

SEQ ID NO: 19771 - DNA, 314 bp, Panicum virgatum
  misc_feature: Ceres CLONE 1806801
acgacacgagcgctcgtctcgtcgcacccgaaatgcggcgccgcgcgccgccgccgccgcccagagccccatcccgcctccccggcggcactcgtcggctaggggggttccgagcggcgagccgcagaccctcgaggttctgcgggcgcggggtgcgactccagcgaagggatcaggctgttgcctgctcggcggggacggggaggagtcattccccctgcctcctgcaataattatttgcatgcgcgcaggtttatgttggttttgaattacgccattcaccctgccggcgaccaataaccgatggccccgcg

SEQ ID NO: 19772 - DNA, 2519 bp, Panicum virgatum
  misc_feature: Ceres CLONE 1806811
  misc_feature: Encodes the peptide sequence at SEQ ID NO. 19773
gggcgagtcttgccgtctcgggccaacccgaaccccaaggctcgcgaccgcgacactttcctgtctcctccgcctccctcctcagatctcgccgccggcggacatgctcccctcctccagcggcgcccgcgcccgcggtctcctgctcggcctcgccctcgccctcgcgtccctgctcgcccccgcctccgcctccgagtccgaccacaagtacaaagcggaggagccagttaagctctgggtgaataaagttggtccttataataatcctcaagaaacttacaactattacagccttccattttgtcaaccatctgagaaccccatacataaatggggtggtcttggagaggtcctgggtggaaatgagctgattgatagccagcttgagatgaagttcttaagaaatgaggagaagggcttcatttgtacacttgagctggattctaaaaaggttcagcagtttgctgatgccattgagaactcatattggtttgaatttttcatagacgatctgcctctttggggttttgttggggagactgacaagaacagtgaaaacaagcattatctatacacacacaagaacatccttgttaagtacaatgagaacaggataattcatgtaaatctcacccaagagtctcctaaacttcttgaagttggtaagaaattggatatgacatattcagtgaagtgggtagcaacagatgtgtcatttgcacgtcgttttgaagtgtacctggactatcctttctttgaacaccagattcactggttctccattttcaactcttttatgatggttattttcctaactggtttggtttcgatgatattgatgcggactttgagaaacgattatgccaaatatgctcgtgaagatgatgatctggagtccctggagagagatgttaacgaggaatcaggatggaagcttgtccatggtgacgtatttcggcctccccgaagtttgatgtttctttctgcacttgttggaattggcacccagctggcagctcttatcctacttgtgattgtgttggccatcgttggcatgttatacattgggtatgctcaacatacaccgcccttaaccttctccttgcatgcagaacatataacttgaaatatctgagagtagccacaatccatctccattggaagaacatgtctctctaacttcaattgtatggtgtttgtcaggcgaggtgctatcatcacaacatttattgtgtgctatgctcttacatcgttcatttctggatatgttagtgggggtctttactcgaggaatggtggtatggttctaccaattttctaccaattttctattcgttgtactgtttctttgcacacttcttttctttgcagtatctgttcacatcctattccttcatgttgttcttctctctattaaaaatactttactcacctcaatcatggcttatcaaatgcacttcttgaatccatgacaggcaaaaactggattaaagctatggtccttacagcatccctctttccgttgctgtgtttttcaattggcttcgcactgaacacaattgctatcttctaccgctcattagcagcaataccatttgggacgatggttgtcatgtttgtactttgggctttcatctcctttcccttggtgcttttggggactgttgttggtaggaactggagtggtgctcctaacaacccctgccgtgtaaagactattccacggcctattcctgagaagaagtggtaccttacaccttctgtcatctcgttgatgggtgggctgcttccctttggcagcatcttcattgagatgtactttgtgttcacatcattctggaactacaaggtgtattatgtctatggtttcatgttgctggtcttcatcatccttctaatagtcaccatctgcgtcactatcgtgggtacctatttcttgctgaatgctgagaactatcattggcagtggacttcgtttttctctgcagcatcaactgctttgtacgtgtacctatactccatctactactaccatgtgaagacaaagatgtcaggcttcttccagacaagtttctactttggctacacattgatgttctgccttggtctaggcattctttgcggtgctattgggtatttagggtcaaccctgtttgtaaggagaatctacagaaatatcaaatgtgattaaattcctgctactcactagcagcagagagatcatatgtattcagtgcggaagcaaggcctcaagatagattgatggtagatcctgaataggtttttgaaactacagaggacatgctccctttgttcactatcatacgcatttttgcttgcctgcttattcctgtggaatcgtcatcatattgtatacctatgtagttgaggattagtctaaagcaacggtttttattcttttctcttttttttagtatttttgtttggtaggatgtaatcagtgaatgttcatgcggcgcgagcacaattgttgggaattttccctcctatgcatc

SEQ ID NO: 19773 - protein, 341 aa, Panicum virgatum
  misc_feature: Ceres CLONE 1806811
  misc_feature (58)..(340): Pfam Name: EMP70 Pfam Description: Endomembrane protein 70
MLPSSSGARARGLLLGLALALASLLAPASASESDHKYKAEEPVKLWVNKVGPYNNPQETYNYYSLPFCQPSENPIHKWGGLGEVLGGNELIDSQLEMKFLRNEEKGFICTLELDSKKVQQFADAIENSYWFEFFIDDLPLWGFVGETDKNSENKHYLYTHKNILVKYNENRIIHVNLTQESPKLLEVGKKLDMTYSVKWVATDVSFARRFEVYLDYPFFEHQIHWFSIFNSFMMVIFLTGLVSMILMRTLRNDYAKYAREDDDLESLERDVNEESGWKLVHGDVFRPPRSLMFLSALVGIGTQLAALILLVIVLAIVGMLYIGYAQHTPPLTFSLHAEHIT

SEQ ID NO: 19774 - DNA, 617 bp, Panicum virgatum
  misc_feature: Ceres CLONE 1806824-R
  misc_feature: Encodes the peptide sequence at SEQ ID NO. 19775
tgagaatgattcagaggcaccacctgcgccagagtactgcatagatgctagttctattggcaattttgcaaggttcataaaccacagctgccaacctaaccttttcgtccaatgcatcttgagctcgcacaatgacgttaagctggcaaaagtaatgctttttgctgctgacactatacttcctcttcaggagctgtcctatgactatggctatcgcttggacagtgttattgggcatgacggagaaattgtgaagctgccttgccactgtggtgctcctgattgccggaaacgcctctactagacctgctgggtgttttcatttggattttggaggaaacaagtactccctccgattttttttaaatgacgttaggacatcaacctttagcttatttgtagtgtaaagttttgtctgaaacgtcaaatattaagatatggaggtagtaatattgtaggaatgcagcagtagtatctgtgtagttgacatgctctgatatatagcaaaagaggagcgacctttagagcattcatattttgtcatatgtagaggacatgcgagcatattctgcaggctatcaatatatatactacatgttcagtcatggtttgattcc

SEQ ID NO: 19775 - protein, 100 aa, Panicum virgatum
  misc_feature: Ceres CLONE 1806824-R
  misc_feature: SWISSPROT Homolog: EC 2.1.1.43 Histone-lysine N-methyltransferase
ENDSEAPPAPEYCIDASSIGNFARFINHSCQPNLFVQCILSSHNDVKLAKVMLFAADTILPLQELSYDYGYRLDSVIGHDGEIVKLPCHCGAPDCRKRLY

SEQ ID NO: 19776 - DNA, 491 bp, Panicum virgatum
  misc_feature: Ceres CLONE 1806824
agtcctccccccgtcccagcgtcttccgccactcccgctaccacggagcgcaggggcacttgcggcatcgtcttctccggcggcgccggaaggttcgaggcgtccggtggaaggcgaagatggactcggtggctatgatggaggtggcgccggtgcctgaccctccattcatctacgccactcccctgcagcctccgccgccgcccgcgccgttggcggcgcttgcgctgcgccgcagcgctctctgccttaacaggcccgtccggtccctctattcggagctggagccgcccaagccgcccagcggccgctgccgtggctagaggaagagggacgaggagaagcaggagcaggctgctgtttttggtgctaagagcccgggaaggaaggtctcctatgctgagcctggggagaggaagccggcgccggtgattgcggcggcgccaatttcttgcgcttggtgctgctcccgctgctgcggaacatgatgg

SEQ ID NO: 19777 - DNA, 2528 bp, Panicum virgatum
  misc_feature: Ceres CLONE 1806866
  misc_feature: Encodes the peptide sequence at SEQ ID NO. 19778
aaaaccatccgcccccccggacaccgcaccaacgggctcgctcgctccagcggcccagcctccgccccctcgccgcacacctccctaaaacccacccgattccgcctaaaccccccaccgcgatcctcgacaattcagcggccgcgatgcagggtctcgccccgcccacctctgtttccatacaccggcgcctgccggccgggtccagggcggcccgggcccccagctcggtgaggttcgcgccgcgcggagtcagctccgtgccgcgcgccgcgcccgccgagtgcctgccgccggcggcgttcaagcccgccgagctgccggcgcccaggaagcacgccgccgccattgccgcgccggcgccggcctcgccgccgcggacggcggggaggaagaaggagctcaacctcttccagcgcgccgcggcggcggcgctcgacgcgttcgaggaggggttcgtggcgggcgtcctcgagcgcccccacggcctgccccggacggccgacccggccgtgcagatcgccggcaacttcgcgcccgtcggggagaggccccccgcccgcgagctccccgtctccggccgcatcccgcccttcatcaacggcgtgtacgcgcgcaacggcgccaacccctgcttcgaccccgtcgccgggcaccacctcttcgacggcgacggcatggtgcacgcgctgcggatacggaacggcgtcgccgagtcctacgcctgccgcttcaccgagaccgcgcgcctgcgccaggagcgcgcgatcggccgccccgtcttcccaaaggccattggcgagctgcacggccactccgggatcgcgcgccttgctctgttctacgcgcgcgccgcgtgcgggctcgtcgatccctcccacggcaccggcgtcgccaacgccggcctcgtctacttcaacgggcacctcctcgccatgtccgaggacgacctcccgtaccacgtgcgcgtcacggacggcggcgacctcgagaccgtcggcagatacgacttcgacggccagcttgggtgcgccatgatcgcgcacccgaagctcgacccggccaccggcgagctccacgcgctcagctacgacgtcatcaagaagccgtacctcaagtacttctacttcaggcccgacggcaccaagtccgacgacgtcgagatcccgctcgaccagcccaccatgatccacgacttcgccatcaccgagaacttcgtcgtcgtgcccgaccaccaggtggtgttcaagctccaggagatgctgcgcggcggctcgcccgtggtgctggacaagtagaagacgtcgcgcttcggcgtgctccccaagcacgccaaggacgcgtcggagatggcgtgggtggacgtgccggactgcttctgcttccacctgtggaacgcgtgggaggacgaggagaccggcgaggtcgtcgtcatcggctcctgcatgacccccgccgactccatcttcaacgagtccgacgagcacctcgagagcgtgctcacggagatccgcctggacacccgcaccggccggtccacgcggcgcgccatcctgccgccgtcgcagcaggtgaacctggaggtgggcatggtgaaccgcaacctcctgggccgcaagacccggtacgcgtacctcgccgtggccgagccgtggcccaaggtgtcgggcttcgccaaggtggacctcgccacgggcgagctgaccaagttcgagtacggcgagggccggttcggcggcgagccctgcttcgtgcccatggaccccgccgccgcgcacccgcgcggcgaggacgacgggtacgtgctcaccttcgtgcacgacgagcgcgccggcacgtcggagctcctggtggtcaatgccgtcgacatgcggctggaggccacggtccagctcccgtcccgcgtgcccttcggcttccacggcaccttcatcacggccagcgagctcgaggcccaggcctgatcgcctgagctcccgttcgctccccacctacctccgcgtttcttggagggggcaggagggcgaggaagaacagaggagacacgagccatggatcaggggagaagtcaccagagggagcctcggccatagtaggtccccggagtcttcgccgtccccgacaccacagttacagcagttggtagttaaatttccaatttttttagtttaattaagagtgtattttagttgggatagtggcagattagagaaaggggcccagctcgtagcttttcagctggtgcttgcttctagagagcagccagagctcagctggtgcctactgctagtatagtctacatttttttttgttcccttttttctttggatcagacagggatatgcttccccgctccagctccagttgttgtcactcctcgcagtggactggagtgtccgggatcttggttgccgctgtttgctcgccattgccgcccagttgccgctgaggtgttgctggcatggtttctctatcactgtgtgtacatttgtcgatagtataataaaaaatagaaaggtcacccacgc

SEQ ID NO: 19778 - protein, 383 aa, Panicum virgatum
  misc_feature: Ceres CLONE 1806866
  misc_feature (105)..(383): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature: Functional homolog of the protein sequence given in SEQ ID NO 50881
  misc_feature: Useful for making plants with modulated water use efficiency
  misc_feature: The sequence is a functional homolog of SEQ ID NO 6 in US patent 7049487
  misc_feature: Functional homolog of the protein sequence given in SEQ ID NO 50875
  misc_feature: Useful for making plants with modulated drought sensitivity
MQGLAPPTSVSIHRRLPAGSRAARAPSSVRFAPRGVSSVPRAAPAECLPPAAFKPAELPAPRKHAAAIAAPAPASPPRTAGRKKELNLFQRAAAAALDAFEEGFVAGVLERPHGLPRTADPAVQIAGNFAPVGERPPARELPVSGRIPPFINGVYARNGANPCFDPVAGHHLFDGDGMVHALRIRNGVAESYACRFTETARLRQERAIGRPVFPKAIGELHGHSGIARLALFYARAACGLVDPSHGTGVANAGLVYFNGHLLAMSEDDLPYHVRVTDGGDLETVGRYDFDGQLGCAMIAHPKLDPATGELHALSYDVIKKPYLKYFYFRPDGTKSDDVEIPLDQPTMIHDFAITENFVVVPDHQVVFKLQEMLRGGSPVVLDK

SEQ ID NO: 19779 - DNA, 1847 bp, Panicum virgatum
  misc_feature: Ceres CLONE 1806872
  misc_feature: Encodes the peptide sequence at SEQ ID NO. 19780
caccacaacctgatactcctctcgcaacaaatccgcggcgccgatcagcgatcggagctgaagcaccatcatccggcgcgcgtgatgtggcccggggacggtccttggccggcgtccgccgtcacggcggcggcgctgctcgtcgccgctgtcatcatcgtgcggcggctcttcatccctcgcctgtggccgtcgtcagggtcagggaccgagcgacggggggcggcgagcggcggcgcgtccggatcggcgcgtctccccgcgggctcgctcgggtggccgctcctcggcgagacgccggcgttcatcctcgcggcgtactccgcccgcccggagtccttcgtcgagcggcggcggctcctgtacgggaaggtgttcgcgtcgcacctgtggggctccccggcggtggtgagctcggacccggaggtgagccgcgcggtgctgcaggccgacgcgtcggcgttcgtaccgtggtacccgcgctcgctcatggagctcatggggcggtcctccatcctggtgctcggcggcgggctccagcgccgggtgcacggcctcgccggcgccttcttcaagtcgccgcacctcaaggcccgggtcaccgccgacatgcgccgccgcgtcgcccgcgccatggccgcgtggcagcgccgcggcgcgcccgtcgtgcgcgtccaggacgaggccaagtcgattgtgtttgaaatcctggtgagggcgctgatagggctagacgaaggacacgaaatgcagtacctcaggcaacagttcaaagaattcattgccggtctgatatcacttccggttaaacttcccgggactcagctctacagatccctcaaggctaagaagaggatgacaacgttgatccaaaagatcatccaggagaagaggaagagaaggatcgccgccgggtgcgatgaggatccgcatgatgggacgactcatcatccgcgcaacatgatcgacgtgctgctgggcaatggcagcgacgagctcaccgacgagctgatatccgacaacatgatcgacttcatgatccctgcggaggactcggtgccggtgctcatcacgctggccgtcaagtacctcagcgagtgcccaccggctctacagcagctggaggaggagaacatggagctgaagaggcggaaatcaggcgctggagaaaccctagaatggacagactacatgtcgctcaccttcacacagcacgtgatcacggagacgctgcggatggggaacatcatcaacgggatcatgcgcaaggcggtgcgggacgtggaggtgagaggccacctcatccccaagggctggcgcgtcctcgtctacttccgcgccgtccacctcgacgccgccgtccacgacgacccgcacgccttcaacccatggaggtggaaggacagggccgacgtgatgaccggcggcggcggcgggggcttcacccccttcggcggcgggcagaggctctgcccggggctggacctcgccaggctcgaggcctccatcttcctgcaccatctcgtcaccaacttcaggtgggtggcggaggaggacgccgtcgtcaacttccccacggtgcggctccggcgagggatgccaatcgcagtcacgcccagaacgtgaacacaggttgccttccgcgcgcgtcgaccatctgtcaagtgtttgactagaatagtttccttcttcaaattaagcagaaaaatttaagaaaactcatactgtacatgcaaccgtgcatttgatgagtgcagacttgagatgcatggttttatacctgatgagttgtactcgaatcgttgtacgttacgcaactgaattaaatatatacagagaatttttac

SEQ ID NO: 19780 - protein, 513 aa, Panicum virgatum
  misc_feature: Ceres CLONE 1806872
  misc_feature (59)..(511): Pfam Name: p450 Pfam Description: Cytochrome P450
  misc_feature: SWISSPROT Homolog: EC 1.14.13.93 (+)-abscisic acid 8'-hydroxylase
MWPGDGPWPASAVTAAALLVAAVIIVRRLFIPRLWPSSGSGTERRGAASGGASGSARLPAGSLGWPLLGETPAFILAAYSARPESFVERRRLLYGKVFASHLWGSPAVVSSDPEVSRAVLQADASAFVPWYPRSLMELMGRSSILVLGGGLQRRVHGLAGAFFKSPHLKARVTADMRRRVARAMAAWQRRGAPVVRVQDEAKSIVFEILVRALIGLDEGHEMQYLRQQFKEFIAGLISLPVKLPGTQLYRSLKAKKRMTTLIQKIIQEKRKRRIAAGCDEDPHDGTTHHPRNMIDVLLGNGSDELTDELISDNMIDFMIPAEDSVPVLITLAVKYLSECPPALQQLEEENMELKRRKSGAGETLEWTDYMSLTFTQHVITETLRMGNIINGIMRKAVRDVEVRGHLIPKGWRVLVYFRAVHLDAAVHDDPHAFNPWRWKDRADVMTGGGGGGFTPFGGGQRLCPGLDLARLEASIFLHHLVTNFRWVAEEDAVVNFPTVRLRRGMPIAVTPRT

SEQ ID NO: 19781 - DNA, 1881 bp, Panicum virgatum
  misc_feature: Ceres CLONE 1806887
  misc_feature: Encodes the peptide sequence at SEQ ID NO. 19782
agctcagctcagaaccaccacacacgggagataactcaactcaactcaactcaactgggacttgggccatgctgccgaccttctcgccgacggcgagcgcctcggcgacgcctccgccgcggccgataccaggcagctacggcccgccggtgatcggcgcgctccgggaccgcctcgactacttctggttccagagccaggacgagttcttccgccgccgcgccgccgcgaaccggagcaccgtgttccgcaccaacatcccgcccacgttccccttcttcgtcggcatcgacccgcgcgtggtcgccgtcgtcgacgccgccgccttcaccgcgctcttcgacagcaccctcgtcgacaagcgcgacatcctcatcggcccctacaaccccggcgccggcttcaccggcggcacccgcgtcggcgtctacctcgacaccgaggagcccgagcacgagagcgtcaaggagttcgccatggccctgctccaccgcggcgcccaggcctggcccgccgagctccgcgccggcgtggacggcatgctcgacgccgtggaggccgacctcgccaaggccaccggcgacaagccctccgccagctacatcgtcccgctgcagcaatgcatcttccgcttcctgtgcaaggcgctcgtcggcgccgaccccgccgccgactgggtggtggacaggttcgggttcaccatcctcgacgtctggctggccctgcagatcctgcccacgcagaaggtcggcctcgtccagccgctggaggagctgctcatccactccttcccgctgccgtccttcgtgatctggccgggctactacctgctctaccgcttcgtggagaagcacggcgccgaggccgtcgagctcgcggccagggagcacggcatcggcaagaaggacgccatcaacaacctcctcttcgtgctcggattcaacgccttcggcggcttctcggtgttcctgccgttcctggtggccaagatcggcgaggcctccgacccggcggggctgcggccgcggctgcaggaggaggtgcgcgcggtgatgcgcgccagcggcggcgacgccgcgttcgggttcaaggccgtccgggagatgccgctggtgcggtcgacggtgtacgagatgctccggatgcagccgccggtgccgctgcagttcgggcgcgcgcgcaaggacttcgtgctccgctcccacggcggcgccgccttccaggtggccaagggcgaggtgctgtgcgggtaccagccgctggcgatgcgggacccggaggtgttcgagcggccggaggagttcgtgccggagcggttcctcggcgaggaggggcaggcgctgctgcagcacctcttctggtccaacgggccggagacctcgcagccggcggccgggaacaagcagtgcgccgccaaggaggtggtggtggacacggcgtgcatgctggtggcggagctgttccgccggtacgacgacttcgaggtggagggcacgtccttcaccaagctcgtcaagaggcagccggcgccgagcttgtcccccgcagccgccggagccaactgagtctgtatgtgtaggccccgccttgccagtctctgttcgatgtctgtctcccggccgttgaaaataagcacttgtgccattgcaaaagtgtatacacactgtatagtgaattagtgatgcaaacaaacaactatatatctcctcaattttcacttagtggtattggtagttcataggtgacgtgtctactgaagtgatgcacttgtgctgacttcgtcaatatttaagatctactcctattagcctagtctctctttagattctcctgtgttgatgtatgcgtttgtgtgagcgtgtacaaagtgtatgcaaccag

SEQ ID NO: 19782 - protein, 498 aa, Panicum virgatum
  misc_feature: Ceres CLONE 1806887
  misc_feature (20)..(492): Pfam Name: p450 Pfam Description: Cytochrome P450
  misc_feature: SWISSPROT Homolog: EC 4.2.1.92 Hydroperoxide dehydratase
MLPTFSPTASASATPPPRPIPGSYGPPVIGALRDRLDYFWFQSQDEFFRRRAAANRSTVFRTNIPPTFPFFVGIDPRVVAVVDAAAFTALFDSTLVDKRDILIGPYNPGAGFTGGTRVGVYLDTEEPEHESVKEFAMALLHRGAQAWPAELRAGVDGMLDAVEADLAKATGDKPSASYIVPLQQCIFRFLCKALVGADPAADWVVDRFGFTILDVWLALQILPTQKVGLVQPLEELLIHSFPLPSFVIWPGYYLLYRFVEKHGAEAVELAAREHGIGKKDAINNLLFVLGFNAFGGFSVFLPFLVAKIGEASDPAGLRPRLQEEVRAVMRASGGDAAFGFKAVREMPLVRSTVYEMLRMQPPVPLQFGRARKDFVLRSHGGAAFQVAKGEVLCGYQPLAMRDPEVFERPEEFVPERFLGEEGQALLQHLFWSNGPETSQPAAGNKQCAAKEVVVDTACMLVAELFRRYDDFEVEGTSFTKLVKRQPAPSLSPAAAGAN

SEQ ID NO: 19783 - DNA, 1976 bp, Panicum virgatum
  misc_feature: Ceres CLONE 1806903
  misc_feature: Encodes the peptide sequence at SEQ ID NO. 19784
ggggtttatagccgcgcttaagcattcacagagttgaccggttactgctgaggtcatcagctctgtgctgtgcagcagcccgccgccgcaggccgctgctcgaccgtcgggggtgatggaggcgccggcactgtggagagtgctcgagttctacagcggcatcggcggcatgaggtactcgctgatggcattgggcgcgcgggcggaggttgtggaggccttcgacatcaacgacgtcgccaacgacgtctacgagcacaacttcggccaccgcccctgccagttgtgatgatcacttgaagattcagaaccttggctgtgctgcctgagtgcctgatgtgcagataatgcgactatacttattgccaacataattccgcagttctgctgatgtgtattcacactattattgtaaaaagaaatatctatggctgtggccaagttgagttcaatcaagaatgcctttcttcatcgtttgcccatagcttagtaaattaggctgagtttaataaactccgtaaggacattagcattagggtcatgtacctgtgtcctctcttcaaggacactagcattttactcaaacactgatttttatgttttattttgacttgtgcatgactgaactatgttgtgattgttttatgaactaattacgtgcatcattctcaaacaacaggggaacattcaaacgctcactgctagtgatctagacaaatacaaggcacatgcatggcttctttctcctccatgtcagccatacacacggcaaggccttcagaagcattcagctgatgctcgtgcgttttccttcatcaagattcttaacctcatgcaaaacatgagctatcctccacaaatgttatttgtggaaaatgtagtcggatttgaggtttctgatacacatgaccagttgctggaggtcctttcaagtttgaattttaacttacaagaattcatcctaagcccattacagtttggtgtcccatattccagacctcgctacttttgtttggcgaaacgagaacctatgcgatttcaaaatgcatcattcaacaataagttgctccggaaacctatgtgcctaagccagacaatggacagtacatcacaggatggcgaccaccgaactgaagaagagctggatccagtatgtaaaccagtaaaagactttcttgtcaaggaggctgatggaggcattcagaacgaaataattttgcaagactacatagtcccgctaaacttgattgagcggtgggggagtgctatggacattgtgtaccctgaatccaagcggtgctgttgtttcactaaaagctattatcgctatgtgaaggggacaggctccttgttggctacatctgaaaacctcaaatgggttcctgaagagaagcttgcaatttcttccctgaaggagttaggcctacgatttttcacccctcgagaggtcgccaatttccattcattcccttcaagcttctgcttcccagatcacataagccttaggcaacagtatgctatgctgggcaacagtctgagtgtagcagttgtgggtcctttgctgcactatctgtttgctgaggcatagagaaatccgccagccagctggtgatgttaacctgacacagacactttggctactagttgctgtggtcaaaaattttcataacttagcaaggttttaggatgtttggttagtggaacacttcgaaaagaaggctgctacctgcaaaggcgcaacatatatcactgaaactctggcggatctaacctacaagagaagctgtttctgcattgcctttcccccatgcgcacatcgtcatgttgaatacttgaatgatggctggaattttgacatgtattcgttgatgtgtatcttgatgaggttattgtaatgattgtggatttgagcacaaggaacttccactgaatcctgtagccaattattaatagcgaatatatttgcttttttttcc

SEQ ID NO: 19784 - protein, 57 aa, Panicum virgatum
  misc_feature: Ceres CLONE 1806903
  misc_feature: SWISSPROT Homolog: EC 2.1.1.29 tRNA (cytosine-5-)-methyltransferase
MEAPALWRVLEFYSGIGGMRYSLMALGARAEVVEAFDINDVANDVYEHNFGHRPCQL

SEQ ID NO: 19785 - DNA, 2341 bp, Panicum virgatum
  misc_feature: Ceres CLONE 1806915
  misc_feature: Encodes the peptide sequence at SEQ ID NO. 19786
acacaaccaaccaagcagcagaaaacatcttctgtccttcccctccgatccctccctcatcgagagtccagacgacccccacaagttccactccacgcagctgctagctagcgtttcgcaagtagtgtacgggcgaggcaatggcggtgatggccgaagtgtccacgaccaccggcgcggcgctccgcagcccggcctcgccagccccggcgccggtgaaggagggcgacgccgacaagctccggttcatcgaggagatgacctccgacgtggacgccgtgcaggagcgcgtcctggcggagatcctcgcccgcaacgccgacaccgagtacctcaccaattgcggcctcgccggcgccaccgaccgcgccaccttccgcgccaaggtgccgatggcgacgtacgaggacctgcagccgtacatccggcgcattgccgacggcgaccgctcgcccatcctgtccggacaccccgtctccgagttcctcaccagctccggcacgtccgccggggagcgcaagctcatgcccaccatcgaggatgagctcaaccgccgccagctcctctacagcctccagatgcccgtcatgaacctgtaagttttcttctccggtaccagcagttattggctcgacagcatacacgtgcgcggtgaagttattaacggcggccatggcgttcaatgatttgcgtgcaggtatgtgcctgggatggacaaggggaaggctctccatttcctcttcgtcaagtcggagaccaggacgccgggcggcctcgcggcgcggccggtgctgaccagctactacaagagcaaccacttcaagaaccgcccgttcgatgcctacaacaactacacgagccccacggcggccatcctctgcgccgacgcgttccagagcatgtacgcgcagatggtgtgcggcctcgtccagcgccacgacgtgctgcgcgtcggcgccgtgttcgcgtccggtctcctccgcgccatccgtttcctgcagctcaactgggagcagctcgccgcggacgtcgagaccggcgcgctcaccccgcgcgtcaccgacccgtcggtgcgcgaggccgtcgcgggcatcctccgcccggaccccgagctcgccgcggtgatccgcgccgagtgctccagcggcgactgggcgggcatcatcacccgcatttggcccagcaccaagtacctcgacgtcatcgtcaccggcgccatggcgcagtacatcccgacgctcaagtactacagcggcgggcttcccatggcgtgcaccatgtacgcgtcgtcggagtgctacttcggcctgaacctccggcccatgtgcgatccctcggaggtgtcctacaccctgatgcccaacatgtgctacttcgagttcctgcccatggacgccgccgcgtcgggcggcgacgcgagccagctggtggacctcgcccgcgtggagctcgggcgcgagtacgagctggtgatcaccacctacgccgggctgaaccggtaccgcgtcggcgacgtcctccaggtgaccgggttccacaactcggcgccgcagttccggttcgtgcgccgcaagaacgtgctgctctccatcgagtcggacaagacggacgaggcggagctgcagcgcgccgtggagcgcgcgtccgcgctgctccgcccgcacggcgccaccgtggtggagtacaccagccaggcctacaccaagagcatccccggccactacgtcatctactgggagctgctgctcgccaagatctccgcctccgccgacggcgaggcggtggacagggagacgctggaccaatgctgcctccagatggaggaggcgctcaactcggtgtaccggcagagccgcgtggcggacggctccatcgggccgctggagatccgggtggtccggccgggcaccttcgaggagctcatggactatgccatctcccgcggcgcctccatcaaccagtacaaggtgccccgctgcgtgacgttcccgcccatcatcgagctgctggactcgcgcgtcgtgtccagccacttcagccccgggctgccgcactggacccccggccagcgcaacgacgactagaccggcggcgaggagctgggactctccggcgcgcttaattagactggaaccatctgctgcatccgatgtccttggttggcattgctcggtggcagaggtagcatgtccgtgctgcacctaaatatttgttaattttagaattttttagtactgtcagttagtggcgtgagggtaacttggatgtgatgtgaagagaggtggctgagctgaccagctgaagcgagtagtcgatgcctgcaagagtcgcggattcttcc

SEQ ID NO: 19786 - protein, 457 aa, Panicum virgatum
  misc_feature: Ceres CLONE 1806915
  misc_feature (1)..(432): Pfam Name: GH3 Pfam Description: GH3 auxin-responsive promoter
  misc_feature: Functional homolog of the protein sequence given in SEQ ID NO 50882
  misc_feature: Useful for making plants with modulated biomass
  misc_feature: Useful for making plants with modulated light quality response
  misc_feature: Useful for making plants with modulated low light sensitivity
MDKGKALHFLFVKSETRTPGGLAARPVLTSYYKSNHFKNRPFDAYNNYTSPTAAILCADAFQSMYAQMVCGLVQRHDVLRVGAVFASGLLRAIRFLQLNWEQLAADVETGALTPRVTDPSVREAVAGILRPDPELAAVIRAECSSGDWAGIITRIWPSTKYLDVIVTGAMAQYIPTLKYYSGGLPMACTMYASSECYFGLNLRPMCDPSEVSYTLMPNMCYFEFLPMDAAASGGDASQLVDLARVELGREYELVITTYAGLNRYRVGDVLQVTGFHNSAPQFRFVRRKNVLLSIESDKTDEAELQRAVERASALLRPHGATVVEYTSQAYTKSIPGHYVIYWELLLAKISASADGEAVDRETLDQCCLQMEEALNSVYRQSRVADGSIGPLEIRVVRPGTFEELMDYAISRGASINQYKVPRCVTFPPIIELLDSRVVSSHFSPGLPHWTPGQRNDD

SEQ ID NO: 19787 - DNA, 577 bp, Panicum virgatum
  misc_feature: Ceres CLONE 1806919
  misc_feature: Encodes the peptide sequence at SEQ ID NO. 19788
aggggagaggaggcgctactagaagtactaccacgcggctgggcgcgccgcatcgagtcggcatctctctgggatccggctgcccggtcgtccggtcgttggctggatcggcggcgatgggggcgctgtcgcggccggaggaggtggtggcgctggtcaagctgcgggtggcggcggggcagatcaagcgccagatcccgcccgaggagcactggggcttcgcctactccatgctccagaaggtctcccgaagcttcgcgctcgtcatccagcagctcggccccgatctccgcaatgccgtcagtacccgctccctccgcccgccttgctcgataacctgagtggcggcctccgaatctcatgctcggcgttttttaagatttgtttggttttcgtcccgacatttttggtgtgcgcgagcgcgcgcgtgcgtgccgtgtgggtctccaaggcgtttctaactgccgttgttgcgatcgcgcaggtgtgcatcttctacctcgcactccgtgccctggacaccgttggtcagtagtcttatacccctagcgtttgctggtatttgtatttggatcaa

SEQ ID NO: 19788 - protein, 74 aa, Panicum virgatum
  misc_feature: Ceres CLONE 1806919
  misc_feature: SWISSPROT Homolog: EC 2.5.1.21 Squalene synthase
  misc_feature: Functional homolog of the protein sequence given in SEQ ID NO 50883
  misc_feature: Useful for making plants with altered sterol content
MGALSRPEEVVALVKLRVAAGQIKRQIPPEEHWGFAYSMLQKVSRSFALVIQQLGPDLRNAVSTRSLRPPCSIT

SEQ ID NO: 19789 - DNA, 2579 bp, Panicum virgatum
  misc_feature: Ceres CLONE 1806971
  misc_feature: Encodes the peptide sequence at SEQ ID NO. 19790
aaaagcccacccagagctctgtagaagaagaggcgaggggcgaaccggagccactcagcggccacctcaccgcaccaccgactgcccgcccgcctgctcctgctcgccgccgcccgctgctctcgccattccagctccagcgctcgccgcctcagcaggccgcagcgcctctcctcctccgcccgccggctgccttccggatgagaagcggcgcaaccggggcggcggaagtgtggtcggcgtgaggcttcgtcggagtccgtgaacgcgccgacaaggatcctggagatcaagcgcatgggttccttggaggcccggtaccggccggccggggcagctgaggacacagctaagagaaggactcagaaaagcaaaagtttcaaagaggttgaaaaatttgatgtttttgtactggagaaaagctcgggatgcaaattcagatccttgcaacttttgctctttgctatcatgtctgctgcatttctaaccctcctatacacaccgtctgtgtatgaacatcagctacagtcaagctctcgacttgtcaatgggtggatatgggataagagaagttctgatcccctatatgtatcttctgccagcattcaatgggaagatgtatataaaagtattcaaaatctgaatggtggtgaacaaaagctcaaagttgcactcctgaattttaacagaactgagtttggcacttggacagatatgctcccagaaagtgatttttcagtcgtaagactagagcatgccaatgaaaccattacctggcagactctctatcctgaatggatagatgaggaggaagaaacagagataccatcttgcccttcgcttccagatccaaattttccaagatcgacacacttcgatgttgttgctgttaagcttccctgttctcgtgtggcgggttggtcaagagatgttgcacggctgcatttgcagttatcagcagcaaaaatagcagcgaccacggcaagaagcaatggtggagtccatgtgctctttgtgactgattgcttcccgattccaaatctcttctcttgcaagaacctggtgaaacgcgaaggcaatgcttggctgtacaaacctgatgtgaaggctctacaggagaagctcaggctacctgttggttcctgtgagcttgctgttccactgaacgcaaaagcacgactttacacagtggacagacgcagagaagcatatgctacaatactgcattcagcaagtgaatatgtttgtggtgcaatcacagcagctcaaagcattcgccaagcaggatctacaagagaccttgttattcttgttgatgagacaataagtgatcaccaccgcaaggggctggaatctgcggggtggaaagtcaggataatagagaggatccggaaccctaaggctgaacgtgatgcctacaacgaatggaactacagcaaattccggctatggcagcttacagattatgacaaggttatattcattgatgccgatctccttatccttaggaatattgatttcttgtttgcaatgccggaaatcactgcaactggcaacaatgcaacactgttcaactctggagtgatggtcattgagccctcgaactgcacattccagttactgatggagcacatcaatgagataacatcgtacaacggtggtgaccagggctacctgaatgagatattcacatggtggcatcgcattccaaaacacatgaacttcttgaagcatttctgggagggcgatgaagaggcagtgaaggcaaagaagactaggttgtttggggctaacccgccaatcctttatgtccttcactacttgggccggaagccatggttgtgcttccgggactacgactgcaactggaatgttgaaattctgcgggagtttgcgagtaatgttgcgcatgctcgctggtggaaggtgcacaacaagatgccgaagaagcttcagagctattgccttctgaggtcaaggctgaaggccgggttggagtgggagcggcggcaggctgagaaagcaaacttcactgacgggcactggaaaaggaacataactgatccaaggctgaaaacctgctttgagaagttctgcttctgggagagcatgctgtggcattggggtgagaacaagaccaactcgacaaagaacaatccggcacctgcgctgcctgctgcgagcctgtcgagctcatgagatctgtagatagctttgctgagagtagtatacccagatacaaaacttccgaagctccatacatacatagcaacagctttgtaaaggtaggcctcttcccgaatgactctatacctctgttggccatcactccagcgccctcccgctgctttttgatggctggcaaatttttttggtttcttctgctaataattcgtcagtataggctgttttcctttctggctgtagagtcctgtccggggtctgttgcttcatgtttcatcggctattgctgtgctgcagtacgccgcctggtttgttgatgtatggtggttgaacggtttcagtgatcaatctggagtgatgcaacaatgagattgctgaccagcaaacactgcgtc

SEQ ID NO: 19790 - protein, 633 aa, Panicum virgatum
  misc_feature: Ceres CLONE 1806971
  misc_feature (306)..(518): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Functional homolog of the protein sequence given in SEQ ID NO 50884
  misc_feature: Useful for making plants with altered carbohydrate content
  misc_feature: Functional homolog of the protein sequence given in SEQ ID NO 50765
  misc_feature: Useful for making plants with altered cell wall content and/or composition
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPLYVSSASIQWEDVYKSIQNLNGGEQKLKVALLNFNRTEFGTWTDMLPESDFSVVRLEHANETITWQTLYPEWIDEEEETEIPSCPSLPDPNFPRSTHFDVVAVKLPCSRVAGWSRDVARLHLQLSAAKIAATTARSNGGVHVLFVTDCFPIPNLFSCKNLVKREGNAWLYKPDVKALQEKLRLPVGSCELAVPLNAKARLYTVDRRREAYATILHSASEYVCGAITAAQSIRQAGSTRDLVILVDETISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEAVKAKKTRLFGANPPILYVLHYLGRKPWLCFRDYDCNWNVEILREFASNVAHARWWKVHNKMPKKLQSYCLLRSRLKAGLEWERRQAEKANFTDGHWKRNITDPRLKTCFEKFCFWESMLWHWGENKTNSTKNNPAPALPAASLSSS

SEQ ID NO: 19791 - DNA, 644 bp, Panicum virgatum
  misc_feature: Ceres CLONE 1806984-R
  misc_feature: Encodes the peptide sequence at SEQ ID NO. 19792
gtgaccgacaaggtggacgtgtacgcgttcggcgtcgtgctgctggagctcctgtccgggcggaagcccatcagcagcgacggggcgtcgcccaagggccaggagagcctcgtcatgtgggcgactccggtgctcagcagcggcgacatctcggacctgctggacccgaggctcgacgtggagcaagacgaggcggaggtgaggcggatggccacggccgcgtgcctctgcctacggaggtcggctcggctcaggccgccgatatcccagatactgagcatactacgaggagagagcacggcgagcatcgccgaccagggcggcgccgcggagctggactgccttgacgacgaggcgtacccggcggcgaacgtgagatcgcacctggacctcgcgctgctggacgtggaggactcggagtccatctccagcacggagcacagcagcggcctcagcccgttggaggagtacctgcgggaacggtggagccgatcgtccagcttcgactgatttgatgcttgcgatcttggggagatgtaattttcgttttctccccccggtatatcccttgtttgttgtttggttttgttaccgggaccatgtacagtatagaatcaaagaatcatcacagccacattttcggc

SEQ ID NO: 19792 - protein, 169 aa, Panicum virgatum
  misc_feature: Ceres CLONE 1806984-R
  misc_feature: SWISSPROT Homolog: EC 2.7.11.1 Non-specific serine/threonine protein kinase
VTDKVDVYAFGVVLLELLSGRKPISSDGASPKGQESLVMWATPVLSSGDISDLLDPRLDVEQDEAEVRRMATAACLCLRRSARLRPPISQILSILRGESTASIADQGGAAELDCLDDEAYPAANVRSHLDLALLDVEDSESISSTEHSSGLSPLEEYLRERWSRSSSFD

SEQ ID NO: 19793 - DNA, 1050 bp, Panicum virgatum
  misc_feature: Ceres CLONE 1806984
aaccagattttaggtggttaactctgtcccccgcctcgcccgcccggcgcccaggataatagttcccgccctggccgcttgcgcttgtatcttcttcctcccctcagctccggcctttcggttcgggctggccgagcgaattcggccacgaagcaagtgcgcggccggaggggggcagcggcgcttggcttggtaacggaactcgctcgctttccaggcaaggcgacgaccgccgcctcggcacttttctattcgagcagcctcggttctacttcaacttccgggtcagacattggttgcaggcttgcagccaccaggagccgggcggcttcgtcttgtgtcagcgcggagtccacggcgattagtggttgagctaaccgctggcccgccgtgctagttactgaccagctccgtgggcgtgccatggcgaggtgcgcctcgtgctgatttcttgaggcgatcgagccgggggcgagcaggcgccatggcggtggaggagcgcggggagggcgtcggccggtgcatactggtggggctgcacatggacgccgtcggcagggacctgctccgatgggcgctcaaccaggcggcgaggccgggggaccgcgtcgtcgccgtgcacatttacagcaagtccgacctgtgcaagacgaacactctgaggctgatcaggacgctggacgactacctggcggagtacgagtccctctgcagccggaaagagatcgttctggtcggccgggtgacgccggggagctcgatccagaaggagctggtgaaggaggccaagctatgcgccgccatggtcttggtgcttggcgccaacaagaagtactccttcggagggtcgacttgcttggccaagtactgcgccaagaagctgccgccgacgaccaccgtggtcgccatccagaacggtaagctcgtcttcgtccgggaggcgcccaagccgccacttggagcaaagccgaatccggtgctgcgcatggtgctgcacccgagcgtggggctggaggccaaggtcatcatcccgaacccgaaccggagcgc

SEQ ID NO: 19794 - DNA, 436 bp, Panicum virgatum
  misc_feature: Ceres CLONE 1806986
  misc_feature: Encodes the peptide sequence at SEQ ID NO. 19795
atccgccaggccggcgccgcccgcactctccccaccctcgatccgctccgccgtcccgcttccggaggaggcagacaggagaaggtgatcggctgcaatggcccgcttgtacgccgcgaacccggaccctcgcgtgacggcgcccgagctcgaggacgagttccgcacctctggagttcttcggagtgctcgggttgctcggaaaccacctggctttgcatttattgattttgatgacaagagggatgctgaggatgcaatccctgatcttgatgggaagaatggatggagagttgagctatcacctactgccagcactgatcgtggtggtcgtgatccctatggtgggtttcagtcttgctgctactagtgtggtgatactgggcgctttgttcttgagtgtcgtttgaggattggctccggaggtctaggcagc

SEQ ID NO: 19795 - protein, 90 aa, Panicum virgatum
  misc_feature: Ceres CLONE 1806986
  misc_feature: Functional homolog of the protein sequence given in SEQ ID NO 50750
  misc_feature: Useful for making plants with modulated flowering time
MARLYAANPDPRVTAPELEDEFRTSGVLRSARVARKPPGFAFIDFDDKRDAEDAIPDLDGKNGWRVELSPTASTDRGGRDPYGGFQSCCY

SEQ ID NO: 19796 - DNA, 531 bp, Panicum virgatum
  misc_feature: Ceres CLONE 1806986-R
gtaagtgctaagagtgtcgtgagactgggcactttgctggtgagtgtcgtttaaggataggttctggaggtttaggcagtggaaggagcagaagcaggagccgcagcggcagccgcagccccagataccgacggagtccaagttatggaagaagaagctacagtcctgcaacacgctctccaaggcgtggtagggtgtcaccagccccagctcgtggacgcagctatagcaggtcaccacgccgtgcacgggagacgtctcctaacggataccgccgcagcaggagctagagccagatatttgtctgtgacagatattgctctttggcccatcatctatgatcaataacctacttgaaagatccatcgcagactgcttgacttttggttaaggttctcataacttttatctatcttattatccctgtgtttactttataatcagtagtaaaacatattggtgggtgtatttattaaactaagaccagctgtcttttcttgtgtggtataaaggcatcgtcctgcactgctc

SEQ ID NO: 19797 - DNA, 2678 bp, Panicum virgatum
  misc_feature: Ceres CLONE 1806988
  misc_feature: Encodes the peptide sequence at SEQ ID NO. 19798
agcgaagcaaaccagcagcaacaaaacaggcgagccttttgctcgccgctgccaccaccaccacctcgtcgcctcgcctcggcctcgcgcgcgcgggatctcgcgctcgctcgccgcgcgcaccgaggaggaaaggagggagggcgcggccgtgcgcagggtttggaggcgcggggcgatccggcggcgatggggagccgggtcaaggaggacgagaggcacgagcggatcatacggggcctgctcaagctgcccgccaacaagcgctgcatcaactgcaacaacttgggaccacaatatgtctgcacaaatttctggactttcgtttgtaccaattgcagtggagcacatcgggagttcacacatcgagtgaaatcagtttccatggccaaatttaccgcacaagaagttacggcccttcaagaaggaggaaatgagcgtgctagagaagtatttttcaaggaatgggatcctcaacgcaatggataccctgacagcagtaatgctgataaattgagaaacttcattaagcatgtgtatgtggaacggagatacacaggagaaagaagtactgataggccacctaggggaaaggatgacaaggacgagtatagtgaaaataggagatctgatggaaattggggtggttcaagaagtccaccaaatggaagttattctgaccgtcagagttatagtggacggagtgatgacagaaactccagatattcctatggagatcgtagtcctggctatgaccaaaatgactacaagaaaagtcctcgctactttgagggtgccgatgatagtagatctgtaaaaacgactccggttcaaaggtttggggaccgcaggttttctgaaccaaggaagcgagatagtggctctccagactttcagaaagaagcagatggttctagtcctgttgtacggccagtgagggatatattgggtgacaatgctcctcaacttcgggttggtgagccttcaaagccagctgctgaacctcggaaaccaattgtagccagaccaattgatcctccaaagacagctgtagccagaccgattgatcctccaaagccaactgtaaccagaacgattgatcctccaaagccaaatggaaccagggcaatcgatcctccaccgctggcaaagacgatgtctagtgccagcagcattgcttcttctgaggggatttcagaaccgacgaaggtcgcaaatgcagtgagtttaattgattttagtgcagatcctgaacctcctgcacctgcagcaccaccacagccggcctctacgactcaaccgcatcctgttaatgcaatggcaccacagcctgttcacgaacaagggaaaagtcctgtgagtggtggtgactgggcatcttttgatgcttttggccaacaacaaacaccacaaaccagcagcagtgcaaactcacttgagtctgcacttgcgcagatgtcattctccgaagcacctgctgcacgaaatgtgtcagcttttccagcctcaattgatcccactctgaaagcgaatggaggacatccatccattgtagatcagtcacataacttgtttgatgcgccctttggaatctcaggcaaccaggcctcaacagtaatgtccaaccaaggatcttcagttcaacaatcacctcttactgcccctacagctggacttccatctcaagtaactgcaaatcaacagggaaccagtggtattcaaggagcaacattttctactgacagtaaatccagtggcaggaaagaacttccagcggatatctttgctgcactatattcaacatcaactccaatgatgcctggttggcaaagagctccccaatttggaatgggatatggcatgcaatatcctgctagagtgttccagggaatgcaaggatatcctcaagcagcgtttcctcagcccacatatcaacaacctgtatatccgcaacatgcatatccccaaacccaaccccagccccaaccccaacctgtgaaagcttcgaatccttttgatcttgggaatgaaccagctccaattcaagctcacatgcccctatctgggccaccaggagcatcagcaggcacaactccccaaacattacttggcacctctagttttggcgttcctccccaacaacctcaccatctctatcaatcagctgcacccccaagcccttttatgatgcagcaagttccaaacagcatgccccagcaaccaccaaatagcatgcatgcgatgcaacaaggtctgggttccttcaacatgggttttgatcagcaagctcctccccgatacccccagccaggcactccaccttcctacggctctgttgcaggtagcaatccttttgggtaaaagaactatttaatgttgaaatgcctgtactttcatctccagaccaagtgtttgcagcactcagcgggacaaacatgcatcgacaccctcaaagagaatgtgtttcatacaactggttgtgtattttgttgcccgtaatctgttgtacaacttgtctccaagggtcaatgatcgaatgtagctctgttttggagggcgtgagatgcatgcagccccattccttgtatattttgtgtacggcgcattctgcttgtattgcatagtttgtatattttgcattcgtttgttatcttggacaatatcagatctgttagctc

SEQ ID NO: 19798 - protein, 723 aa, Panicum virgatum
  misc_feature: Ceres CLONE 1806988
  misc_feature (12)..(130): Pfam Name: ArfGap Pfam Description: Putative GTPase activating protein for Arf
MGSRVKEDERHERIIRGLLKLPANKRCINCNNLGPQYVCTNFWTFVCTNCSGAHREFTHRVKSVSMAKFTAQEVTALQEGGNERAREVFFKEWDPQRNGYPDSSNADKLRNFIKHVYVERRYTGERSTDRPPRGKDDKDEYSENRRSDGNWGGSRSPPNGSYSDRQSYSGRSDDRNSRYSYGDRSPGYDQNDYKKSPRYFEGADDSRSVKTTPVQRFGDRRFSEPRKRDSGSPDFQKEADGSSPVVRPVRDILGDNAPQLRVGEPSKPAAEPRKPIVARPIDPPKTAVARPIDPPKPTVTRTIDPPKPNGTRAIDPPPLAKTMSSASSIASSEGISEPTKVANAVSLIDFSADPEPPAPAAPPQPASTTQPHPVNAMAPQPVHEQGKSPVSGGDWASFDAFGQQQTPQTSSSANSLESALAQMSFSEAPAARNVSAFPASIDPTLKANGGHPSIVDQSHNLFDAPFGISGNQASTVMSNQGSSVQQSPLTAPTAGLPSQVTANQQGTSGIQGATFSTDSKSSGRKELPADIFAALYSTSTPMMPGWQRAPQFGMGYGMQYPARVFQGMQGYPQAAFPQPTYQQPVYPQHAYPQTQPQPQPQPVKASNPFDLGNEPAPIQAHMPLSGPPGASAGTTPQTLLGTSSFGVPPQQPHHLYQSAAPPSPFMMQQVPNSMPQQPPNSMHAMQQGLGSFNMGFDQQAPPRYPQPGTPPSYGSVAGSNPFG

SEQ ID NO: 19799 - DNA, 2352 bp, Panicum virgatum
  misc_feature: Ceres CLONE 1807001
  misc_feature: Encodes the peptide sequence at SEQ ID NO. 19800
cctttatcaaagcgtctgaaaggcttcgattgctttctatatgcaggcactttgaaagccttgggaactgtgttcggaagtgcattaatctgaagttcatcgtcccagatcctgtttttgcagctttcataataccagtctgatgataagatcaatcactacctctcgtcaccactctgatgatccatcagctggcctcatcttctgcttctgaagaggatggccacattcttctccgcttctaccgatcagagggacctcgccgccgccggcgacatgtcgttccaccactacaccacgtccaatccgtactcggatacaccaaccggtggtctgatacctttccccgccaccatcatgtctgaaggccacgtcgcgcatggcggcgacggcagggacgagccgacctcgttcttgaacgcgcgggacgggccatcgtgcggcgccgagatgggcctgcagacgcagctgctgatggcgaacgcgtcggcggcgcagcaccagggtctatcgcttagcctcgggactcaaggcgtgccggtggcgtctctttaccagtaccgccaggcaggcatggccgccgcctccttgcttagcccgggccagacgacgacggcgagcaggaacgcacagagcatctacatccagaactcaaagtacctgaaggccgcgagggagctgctggacgaggtggtccatgtccgggacgcgatcaagcgcaagggagacaagaaccaccagagcaaggattccggcgagggcaaggatgccgagaagagcgaggagaaggccgacgagcacgagggcaactcctccgccgagctgacgccgtcagagaggcaagaccttcagaacaaagtgtcggcgctgatggccctgctggatcaggtggaccggaagtacaggcactaccgcaaccagatgcagatggtcatgtcgtccttcgacgaggtggccggcgccggcgcggcgaggccgtacacggcgctggcactgcagacgatctcccgccacttccggtcgctgcgtgacgtcatcggcgcgcaggtgcagtccctgcggcggagcctcggcgagaaggacagctccgcgcagggcggcgggctgtcccggctgcgttacatcgaccagcagctccggcagcagcgcgccatgcagcagttcggcatgatgcagcagccgcagcacgcctggcgcccgcagcgcggcctcccggagtccgccgtctccgtgctccgcgcctggctcttcgagcatttcctccacccgtacccaaaggattctgagaagttgatgctcgcaaggcagacaggcttgtccaggggccaggtgtccaactggttcatcaacgcgcgggttcgcctgtggaagccgatgatcgaggagatgtacaaagaggaattcggcgcggagatggactcgcactcgtcggaggagaacgcgggcaacaagggcaaggacgaggcgatatcttcggaggatcacgacgagttccagagcccgtcgagcgccgccaagcacggcgcagcagctggccacctcagcgcgttcaagtcggaggcgatcggtggcatggacgccggcggcgtcggcctgtccggcctcgccggaggcgccatcggctcgtacgcgaccagcctcaacctcggcgccgtcggcaacggcagcagcagcctcctgcaggacgcgctcgcgcaccaccacggcgacgcgaggttcgtggcgtacggcgacatgggcggcctcggcggcggcggctacgacggcggcagcgtgtcgttgacgctgggcctgcagcactgcaacgacgccgggaccgtgccggccgaacagcagggcctcctgtacggcaacgccggcgacttcgagttgatgaacggctccgaggacaggcagcggttcggctcgtcgcagctgctgcacgattttgtcgcgtgagcgcgcgcggctggggtgctcgttgggaatagcgcggacggcgtcagaagcctgggatggccggccggcgccgccgctggtatatatacataccgtgatcacagttcagttcatcatggtacacggtttcatcaaacaagtaagtatacgcatgtactggtgtggtaagtgaggtagtagtgggaaatggggggtatacaaaactgtatatgaggtgtggtaagttgtagggtgctgtaaaaggatatttagattggtatttttggtagcttgaagattcgtgtactgatgattcaagtcccatatatgatgtgttgttggtccaattggacctcagtccgtggcttcctttaatttggagattgtagacactaatgtttcatgttctgaattatggtaccagttgttcagttc

SEQ ID NO: 19800 - protein, 572 aa, Panicum virgatum
  misc_feature: Ceres CLONE 1807001
  misc_feature (140)..(275): Pfam Name: POX Pfam Description: Associated with HOX
  misc_feature: The sequence is a functional homolog of SEQ ID NO 1877 in the 11/479,226 US patent application
  misc_feature: The sequence is a functional homolog of SEQ ID NO 1510 in the 10/666,642 US patent application
  misc_feature: The sequence is a functional homolog of SEQ ID NO 964 in the 11/435,388 US patent application
  misc_feature: The sequence is a functional homolog of SEQ ID NO 436 in the 10/666,642 US patent application
  misc_feature: The sequence is a functional homolog of SEQ ID NO 820 in the 11/435,388 US patent application
MATFFSASTDQRDLAAAGDMSFHHYTTSNPYSDTPTGGLIPFPATIMSEGHVAHGGDGRDEPTSFLNARDGPSCGAEMGLQTQLLMANASAAQHQGLSLSLGTQGVPVASLYQYRQAGMAAASLLSPGQTTTASRNAQSIYIQNSKYLKAARELLDEVVHVRDAIKRKGDKNHQSKDSGEGKDAEKSEEKADEHEGNSSAELTPSERQDLQNKVSALMALLDQVDRKYRHYRNQMQMVMSSFDEVAGAGAARPYTALALQTISRHFRSLRDVIGAQVQSLRRSLGEKDSSAQGGGLSRLRYIDQQLRQQRAMQQFGMMQQPQHAWRPQRGLPESAVSVLRAWLFEHFLHPYPKDSEKLMLARQTGLSRGQVSNWFINARVRLWKPMIEEMYKEEFGAEMDSHSSEENAGNKGKDEAISSEDHDEFQSPSSAAKHGAAAGHLSAFKSEAIGGMDAGGVGLSGLAGGAIGSYATSLNLGAVGNGSSSLLQDALAHHHGDARFVAYGDMGGLGGGGYDGGSVSLTLGLQHCNDAGTVPAEQQGLLYGNAGDFELMNGSEDRQRFGSSQLLHDFVA

SEQ ID NO: 19801 - DNA, 2258 bp, Panicum virgatum
  misc_feature: Ceres CLONE 1807006
  misc_feature: Encodes the peptide sequence at SEQ ID NO. 19802
gtccatcggcttccttcctcccctgttctcctcgatccctcgccgccgctggtccggctccatccatcgtcccaaccgcttcgtctttctcgcgcagctgtcgcaggtccccctagcgcctagagtttgctgagtccgtcggcccaagataatggctggacaccgaaacagtcatggaaaacggcactctgattatgctgaaaatggaggtggtaagagaagaaatcctggtgatgattcctatgctcctggtcccgatgatactgtgtatcgctacctctgctcctctagaaaaattgggagtatcattggccgtggtggagagattgcaaagcagttgaggaccgagactcaagctaagattaggattggcgagagtgttcctgggtgtgaagagcgagttatcacaatatttagctcaagcagggaaactaatactattgatgatgctgaagataaggtttgctctgctcaggatgctctctttagagttcatgagaggcttgcttctgatgagggtcctgggaatgaagacagtgaagaagttgtacctcaagttactgttcgtttgcttgtgccatcagaccagattggatgcattattggaaaaggtgggcatatcatccaaggaatccgcagtgagactggtgcgcaaatacgtgtgcttagtaatgatcatatcccatcatgtgccattaatggtgatgaactcctccagatatccggggatgctgtagttgtcagaagggctcttcgtcaagtgtcatctcgcctccatgacaacccatctaagtcacagcatcttcttgcatccagcttgacccaaccttatgcagggagctcccaccttggtagttcctccactgcacctgttgttgggattactcctgtaattcctgcttttggaggatacaaaggtgatgtggcaggagattggccctctatacctcggagggatgagagcgctgcaaaggagtttagcttgcgtttactttgtgctgctgtgaatgtgggaggtgttattgggaagggtggtggaattatcaaacagattaggcaggaatctggggcttttattaaagtggatagctccaattcaggtgctgaagatgattgcataattacagtttctgcaaaagagttctttgaagatcctgtctctccaacaattgatgctgcagttcgtttgcagcctaggtgcagtgagaaaagtgatgcagaatcagcagagccatcatacacaacacgcttgttggtgtctacatcacgtattgggtgcctaattggcaaaggtggttcaatcattactgagatacggagaacaacaagagcaacgatacgcattctttcaaaggaaaatgttccaaaggtagcagcagaagatgaagagatggttcagatcagtggagggcttgatgttgcaagacatgctcttgtgcaaatagctacaaggctgaaagccaatttctttgaaagagagggtgctttatctgcatttccacctgtgatcccttatcatcctttgcctgctggtgtttctgatgaaccaaagtatctaagcagagacactaagcctgttgggcattttctatattcaagtagtttccgtgcatcagatgatatgattccttctgacagctatggaagttatagcagctcccaggcacctggaggtggatatgtggcttacagtgggtacagtggccgctcaaccagcagtgggttgtctggtcatagttctcttccctatggaaagcgtcatggttattaggatctagatttgttgaataaaacaggtatggttcttcaattttgtcttgacttgtaagaatgattatgtgatcgtgccttgcttgccttaatgctttgctgcctttttaacacatttaacccagctcagctatcttctgatggacctgttcttttcacctttgcccgcctgctcccctcccgcactaaaaacagccaagacaatgaagttcggagcctgcttattggagccccttcccaaaccagatgaccaagagtattgcccatcctggaagctttgcttaagaggacctgtctggatgccatagaccattgattttcctcacactacattacttatatcttccaccgggcctgtgtttgtagccctaccataaatttccaaacctatgtattgatgaaggtcgcatttgagattgcgtgtatttacttgtttgagacctgcttcagtttagcggcttttgttgaaattgaaatacttgtttacc

SEQ ID NO: 19802 - protein, 539 aa, Panicum virgatum
  misc_feature: Ceres CLONE 1807006
  misc_feature (137)..(204): Pfam Name: KH_1 Pfam Description: KH domain
  misc_feature (364)..(431): Pfam Name: KH_1 Pfam Description: KH domain
  misc_feature (39)..(104): Pfam Name: KH_1 Pfam Description: KH domain
  misc_feature (277)..(332): Pfam Name: KH_1 Pfam Description: KH domain
MAGHRNSHGKRHSDYAENGGGKRRNPGDDSYAPGPDDTVYRYLCSSRKIGSIIGRGGEIAKQLRTETQAKIRIGESVPGCEERVITIFSSSRETNTIDDAEDKVCSAQDALFRVHERLASDEGPGNEDSEEVVPQVTVRLLVPSDQIGCIIGKGGHIIQGIRSETGAQIRVLSNDHIPSCAINGDELLQISGDAVVVRRALRQVSSRLHDNPSKSQHLLASSLTQPYAGSSHLGSSSTAPVVGITPVIPAFGGYKGDVAGDWPSIPRRDESAAKEFSLRLLCAAVNVGGVIGKGGGIIKQIRQESGAFIKVDSSNSGAEDDCIITVSAKEFFEDPVSPTIDAAVRLQPRCSEKSDAESAEPSYTTRLLVSTSRIGCLIGKGGSIITEIRRTTRATIRILSKENVPKVAAEDEEMVQISGGLDVARHALVQIATRLKANFFEREGALSAFPPVIPYHPLPAGVSDEPKYLSRDTKPVGHFLYSSSFRASDDMIPSDSYGSYSSSQAPGGGYVAYSGYSGRSTSSGLSGHSSLPYGKRHGY

SEQ ID NO: 19803 - DNA, 2093 bp, Panicum virgatum
  misc_feature: Ceres CLONE 1807011
  misc_feature: Encodes the peptide sequence at SEQ ID NO. 19804
actaatctccgcggcgaaacgaattccttcccattccaatttccaccgctggaagaccaccacctgcgggcgccccaactccccacgttcccgagaggctccgatccgattcgcagcgcccgcccgccagccttctgccgccgcgtcccacgtgcgccccaccccgccgccagcgcagcgcttcgccctccgccctgtcgagccgcgatcccgtccggtccggggcgtcggatccggcggcgccctcgatgcggtcgccggggctcctggccgccgccctcgtcgcggcggcgctgctgctcgcggccggcgccggggcggccacggaggaggcctacgtcacgctgctgtacggcgacgagttcgtgctcggcgtgcgcgtcctgggcaagtccctccgcgacaccggcacgcggcgcgacatggtcgtgctcgtctccgacggcgtctccgagtactcgcggaagctcctccaggaagatggttggattgtgaatcgaataacattactggcaaatcctaatcaagtgaggccaaagaggttttggggtgtctacaccaagctaaagatatttaacatgacaagctacaaaaaagttgtttaccttgatgcagatactatcgttgtgaaaagtatcgaggatcttttcaagtgagggaagttctgtggaaacttgaagcattctgaaagaatgaattctggagtaatggttgttgagccctctgaaactctattcaatgatatgatcgacaaagtgggtcgtttgccttcttacactggaggggaccaaggttttctaaattcatattatcctgactttcccaactcccgtgtctatgagccagactcacctttaactcctgaaccggaaacacagcgcctttctaccttgtataatgctgatgtgggtctttatatgctagccaacaagtggatggttgatgaaaaagaattaagagtcattcattacacgctgggtccccttaaaccctgggactggttcacagcttggcttgtaaaacctgttggaacatggcaggacattaggcaaaaacttgaagaatctctccctggaactggtggggggaggaacccacatgaccagctggttgtcaaaatattgttcattctcccattttgcctgctattatttggttattaccaatcgtgttttcagacaaacaaggagttgataagtataagatctctatgtgcatttgctagaagagcccgccacaaatacaagtctgaggagccattaccatcttattcagtggttggttcatcagctgcatttggtatttcaaaccaaaggttatcaaatgggacacattcgaagctccctccttattttgggccgatcgcagtgctagtttgctttatatctgctggcgtctcttttgcctttgcttttgctatcattccacggcaggttatgccatggacaggtttgctgctgatgtttgagttgacctttgtggcattcttcttattatttgggagttatcttcactttgtctatcaatggggaagtatgagtgcaaatcatgtgggatttaacaattctgattcatcagagaatcatattggatcaggccatcagcgcaatatgtccgactgtgatatggatgcaacattttactggataggaatggcggtcattgctactgttgctgtattgttaccaactatcttgggtataactgcattattcacaaagcttggattaatggttgctggcggtgttgtgctggcatcttttatgacatacgccgcagagcatcttgctatctcagccttcaacaagggtcagaaagacagaaatgcgagaactagaagcttttgtttttaacgacaagtaaattctgtacctacaccattgatccatgttgtattgtagtaggtttgtacacacagaaagaatgatggttccttttttttttgacacatggcttcctgcccagaccccctttttgtagcacgtcacgctgtcaactagtggtaaataggttcccagatgttgtttatttatgcggcacggttggctcgcacagtaaatcttgtcaatagagcagtcactgccatttgcttg

SEQ ID NO: 19804 - protein, 135 aa, Panicum virgatum
  misc_feature: Ceres CLONE 1807011
  misc_feature: SWISSPROT Homolog: EC 2.4.1.186 Glycogenin glucosyltransferase
  misc_feature: Functional homolog of the protein sequence given in SEQ ID NO 50885
  misc_feature: Useful for making plants with altered cell wall content and/or composition
MRSPGLLAAALVAAALLLAAGAGAATEEAYVTLLYGDEFVLGVRVLGKSLRDTGTRRDMVVLVSDGVSEYSRKLLQEDGWIVNRITLLANPNQVRPKRFWGVYTKLKIFNMTSYKKVVYLDADTIVVKSIEDLFK

SEQ ID NO: 19805 - DNA, 4115 bp, Panicum virgatum
  misc_feature: Ceres CLONE 1807053
  misc_feature: Encodes the peptide sequence at SEQ ID NO. 19806
ctcgctgcccctcccctccctcctctcaccccttcaaaccaaaacccaaacaccaccaccgcctccaccgctcatcgccgcggcagagagccgagaggagaaccgcattgcccaaaccaggcgagccgcagtgccgcacgcgcccgccccacaccgcgcacgcgacggccgcaccgagccggggtgaggcgccagcgccgccagctacaccagccgcctacgcgctttggcctggctctagcgctcgcaagtcctagcggggctagcagcggggggcgggcgagattccaaagggaaaaggccccgggagcaaaagggaggcgaggtgcggagggagggggaaaagcggcgggagtggccagtgtggaggggagggagtccagtccaatccaatccagccggaccccgaccgacgcggctgccgcaccggtgactggctggaagggaagtgtgcgcggcaagcgacgcacgccacagacaccggcaccgacacccccgcgccgatcggagccgcgcgccagatccgacgccccgccggaatcgcggcgggttccagtgcccgcggcgccgcctcggatctgcattccgttcagggcctcctcctgatcgccttgcgccctcgcctccccaaatactctgcaaccgatggatcgacgcagctggccttggaagaagaaatcatctgataaatcatcaaacggagaagtgttgcagaattccaatcaagaacaggaagataaaggtccaaaatttgtgcaaattgcaccggaaacatatgcacatcttacagagtcagaggaaaaagtaaaagttttagaagaaaatgtgaaggtcttaaatgaacaactctctgcggcacaatctgagatcacaactaaagatgcactagtgaaacaacatgcaaaagttgctgaagaagccgtatcaggttgggagaaagctgaagcagaggcctccgcactgaagcttcagctagaaactgttacattgtctaagctcgcagctgaagaaaaagctgcccatttagatggtgctttgaaagaatgcatgaagcaagtaagaactgtcaaggaagaaagtgagcagaaactgcatgatgtagtctttgcaaaaaccaaacagtgggagaagataaaggccgagttcgaagcaaaattagttgaattcgaacaggaactcataagggctggtgctgagaatgatgcactcacaagatccctccaagaacgggcagaattgctgatgaaaattgatgaggaaaaagctcaagcagaagccgagattgaagtcttgaaaagcacaatccagtcagacgaaagggagataaattccctcaaatatgaactgcatgttgtctccaaagagcttgaaatccgcaatgaagaaaagaacatgagcgtgcgctcagctgatgtagcaactaaacagcatcaggaagatgtcaagaaaatatcaaaacttgaagctgaatgccaaagattacgtggccttgttcggaagaagttacctggtccagctgcactagctcaaatgaaaatggaggtggagagcttgggcagagagtatggagaccacagagtacgacgatcccctgcaaagaattctagtttccatcgtcctatgtctcctgttcctgattatgccatagagaacttacaacacatgcagagagggaatgagtttctaactgctcgtctattaacaatggaagaagaaaccaagatgctaaaagaggcactgacaaagcgaaacggtgagctacagtcatcaagaagcatgtatgctaaaacagcaggcaagctccgtagcttggaggttcaaatgttgactggaaaccaacataagagtccaactccaaacatggatattcagtttgatggtgcactgagccaaaatggaagcaacccacctagcatgacttcaatgtctgaagatggtgttgatgatgaaggaagttgcacggaatcttgggccaatgctctagtattagagctctctcagttcaagaaagagaaagcggccaagagcagggcgatagaagactccaataggttggaactcatggatgacttcttagagatggagagattagcatgtttgtcttctgaggctaatggcaatggcagtgccatcaacaaaatgaagatagatgaagttggggctactttgtctggtattactgaaggagacggtgttaaagatttgcagtcaacttcaccaatgtcagaaactccatcaagtaaacagcagctatccgagaaatcttcacttttgaaattgcaatcaagaatatcttccttactggattctgaatcaccagagaacaatgcaggaaagatgattgatagcattagaaatattttgaaggatattgaagatgaggcagattcgatcaatgcaaatggcactcatcacttggatgggaccttaagttcaggtagcgaatgtgccatggatcaagaactaaagactgccatattgaggattcaagactttgtcatgttgcttgatcaagaactctccaagttccaaggccagtcatctgattatgatgggctatttgaaaaaacacaacaattctctgcattaattgacaaagttttgtcaaatgataatggcctaaatgactttgtcatggcactatctgttatcttgtcagaaaccagtcagattaagttcacaatgtcgagagacaacagcaatgaagcagaaagtaataacttagcttgtgttgataaagtgactctacttgaaaataaggttcagcctgagccagtaaaagacagtgtttctgatctctgtccactacttcctcgttcatcttctgatcctgagtttgaggggcctgctgatgctggatttgatgctaagactgctctgaagatatgctcaccagaggaatatgaacaacttaaatctgagaagaccaatctggaggaagaactagcgaagtgcaatgacataatagaagaaacaaaggttagattgagtgatatggagaaaaacttggaagaccttacagccaagttggctgacagtgagaaatcaaatagcttgagtgagacacagttgaaatgtatggccgaatcctacaagtcacttgaatcgagaaaagttgaattagaaaatgagatagaagtactgcagtccaaaatagatactttgacagctgaactcaccgatgaaagacaaagtcatcaggagaacttagccaaatacaaagacctcgaggagaagatggaaaggtatgagttggagaggaggtcaatgtttgtagatgagggtccagataccaattcaaagcaggagaaagagatagcggctgcagcggagaagcttgcagagtgccaggaaacaatactgattctcggccgtcagctgcaagctatgcgtccttcagctgagtctttaggttcttcacctaaccggcaacgtatggaggactttctgcaggatgctgtaggaacaactgcaggagagtcttcccagaagccgggaggccaacctgatacagaccaggaaattcttggggcaggaaatgagtctcctgtcaatagattcaagacgcacataaccccttctgacgctgacgagagccctttcccttctccgaacaactccaagcgtccgaagcatcgatcgagatcctcttcatcttcgtcgtttgctaaccaccagttgccagagaaacagagccgcggattcagtcgtttcttcacaaagggcaaagagtgaaaatttctccttgttgcctcatcagatttgttgattagtgacgctgaatgggtgggatggtgaaggccgtgaatttctgtagagctagtggggcaagcctgcttgtgtattctcacaggtgacgccttgggttgctggaataatactcagcttgcagtccagcaggttgtgggcgtggcgagagtgtgtgtggaaatgtaaggcatcggtatcttctgctagagcttctccgggttgctgtgtgtttgaaacctcactaaaacctcactgtacatgtgcttacttgcctgaagaagaggttgttggtttttgttgaatccgcttgtgaagtagcctgtgtattggccttggactggtttgttgtacagttaacctgggtt

SEQ ID NO: 19806 - protein, 1029 aa, Panicum virgatum
  misc_feature: Ceres CLONE 1807053
  misc_feature: SWISSPROT Homolog: EC 2.7.11.1 Non-specific serine/threonine protein kinase
MDRRSWPWKKKSSDKSSNGEVLQNSNQEQEDKGPKFVQIAPETYAHLTESEEKVKVLEENVKVLNEQLSAAQSEITTKDALVKQHAKVAEEAVSGWEKAEAEASALKLQLETVTLSKLAAEEKAAHLDGALKECMKQVRTVKEESEQKLHDVVFAKTKQWEKIKAEFEAKLVEFEQELIRAGAENDALTRSLQERAELLMKIDEEKAQAEAEIEVLKSTIQSDEREINSLKYELHVVSKELEIRNEEKNMSVRSADVATKQHQEDVKKISKLEAECQRLRGLVRKKLPGPAALAQMKMEVESLGREYGDHRVRRSPAKNSSFHRPMSPVPDYAIENLQHMQRGNEFLTARLLTMEEETKMLKEALTKRNGELQSSRSMYAKTAGKLRSLEVQMLTGNQHKSPTPNMDIQFDGALSQNGSNPPSMTSMSEDGVDDEGSCTESWANALVLELSQFKKEKAAKSRAIEDSNRLELMDDFLEMERLACLSSEANGNGSAINKMKIDEVGATLSGITEGDGVKDLQSTSPMSETPSSKQQLSEKSSLLKLQSRISSLLDSESPENNAGKMIDSIRNILKDIEDEADSINANGTHHLDGTLSSGSECAMDQELKTAILRIQDFVMLLDQELSKFQGQSSDYDGLFEKTQQFSALIDKVLSNDNGLNDFVMALSVILSETSQIKFTMSRDNSNEAESNNLACVDKVTLLENKVQPEPVKDSVSDLCPLLPRSSSDPEFEGPADAGFDAKTALKICSPEEYEQLKSEKTNLEEELAKCNDIIEETKVRLSDMEKNLEDLTAKLADSEKSNSLSETQLKCMAESYKSLESRKVELENEIEVLQSKIDTLTAELTDERQSHQENLAKYKDLEEKMERYELERRSMFVDEGPDTNSKQEKEIAAAAEKLAECQETILILGRQLQAMRPSAESLGSSPNRQRMEDFLQDAVGTTAGESSQKPGGQPDTDQEILGAGNESPVNRFKTHITPSDADESPFPSPNNSKRPKHRSRSSSSSSFANHQLPEKQSRGFSRFFTKGKE

SEQ ID NO: 19807 - DNA, 1416 bp, Panicum virgatum
  misc_feature: Ceres CLONE 1807071
  misc_feature: Encodes the peptide sequence at SEQ ID NO. 19808
acgctcacgcccgtccgtctcttccgtcgaccgtcttccccaactcccggcggccgcgctcctccgtcctccctccacggcgcttgcgacccgtccgtcctgcgcccagcagccacactcgtggcagtagggggggcgagccggcggcgtccggggtcctctcgccggctgctggcagcccgtctagactggccgtgatgctcctggcgcgcaccctgcgctcccgcctccgcccgccgctcgcggcggcggcggcgttctcctcggcgccggcatcggcggccgcggcggaggcggagcgggcgatacgggacggtccccggaacgattggagcaggcctgagatccaggccatctacgactccccgctcctcgatctcctcttccacggggtacgcacgcctgcctttgcgcgcctcatcccatctggacggacacattgcgataccaaaatcgcccgttatttttgcccccaatggacttagaacttcagcgaaagttctgtatttaatctttcggggtttggaaggccgtagatttgctgccaaggctggatatgtggtattagagatgaagcaagtacatttttgttggcgccgggtgaagattgctagtggctttcgggggccagtgccaaaaacgtttatttcgggggattttcttgttcaaattagccatatgctttagtacgggctccaaaatttttaatgatagttataattgttatctgtggtggttccttgctctgtaatcttccataagatcactagtgatgactttatagtggatgttttatggtgggaatccaaaaaatcatcgccatagtttcaaaatatgcagccaaactgaatagatatatattattaggttgagcaactccagcagacgctctaaacagcccctatctcaagttagcgggttaattaagctaaaaagatgcattccagcagactctctactaggctctctatttttgggatgcctccatattccttcctccaccctccatttctagggggcctctagggagccctctattataagttagaattgagagctactgctggagttggagcaaatttggaggcctttaaaaaatagaggtagcccctatttcgcatttagagggtctgatttaagggctgctgctggagttgctcaacttttacaacataacagagatcccgaaatcttatgtcatcttttatagaattaaaagtaggactgcacctcttcatgttatttggtagccacgctgagaatgttgcaccctttagtttcctaaaaagatcacatagttactttcgatggttgaatttaaagctccacctaaaatgcagagaaagaaaatcaggcatgagctacaagagtcaagtgggatcatcatcctgaaaatgtttgtacatttctaaaatg

SEQ ID NO: 19808 - protein, 95 aa, Panicum virgatum
  misc_feature: Ceres CLONE 1807071
  misc_feature: SWISSPROT Homolog: EC 2.8.1.6 Biotin synthase
MLLARTLRSRLRPPLAAAAAFSSAPASAAAAEAERAIRDGPRNDWSRPEIQAIYDSPLLDLLFHGVRTPAFARLIPSGRTHCDTKIARYFCPQWT

SEQ ID NO: 19809 - DNA, 660 bp, Panicum virgatum
  misc_feature: Ceres CLONE 1807071-R
  misc_feature: Encodes the peptide sequence at SEQ ID NO. 19810
actgctgattatctgccattatctatagttgagatgattgcagctagtgtgtgagcctgcattgcacacatgaaaaacattgctataacacaagtctttgattgcacaatgttgactacaatatgcagattataacctgctttaggattacacatgctgcttttcgtttgtatttgtttgtgctaactagtgttctacatcagcctgtagagatctgggaaatgatccgcatgattgccactgctcggatcgtgatgccaaaggcaatggtgaggctttcggcaggccgcgtacggttctccatgccagaacaagcgctctgcttccttgctggggccaactccatatttgccggtgagaaacttctgactaccgcgaacaatgacttcgatgcggaccaggcaatgtttaagatcctaggtcttatccccaaggccccaagctttggtgatgaagaggcggcagctcctgctgacaccgagaggcctgaacaagccgcttcaatgtaaagaaaaatgtgaaacaaattaccgatttttaatatcaccattactgcgatactagcactagtgttagctagagctagagcattgtattgtagaaaccactattttgtcgtcgcttgagactgaataaaataaactaggcccactgcatgcc

SEQ ID NO: 19810 - protein, 128 aa, Panicum virgatum
  misc_feature: Ceres CLONE 1807071-R
  misc_feature (20)..(103): Pfam Name: BATS Pfam Description: Biotin and Thiamin Synthesis associated domain
  misc_feature: SWISSPROT Homolog: EC 2.8.1.6 Biotin synthase
MQIITCFRITHAAFRLYLFVLTSVLHQPVEIWEMIRMIATARIVMPKAMVRLSAGRVRFSMPEQALCFLAGANSIFAGEKLLTTANNDFDADQAMFKILGLIPKAPSFGDEEAAAPADTERPEQAASM

SEQ ID NO: 19811 - DNA, 2355 bp, Panicum virgatum
  misc_feature: Ceres CLONE 1807077
  misc_feature: Encodes the peptide sequence at SEQ ID NO. 19812
acccgctgctccttcactcctcgctgatccagccattaatgccacaccagcagcatccgctgcctccctctcccttcctccccccattttactcgcccccatacccctctcctctctgtgtctttctcttcccctcttcctccccccacgcgactgctggcaccacgatccctgtcgagaatccggcgtctagctggactgggttgagtgcgcgattcggtctctcagccccgcggggggttccttttgcggtttcaggttctttgcttgagggatgagtggaagcaggcccggctgcagaaagagggtgaaaacttcgtctgcacctgttgctgatgtgcattaggggatctgcggtggtaacatacagctggatctcacgagcttgactgaatcgactcttggagcctgacacagcgccatgggttccggcgatttgagctcggagatgaagaggacggttcttggcctcacgctctgggtctggattgccatcggcgtggtcgccctcctcgtggccatcctgctgatggtctgcatttgggtcgcctcgcgccggaggaccaagagaaccatggacagcctgaggcagacgcagatccccatctactccaaggagatccccgtcgaccgggtcggcggcggccgcagcctcgcgcagacaatgcacgagcgcgagcacccgagcttcccgccgcaggacaagcacgcgagccgggacccggccggggcgacgctgggccacatggcgctcagcaagtcctcggatcacgataacatgagccaggggagctcggtttgcaatgtcgatcgtgccgccagcgtgcactccggtgaggatgggagctcggggccacggaggaagcccaattcgccggcggcgtttgtgtctgcgtcgcctctcgtcggccttcccgaattctctcaacttggctggggtcactggtttactcagcgtgaccttgagcttgctaccaaccgtttctccaagttgaatgtgctgggagagggtggctatggagttgtgtaccgtgggcgcctggtgaacgggactgaagttgccatcaagaagatctttaacaacatggggcaggcagagaaggaattcagagtagaggttgaagctattggccatgtccggcataagaatttggttcggctgttgggatactgtgttgagggtgtaaacaggatgctggtatatgagtttgtgaacaatggcaacttagagcagtggctacatggagctatgcgtcagcgtggagtttttacctgggaaaatcgcatgaaggttgtaacgggaactgcaaaagcgcttgcataccttcatgaagctatagaaccaaaagttgtacaccgagatattaaatcaagtaatatattgattgacgatgaattcaatggcaaggtctccgactttggattggctaagcttttgggctcagataaaagccacattactactagagtaatgggaacatttggatatgtggcaccagaatatgctaatactgggatgttaaatgagaagagcgatgtctatagtttcggtgttctcttgttggaaactgtgacaggaaggggtcctgttgactacagccgatcttccaatgaggtcaatcttgttgaatggctcaaaacaatggtggccagtcgaagggcagaggaagtggctgatccaagcttagaagttaggccatctattaggtctctgaagcgggctcttctagtggcactaaggtgcgttgatcctgactctgaaaagagacccaagatgggccaggttgtcaggatgcttgagtctgaagaagttccgtaccgggaggaccggagaaaccggaggagtcgcactggaagcatggatattgagtctatagcagagggttcaaactctgccgagtttggaaagaaggtggagaggactggcagtgcaacatcagaccgatctcagccttgaggccttgcaaacaaattctatatcgtgaaaagcctgagaaataatgttaatcaccaaggtgattgctgccctgatagggtatgttggtaggtggtggaggcagggcaagccctgatgttactacctgaatcttaggtctactagtatcaggtcgagtagaaacattcttggatgtaggatctcctggtctcctctcctgttgtctgtacaggttatatgttggcgcctagggaattcccttggttgggtgtttaacaattggtcggttcttctggatcttgcactgttaccttctcaaatctggttccttgcttctgcggtgctgtatatgaggttgtactgttaatgttcctggcttgcagcttgttaatatttctctggatttgtctgcagcgtac

SEQ ID NO: 19812 - protein, 511 aa, Panicum virgatum
  misc_feature: Ceres CLONE 1807077
  misc_feature (188)..(459): Pfam Name: Pkinase Pfam Description: Protein kinase domain
  misc_feature: SWISSPROT Homolog: EC 2.7.11.1 Non-specific serine/threonine protein kinase
MGSGDLSSEMKRTVLGLTLWVWIAIGVVALLVAILLMVCIWVASRRRTKRTMDSLRQTQIPIYSKEIPVDRVGGGRSLAQTMHEREHPSFPPQDKHASRDPAGATLGHMALSKSSDHDNMSQGSSVCNVDRAASVHSGEDGSSGPRRKPNSPAAFVSASPLVGLPEFSQLGWGHWFTQRDLELATNRFSKLNVLGEGGYGVVYRGRLVNGTEVAIKKIFNNMGQAEKEFRVEVEAIGHVRHKNLVRLLGYCVEGVNRMLVYEFVNNGNLEQWLHGAMRQRGVFTWENRMKVVTGTAKALAYLHEAIEPKVVHRDIKSSNILIDDEFNGKVSDFGLAKLLGSDKSHITTRVMGTFGYVAPEYANTGMLNEKSDVYSFGVLLLETVTGRGPVDYSRSSNEVNLVEWLKTMVASRRAEEVADPSLEVRPSIRSLKRALLVALRCVDPDSEKRPKMGQVVRMLESEEVPYREDRRNRRSRTGSMDIESIAEGSNSAEFGKKVERTGSATSDRSQP

SEQ ID NO: 19813 - DNA, 1783 bp, Panicum virgatum
  misc_feature: Ceres CLONE 1807083
  misc_feature: Encodes the peptide sequence at SEQ ID NO. 19814
attgcttattactatcatccaacccgctcgatcgctatcatttctctgccaagtagtacaagctcccaagcacctgctgatctacctctctctgccgcaagagagaagagaagaagatggccagagggggggcgctcaccgtccgcttggaagaaggcggcggcggcggcggtgcggtaacgttcacggttgtgatgagctgcctcaccgcggcctccggcgggctcctgcttggatacgacatcagtgttacaggaggactgatgcagatggaatcgttcctccaggcgttcttcccggagatcctccggaagacggacaacaagcagcaggacgcgtactgcatctttagaaaccaggagctcaccatgttcgtctcctcgttatacctcgccgccatcatctcctccctcgtctccggccacctgaccaggaaagtgggccggaggaactccttactgaccggcggcttcctgttcttggccggcgtcgtcctcaacttcactgccgtcagcatcagcatgctcgtcatcggccgcgtcctcctcggcctcgccgtcggcttcaccagcctgtctgcaccggtgtacctggcggagatagcgccggcacggtggcgaggtgcgttcacgaccagcttccacttcttcttcaacgtgggcatgctcatggcggacctggtgaactacggcgccgacaccatcccgaggtcggggtggcgcgtgtcgctcggcgtcggcctcgtcccggccgccgtcatcatcgtcggcgcggcgctcatccccgacacccccaacagcctggtgctgcgcgggaggctcgacgaggcccgcgcctcgctgcggcgcatccgcggggcggcggcggtggctgccgacaccgaggcggagctcgaggacatcgcccgcgccgcggagcaggaccgcaggcacgagtccggcgcgttccggagcctgttcttccggcgagagtaccgcccccacctcgccattgctgtcgcgacgccggtgttcttcgatctgaccggcatgatcgtggtgtccattttcacgccgctcctcttctacaccgtcgggttcgcgaaccagaaggccatcctcggcaccatcatcaccgacgtggtcagcctcgcgtccatcgccgtcgccgggctggccgtggaccgctacggccgccgctcactcctcatgctgggcagcgccgtgctgatcctctcccaggtggccatggcgtggatcttgggcgcgcagctggggaccgacggcggcaagtccatgccccgcgggtacgccgcggcggtggtggcgctggtgtgcgtgtacacggcggggttcggcgtgtcctggggcccgctgaggtgggtggtcacggccgagatcttcccgctcgaggtgaggccggcggcgctcggcctcggcggcgccatctccggggtgctggtcttcgtgcagtcacagtcgttcctggagatgctgtgcaccttcaagtacgccaccttcttgttctacgccgggtgcgtggtcgtcatggtggcggccgttgcggcgttcctgccggagacccgcggcgtgcccatcgaggccatgggcgccgtgtgggagcgccactggtactggaagcgcttcgtcacgccggcacccgccaaattttcagatgggccggtttaattgcggctgcgttttacacggtccatcgaaagcaagataccctgttgatctttataaaaaaggaataatatcatcctgtcaactaatggagcagtttgttattgattttttttttc

SEQ ID NO: 19814 - protein, 516 aa, Panicum virgatum
  misc_feature: Ceres CLONE 1807083
  misc_feature (28)..(494): Pfam Name: Sugar_tr Pfam Description: Sugar (and other) transporter
MARGGALTVRLEEGGGGGGAVTFTVVMSCLTAASGGLLLGYDISVTGGLMQMESFLQAFFPEILRKTDNKQQDAYCIFRNQELTMFVSSLYLAAIISSLVSGHLTRKVGRRNSLLTGGFLFLAGVVLNFTAVSISMLVIGRVLLGLAVGFTSLSAPVYLAEIAPARWRGAFTTSFHFFFNVGMLMADLVNYGADTIPRSGWRVSLGVGLVPAAVIIVGAALIPDTPNSLVLRGRLDEARASLRRIRGAAAVAADTEAELEDIARAAEQDRRHESGAFRSLFFRREYRPHLAIAVATPVFFDLTGMIVVSIFTPLLFYTVGFANQKAILGTIITDVVSLASIAVAGLAVDRYGRRSLLMLGSAVLILSQVAMAWILGAQLGTDGGKSMPRGYAAAVVALVCVYTAGFGVSWGPLRWVVTAEIFPLEVRPAALGLGGAISGVLVFVQSQSFLEMLCTFKYATFLFYAGCVVVMVAAVAAFLPETRGVPIEAMGAVWERHWYWKRFVTPAPAKFSDGPV

SEQ ID NO: 19815 - DNA, 2103 bp, Panicum virgatum
  misc_feature: Ceres CLONE 1807116
  misc_feature: Encodes the peptide sequence at SEQ ID NO. 19816
atattcgcttacactcgcgctgccatcatctccgcgcagcgcctctcctccctccctctggcttcgccgctggacgagagcacgcgttgagacggggccggtcgggcgcggctctatctgcgcctcccccccggccatatttcgcctcctctggccggatctcaccctgcggctcgtcccgtggctgtcctgcgccgttcagagttcgagcacatggtctctccgtgcatcattaagagaccgagccgccgtccccccatccccttctatctgctaattcatttgttctagccttcatattagcccatgttcattccataatactcctactttagtaccattgtacctcattacaatacctgacactccttaacctgctgttacaaattaggttgagctgctcgattcgatcaataaagaagggtgaaaggctacgtgagctcttgctgcagctagaacaacttacaccagaatcatggcgagccttgccgattcttttctagcggatcttgatgaactgtcagacaatgaaggctatcctgaagaagacaatgctgaggcagctggtatggaggatgacggtgatgatgatatgcctgaccttgagtctcttaattacgatgatctggatagtgtctcaaagttgcagaagacgcaacgctataatgacataatgcaaaaagttgaagatgcacatcagaaaggcactgacttctccaatcaaggttccatcctggaggaggatccagagtcccagcttattgtggactgcaatgctttatcagtagatattgagaatgagataaccataatccataatttcataagtgacaagtataggttgaagtttcctgaactggagtcccttgttcatcatccgattgattatgcccgtgttgtcaaaaagattggaaatgagatggacttaacacttgtagatctggaagggcttttaccttctgcaattataatggttgtctcagtgacagcatcaacaacaagtgggaagcctctttcagaggaaaatttggaaaaaacagttgaagcttgtgacagagcccttacgctcgatgccgcaaagaagaaagtgcttgattttgtagagagtagaatgggttacattgcaccgaacctttctgccattgttggcagtgctgttgcctcaaaactgatgggtactgctggtggtctgggagcacttgcaaaaatgcctgcttgtaatgttcagttacttggtgcaaagaggaaaaatcttgctggattttctactgccacatctcagtttcgagttggctatcttgaacaaactgaagtatttcagagcacatctccagctctgaggactagtgcttgcaagcttattgctgcaaagtcaactctagcagcaaggattgattcaattagaggtgatccaactggaaaagctggacggaacttattagaagaaattcgtaagaagattgagaagtggcaagaaccgcctcctgcaaagcttccaaagccacttcccgttccggactctgaacctaaagggaagggagggggtcgtcggcttcgtaaaatgaaagaaagatatgcgcaaactgatatgatgaagcttgcaaaccggatgcaatttgggattccagaggagagctctttaggtgatggcttgggggaaggttatggcatgctcggacaggcaggaagtggcaagctgcgtgtctcagctggacaaagcaaacttgccgctaaagtggccaagaaattcaaggagaagagctatggtagcagcggtgcaacttcaggattgacatctagtttggcatttacaccagttcagggaatagagttgtcaaatccacaggcgcaagggaacccgcttggtggtggaactcaaagtacctacttttctgagactggtacattttcaaagatcaggaggacccaatagaagctgatttccccgttgcaaccatctcatctcatctcatctgcactgcagttgaaatcgttgggacattgttgaaaaatccaaaaatccagcatgtgaatttaccaagtcttgtttttcaattgaagcaaaatccagagattttatgaaagacggtttagttttgcttc

SEQ ID NO: 19816 - protein, 485 aa, Panicum virgatum
  misc_feature: Ceres CLONE 1807116
  misc_feature (187)..(335): Pfam Name: Nop Pfam Description: Putative snoRNA binding domain
  misc_feature (95)..(147): Pfam Name: NOSIC Pfam Description: NOSIC (NUC001) domain
MASLADSFLADLDELSDNEGYPEEDNAEAAGMEDDGDDDMPDLESLNYDDLDSVSKLQKTQRYNDIMQKVEDAHQKGTDFSNQGSILEEDPESQLIVDCNALSVDIENEITIIHNFISDKYRLKFPELESLVHHPIDYARVVKKIGNEMDLTLVDLEGLLPSAIIMVVSVTASTTSGKPLSEENLEKTVEACDRALTLDAAKKKVLDFVESRMGYIAPNLSAIVGSAVASKLMGTAGGLGALAKMPACNVQLLGAKRKNLAGFSTATSQFRVGYLEQTEVFQSTSPALRTSACKLIAAKSTLAARIDSIRGDPTGKAGRNLLEEIRKKIEKWQEPPPAKLPKPLPVPDSEPKGKGGGRRLRKMKERYAQTDMMKLANRMQFGIPEESSLGDGLGEGYGMLGQAGSGKLRVSAGQSKLAAKVAKKFKEKSYGSSGATSGLTSSLAFTPVQGIELSNPQAQGNPLGGGTQSTYFSETGTFSKIRRTQ

SEQ ID NO: 19817 - DNA, 1746 bp, Panicum virgatum
  misc_feature: Ceres CLONE 1807118
  misc_feature: Encodes the peptide sequence at SEQ ID NO. 19818
atccagttcacgcgaacagtaggtgaccaaaaccaaggagggccgccatgcacccagcactgttcatggagacgctccaagtccaagcagctcatgctgagctctttgcacgcgccttcctcgccctcgtcgccaccgttgccgtcctctacctcacgcggctgctgctcgcgccgctcaagaggcgcgccgccgccagctcgccttccctcccgcgcccgaggggcctccccctcatcggcaacctccaccagctcggcgcggtcccgcacgactccctcgccgcgctggccgccaggcacgacgcgccgctcatgctgctccgcctgggctccgtgcccacgctcgtcgtctccaccgccgacgcgctgcgcgccgcgttccagcccaacgaccgcgccatgtcggggcgcccggcgctgaccgtggccaccaggatcacctacggcctgcaggacatcgccttctcgccgccggacggcgccttctggcgcgccgcgcgccgcgcgtccctgtcggagctcctgggcgccccgcgcgtgcgcgccttccgcgacgtccgcgagggcgaggccgccgcgctcgtcgccgccgtcgcggccgcgtccgcggccggctcccccgtgaacctcagcgagatgctcatggcgacgagcaacaggatcctgcgccgcgtcgcgttcggtgacggcggggacgacgggagcatcgaggccggcgccgtcctcgacgagacgcagaagctcctgggcgctttcttcgtggccgactacatgccgtggctggggtgggtggacgcgctccggggcctgcggcggcggctggagcgcaacttccatgagctcgacgcgttctacgagaaggtgatcgacgaccacctcaacaagcgcgcggattccaaaggcgaggacttggtcgatgtgctcctccgcctgcacggcgatccggcttaccggagcacgttcagcagccgtaaccggatcaaaggcatcgtcacggacatgttcatcgctgggacagacaccaccgcggcgacgttggagtggacgatgacggagctgctccggcacccggacatcctcgccaaggctcagcaggaggtgcgcggcggcggcggggacatcgtcctcgagtccgacctcccgcgcctcaagtacctgaagcaggtcatccgggagtcgatgcgggtgcacccgccggtgccgctactggtgccccgggagaccatcgagccctgcgcggtgtacggctgcgagatcccggccgggacgcgggtgctcgtgaacgccagggccatcggccaggaccccggcgcgtggggccccgacgcggcgcggttcgtgccggagcggcacgcggaggtcgccgacctcagcgaccacaagccgtggcacgacagcttctcgctcgtgccattcggggtcggccggagaagctgccccggcgtgcacttcgccacctccgccgttgagctgcagctggccaacctgctcttctgcttcgactggcgcgcgcccaacggcgaggccgtggacctggagcaggagaccgggatgaccgtgcacaggaagaaccctctcgtgctcgtagcggaaaggagacgcgtgcagtgagatcacctcgttggcgtccttaagacgacgacgagtacgctttcgtgtagtattccgttgctgtatttcagtacgtaggaacctagcttgctatacatgtcgtcacgtatatccaatccctttattttttcag

SEQ ID NO: 19818 - protein, 521 aa, Panicum virgatum
  misc_feature: Ceres CLONE 1807118
  misc_feature (55)..(514): Pfam Name: p450 Pfam Description: Cytochrome P450
  misc_feature: SWISSPROT Homolog: EC 1.14.13.68 4-hydroxyphenylacetaldehyde oxime monooxygenase
MHPALFMETLQVQAAHAELFARAFLALVATVAVLYLTRLLLAPLKRRAAASSPSLPRPRGLPLIGNLHQLGAVPHDSLAALAARHDAPLMLLRLGSVPTLVVSTADALRAAFQPNDRAMSGRPALTVATRITYGLQDIAFSPPDGAFWRAARRASLSELLGAPRVRAFRDVREGEAAALVAAVAAASAAGSPVNLSEMLMATSNRILRRVAFGDGGDDGSIEAGAVLDETQKLLGAFFVADYMPWLGWVDALRGLRRRLERNFHELDAFYEKVIDDHLNKRADSKGEDLVDVLLRLHGDPAYRSTFSSRNRIKGIVTDMFIAGTDTTAATLEWTMTELLRHPDILAKAQQEVRGGGGDIVLESDLPRLKYLKQVIRESMRVHPPVPLLVPRETIEPCAVYGCEIPAGTRVLVNARAIGQDPGAWGPDAARFVPERHAEVADLSDHKPWHDSFSLVPFGVGRRSCPGVHFATSAVELQLANLLFCFDWRAPNGEAVDLEQETGMTVHRKNPLVLVAERRRVQ

SEQ ID NO: 19819 - DNA, 1852 bp, Panicum virgatum
  misc_feature: Ceres CLONE 1807132
  misc_feature: Encodes the peptide sequence at SEQ ID NO. 19820
gtttgaccgggttgagtccacggcccatgaggccgaagacccccacctgccccgcagccagggcgccgcggcgccgccgccgccaactaacgcctctcttgccaccaccaccaaccccgcggcggccggcctcgcccgataagacgccggcccgcctcccgcctcccccttccgctcccactgcgtgccacgaccagccacctcctgctcctgcagcgatgccgcccccgtccctcttgctcctccactcccgcgccccgcttcagccccgctccttccggatgaactcccggggagctccaagcagggtcgtcgtctgctccgccgcgtccggcgaggggttcatctccgcggctccgatccttctcccagagggtccctggaagcaggtggaaggtggcgttactgcctcgaaagggttcaaagcggcgggcatctacggtgggctgcgcgccaagggcgagaagcccgacttggcattggtcgcctgcgacgtcgacgccaccgtagcaggagcttttactacaaatgttgtcgctgccgcacctgttttgtattgtaagaacgtcctcagtacatcgaaaacaggtcgtgctgtgctaattaatgctggacaagcaaatgctgcaactggtgatcttggctatcaggatgcagttgatagtgcacttgctgttgccaagcttctcaatgtgagcacagatgacatattgattcagtctactggtgtcattggtcaaagaataaagaaggaggcacttttaaattcactgcctagacttgtgggctcactgtcttcttcagttcagggcgcgaattctgctgctgtggccattacaactacagaccttgttagcaagagcattgctgtccagactgagattggaggagtggctatcagaataggaggaatggctaaaggttctggaatgattcacccaaatatggcaactatgctcggggttttaaccactgatgctcaagtcagcagtgatgtctggagagaaatggtccgaacctcagttagtagaagtttcaaccaaattacagtggatggtgatacaagtaccaatgactgtgttattgctatggcaagtgggttatctggtttatctggaattctcagtcttgacagcactgaggcccaacagttccaagcatgcctagatgcagtaatgcaaggtcttgcgaaatccattgcatgggatggtgagggtgcaacatgcttaattgaggttactgtaagtggtgcgaacaatgaggcagaagctgctaaaattgctcgttcagtagcatcttcttctctggttaaagccgctgtgtttggaagagatccaaattggggacgtattgcttgctcggttggctattcaggcattcagtttgatgcaaatcaacttgatatttctctgggagctattccactaatgaaaaatggtcaaccactaacctttgacagatccgcggctagcaagtatctcaaagatgctggagatgtccatggtacagtgaacattgatatatcagttggaaatgaaggaggaaatggaaaggcatggggctgtgatctgagctacaaatatgtcgaaataaatgctgaatatacaacgtgagatttatattcactgtgaagaaaaatgtcttcattggttggaaacttggaatgatgaatctttcggtgcaaccagccaaccaccatctggagaatgtatatcgtattgcaacagccagccatttcttaccaagatgttgcgcatgtactattctttcccgcgagatcaatttaaatcaatgccttgtaaatgtaataatgagatgaataatggtggactgacatggtattgattccacc

SEQ ID NO: 19820 - protein, 464 aa, Panicum virgatum
  misc_feature: Ceres CLONE 1807132
  misc_feature (68)..(464): Pfam Name: ArgJ Pfam Description: ArgJ family
  misc_feature: SWISSPROT Homolog: EC 2.3.1.35 Glutamate N-acetyltransferase
MPPPSLLLLHSRAPLQPRSFRMNSRGAPSRVVVCSAASGEGFISAAPILLPEGPWKQVEGGVTASKGFKAAGIYGGLRAKGEKPDLALVACDVDATVAGAFTTNVVAAAPVLYCKNVLSTSKTGRAVLINAGQANAATGDLGYQDAVDSALAVAKLLNVSTDDILIQSTGVIGQRIKKEALLNSLPRLVGSLSSSVQGANSAAVAITTTDLVSKSIAVQTEIGGVAIRIGGMAKGSGMIHPNMATMLGVLTTDAQVSSDVWREMVRTSVSRSFNQITVDGDTSTNDCVIAMASGLSGLSGILSLDSTEAQQFQACLDAVMQGLAKSIAWDGEGATCLIEVTVSGANNEAEAAKIARSVASSSLVKAAVFGRDPNWGRIACSVGYSGIQFDANQLDISLGAIPLMKNGQPLTFDRSAASKYLKDAGDVHGTVNIDISVGNEGGNGKAWGCDLSYKYVEINAEYTT

SEQ ID NO: 19821 - DNA, 1815 bp, Panicum virgatum
  misc_feature: Ceres CLONE 1807163
  misc_feature: Encodes the peptide sequence at SEQ ID NO. 19822
atcacatcccagttcccggcttccagctgtggttgatcagcgagaagagagcatctacttaccagtcgtctagcggcacaacacacatagagagacagggagggagaagatcaatcaatgcattaccggccgagctgatctgatcacctctctcctccggccactcccccaggccaccatcccgttcctctcacaagaatcactcctgctccctcctcagatctctctctcgcgagcaaaacaggcaaagctttaccccgggtaaggttacgggcagccatgaggcggcggccaccttcccattcccgtgccgccgccgccgctgccgtgctcctgctcctgctcctgctgctgtcccccgctccgagctcccagctcgacctgggctccgccattgccgcctggatcaacggcgcgccaccgccgtctcctagccctcccgccggcgccggcgtcggcgcctcctcctcctcatcctcagccgcgccgagtcaggagtacacggcgctgcaggcgctgaaggcggccgtcaccgaggacccccgcagcgcgctgtcgtcgtggcagggcgccaatgtctgcgcctacagtggcgtctactgctccgcgccgcccgacggcgcgggcgcgcccacggtggtggcggggatcgacctcaaccgcgccagcctcaggggcacgctccccgaggcggtctccctcctggcgcacctcacgttcctccacctcaacagcaaccgcctgggcggcgccgtcccggactcgctccgggacctgcagtacctgacggagctggacctcagcaacaacctcttctccggcccgttcccggcgtccacgctgctcatcccgtcgctggtgtacctggacctccgcttcaacgccttctccggggagctcccgcccgatgtgttcgccaaggacctcgacgccgtgttcctcaacgacaaccagttcgagggccagatcccggagacgctgtggtcgtcgcccgccacggtcatcacgctcgccaacaaccgcttcacgggcaccgtcccggccgcctacgggtacggcggcggcggtggcggcggccgggttcgcgaggtgctgttcctgaacaacaacctgaccgggtgcgtgcccgaggcgctggggttcctgcccagcatccaggtgctggacctgagctacaacgcgctgtcggggcacctccccggcacgctgtcgtgcctgtccgtgatcgaggtgctcaacgtggcgcacaaccagctgacgggggagctcccggacctgctgtgcgacctgcggcggatcacgaacctgtcggtgtccttcaacttcttctccgggatcagccagcggtgcgaccggcagctggggagccgcggcgtgttcgacttcgtgggcaactgcgtgcccgggcgggacatgcagcggccgcagcccgagtgcgaggggttcccgggggagggcgggctcagctgcctccgcatccccggggcgcggcccgccgggtgcggcggcgacgcggccgcgtccgtgggcgtcggcgtcggcgtcggggtcggggtcggggtcggggtcgggggcgggggcctgccgttcgggctgccaggcgccgccgccggggccgggggcgcggtcaccgtcaccgtgccctgatcggtgccgctgcaggccgctggcattgcatcttttcctttcgttttcctttttttttgaggcaattagcctcgatcggcttggcgcatcgcatctgatcgttaatttacatggcggtggtaacgggtgaatattggttggttggttggttcttggctcattctgttc

SEQ ID NO: 19822 - protein, 455 aa, Panicum virgatum
  misc_feature: Ceres CLONE 1807163
  misc_feature (70)..(109): Pfam Name: LRRNT_2 Pfam Description: Leucine rich repeat N-terminal domain
  misc_feature: SWISSPROT Homolog: EC 2.7.11.1 Non-specific serine/threonine protein kinase
MRRRPPSHSRAAAAAAVLLLLLLLLSPAPSSQLDLGSAIAAWINGAPPPSPSPPAGAGVGASSSSSSAAPSQEYTALQALKAAVTEDPRSALSSWQGANVCAYSGVYCSAPPDGAGAPTVVAGIDLNRASLRGTLPEAVSLLAHLTFLHLNSNRLGGAVPDSLRDLQYLTELDLSNNLFSGPFPASTLLIPSLVYLDLRFNAFSGELPPDVFAKDLDAVFLNDNQFEGQIPETLWSSPATVITLANNRFTGTVPAAYGYGGGGGGGRVREVLFLNNNLTGCVPEALGFLPSIQVLDLSYNALSGHLPGTLSCLSVIEVLNVAHNQLTGELPDLLCDLRRITNLSVSFNFFSGISQRCDRQLGSRGVFDFVGNCVPGRDMQRPQPECEGFPGEGGLSCLRIPGARPAGCGGDAAASVGVGVGVGVGVGVGVGGGGLPFGLPGAAAGAGGAVTVTVP

SEQ ID NO: 19823 - DNA, 659 bp, Panicum virgatum
  misc_feature: Ceres CLONE 1807175
  misc_feature: Encodes the peptide sequence at SEQ ID NO. 19824
agagagagaaagtgagttccagcgaagcagccagcagcccgccacgccttcctccttcctctcgcggattcagagctccagacctcctccgtgtccgtgggtgcgaagcggcgcaacggcggcggcggcaacagcgaaagcgtgatcgccttcccgggagcgggaagctcgagttgagcggcggcgcaacggccgccgatgggaccaatggagccgcgctaccgtcccgccggcgcccctgaggatacaactaagagaaggacctctaaaagcaaaagcttcaaagatgtcgaaaattttgaagttcttgtcattgaaaagaactgtggttgcaagttcaaatctttgaagatcatgatcatagctatcatttctgcaacagttcttacccttataaccccaaccttgtatgagcaccaattgcagtcagcctcccggtttgtggacgtcggttggatgtgggacaaaacaagttctgacccgcgatatgcttcatctgttgatgttcagtgggatgatgtacatagagcactcagaaatctaaaaagtggtaatcaagatctcaaagttggactcttgaattttaacagcaccgagtatggctcctggacacagttgttgccggacagccatgtttccataataagacttgagtatgc

SEQ ID NO: 19824 - protein, 153 aa, Panicum virgatum
  misc_feature: Ceres CLONE 1807175
  misc_feature: Functional homolog of the protein sequence given in SEQ ID NO 50565
  misc_feature: Useful for making plants with altered carbohydrate content
MGPMEPRYRPAGAPEDTTKRRTSKSKSFKDVENFEVLVIEKNCGCKFKSLKIMIIAIISATVLTLITPTLYEHQLQSASRFVDVGWMWDKTSSDPRYASSVDVQWDDVHRALRNLKSGNQDLKVGLLNFNSTEYGSWTQLLPDSHVSIIRLEY

SEQ ID NO: 19825 - DNA, 598 bp, Panicum virgatum
  misc_feature: Ceres CLONE 1807175-R
  misc_feature: Encodes the peptide sequence at SEQ ID NO. 19826
atgttctccactacctgggcctgaagccgtggctgtgcttcagggactatgactgcaactggaacaaccccccgatgcgcgaattcgctagtgacgtcgcgcacgcccggtggtggaaggtgcacgacaggatgccccggaagctccagtcctactgcctcctgaggtcacggcagaaggccgggctggagtgggaccggaggcaggctgagaaggccaactctgaagatggccattggcgccgcaacatcactgaccccaggctgaagacctgctttgagaagttctgcttctgggagagcatgctctggcattggggcgagaacaataacaggacgaagggcagccccgcgacggtgacgacggcgagcttggcaagctcatgatctgtacatataaaaacaagcaacttcccataaggcaaccatacatgcatagcaatagtttgtataggtacctgtgcttcttaggtctttgctatacaaaatacacccctccctgttgctgtcatggctgcagctctatgtcagctgccggcctgcctcgatggctaacgattcttttgggttggctgagataataagttacttttacatgc

SEQ ID NO: 19826 - protein, 127 aa, Panicum virgatum
  misc_feature: Ceres CLONE 1807175-R
  misc_feature: Functional homolog of the protein sequence given in SEQ ID NO 50565
  misc_feature: Useful for making plants with altered carbohydrate content
  misc_feature: Functional homolog of the protein sequence given in SEQ ID NO 50566
  misc_feature: Useful for making plants with altered cell wall content and/or composition
VLHYLGLKPWLCFRDYDCNWNNPPMREFASDVAHARWWKVHDRMPRKLQSYCLLRSRQKAGLEWDRRQAEKANSEDGHWRRNITDPRLKTCFEKFCFWESMLWHWGENNNRTKGSPATVTTASLASS

SEQ ID NO: 19827 - DNA, 701 bp, Panicum virgatum
  misc_feature: Ceres CLONE 1807176
  misc_feature: Encodes the peptide sequence at SEQ ID NO. 19828
acggctccactcacgccacgcggcggcggttaccatcaccggcgccggtacaccctgccttatccgacccggtgagaagcaccacccagcccacacgcacagggggccgcggggacccgcgaattcggcacgcaccacagccatggacgcgccccagctcctcctcggcgcgctcctcttcctcctccccgccgcgctcctcctcctcaccctcctccaccgctcgcggggcaagcgcccgcgcctcccgccgggcccgccgtccctgccgctcctcggcagcgtggtgtggctcaccaactcgcccgccgagatcgagcccctgctgcggcgcctcttcgagcggcacggccccgtcgtggcgctccgcgtcggggcgcgcctctccgtcttcgtcgccgaccgccgcctcgcgcacgcggcgctcgtcgagcacggcgccacgctggcggaccgcccggcgctcgcgtcggccaggctcctcggcgagaacgacaacaccatcacccgcgccagctacgggcccgtgtggcgcctcctccgccgcaacctcgtcgccgagacgctgcacccgtcgcgggtgaggctcttcgcgccggcccgcgcctgggtgcgccgcgtgctcgccgacaagctcggggaggccgcacccggcgcgccgccgccccgcgtcgtggagacgttccagtacgccatgttct

SEQ ID NO: 19828 - protein, 186 aa, Panicum virgatum
  misc_feature: Ceres CLONE 1807176
  misc_feature: SWISSPROT Homolog: EC 1.14.13.88 Flavonoid 3',5'-hydroxylase
MDAPQLLLGALLFLLPAALLLLTLLHRSRGKRPRLPPGPPSLPLLGSVVWLTNSPAEIEPLLRRLFERHGPVVALRVGARLSVFVADRRLAHAALVEHGATLADRPALASARLLGENDNTITRASYGPVWRLLRRNLVAETLHPSRVRLFAPARAWVRRVLADKLGEAAPGAPPPRVVETFQYAMF

SEQ ID NO: 19829 - DNA, 656 bp, Panicum virgatum
  misc_feature: Ceres CLONE 1807176-R
  misc_feature: Encodes the peptide sequence at SEQ ID NO. 19830
ccacgagatcaaagccgccaccgacgacgacatggaagaggtctccgaggaggacgtccacaagatgccgtacctcaaggcggtggtcctggagggcctccgcaagcacccgccggcccacttcgtgctgccgcacaaggctgcggaggacatggagatcggcgggtacctgatccccaagggcaccacggtgaatttcatggtggccgagatgggccgggacgagcgggagtggaagaacccgatggagttctcgccggagcggttcctccccggcggcgacggcgagggcgtcgacgtgacgggcaccaaggggattaggatgatgccgttcggcgtgggccggaggatctgcgcggggctcggcatcgcgatgctgcacctggagtacttcgttgccaacatggtcagggaattcgagtggcaggaggtgcccggcgaggaggtggacttcgccgagaagaacgagttcaccgtcgtcatgaagaagccgcttcgcccgcgccttgtgcccaggagggctcggagtgcgagttctcactagctatcttgaattacagcgatctaatagcagagtggttccatggtttcttgctgtgtgatgtaaatatctattcagaatactgctcactagctgtcaagaattacagttttct

SEQ ID NO: 19830 - protein, 180 aa, Panicum virgatum
  misc_feature: Ceres CLONE 1807176-R
  misc_feature: SWISSPROT Homolog: EC 1.14.13.21 Flavonoid 3'-monooxygenase
HEIKAATDDDMEEVSEEDVHKMPYLKAVVLEGLRKHPPAHFVLPHKAAEDMEIGGYLIPKGTTVNFMVAEMGRDEREWKNPMEFSPERFLPGGDGEGVDVTGTKGIRMMPFGVGRRICAGLGIAMLHLEYFVANMVREFEWQEVPGEEVDFAEKNEFTVVMKKPLRPRLVPRRARSASSH

SEQ ID NO: 19831 - DNA, 2327 bp, Panicum virgatum
  misc_feature: Ceres CLONE 1807197
  misc_feature: Encodes the peptide sequence at SEQ ID NO. 19832
ctctctctggcccctactcccccatgctgatcacaccgcatcgcatctctctctcgcttgtttcgctcgcagaaccccgcctccgccgcggctccggcgccgcatccatatccaggagcagtcagtcccttccccgcgcggggcggtggagacggcttggttatttctcagatgtaatttggtgatgctggggcttgtttagtcatcttggtttgaagataccagccatgggtcatctgaattatggagtctctcttcctctactgctccgtctacaacttttgctgccactacttcttccttttgctatggcagatatagcctctgagaagcaagcactccttgattttgcctctgcagtctaccgtggcaacaagctcaattggagtccaaatatcccactgtgctcatggcatggtgtcacatgctcaccagatcgatcacatatatgggcccttagggtaccaggggctggtttgattggtacaattccagctaatactcttggcaggcttgtgtccctccaagttttaagcctgaggtctaatcgtttgagtggaagtcttccattggatgttgccttacttccttctttacaagccatatttcttcagcacaacgaactgttgggagacttgccttcatttttctctccaagcctcaataccctcgatctctcttacaactcctttacaggacaaataccatcaggtttgcaaaatcttacccaattatctatcctgaatttagcaggaaattccttgtccgggccaatccctgacctcaaacttccaagcctaagacagctaaatctgagcaacaatgaactaaatggttcaattcctccctttctccaaatattctcaaatagctccttcttagggaaccctggattgtgtgggccacctctagctgaatgctcctttctatcttcaccgacaccgtcacaagtgcctttgcttccatcatcgccacatcgtgagaagaaggcaggcaatggcttgataattgccgctgttgttgggggctttgttatatttctgctagctgctgtgatgttcactacgtgcttttcaaagaggaaggagaagaaagatgaggtgggttacaacagtaaggtgactgatggtgccaggattgagaagcgcaaagaagatgtcagtagtggtgtccaaatggctcataagaacaagctggtattcttggatggatgcagttacaactttgacttggaggatttactgagggcttctgctgaagttcttggcaaagggagttatggaactgcctacaaagctatacttgaggatggcactattgtggtagtcaagaggctaaaggatgttgtggcaggaaagaaagaatttgagcagcagatggagctcatagggagggtaggcaaacatgtaaacattgcacctattcgtgcttactactactcaaaggatgagaagcttattgtttatgagtatattgctactggcagcttctcagctctgttgcatggtattaaaggaatttgtgagaagaccccattagattggaataccaggatgaagattatacttggaattgcacgtggaatcgagcacatccatgcagaaggtggctccaagttcgcccatggcaatatcaagtcagccaatgtcctgctcgatcaaggccacaacccatatgtctcagactatggtcttagtgctttgatgagccttccaatcaacacctcccgggttgttgctggttaccgagctccggagacctttgaatccaggaaattcacacacaagtctgacgtgtacagctttggcgtccttctcatggagatgctgaccggcaaagcctctctccagtcacaggggcaggatgacgtcgttgatctaccaagatgggtgcattctgtggtccgtgaggagtggaccgccgaagtatttgatgtccagctgatgaaatatccgaacatagaggatgagctggtccagatgctccatattgccatggcgtgcacgtcgtggttgccagaccgacgcccaacaatggcagatgtggttcggatgatggaggagctaggccagtctgcttccgagagctgcactccctccaatggcaatcccagggagaccaatcctccatcggtgtgaatttcagtctataatttgtgtgattctgatccgaaattggtgaatccatgacatcgatgatatcctctattggctttatgtggtcctgaagcttacacattagaaccacaccggctgtatgatacggcgttgtatcattacagttgtaatgttattccctgttcatgttaaagttgttattccctgttc

SEQ ID NO: 19832 - protein, 636 aa, Panicum virgatum
  misc_feature: Ceres CLONE 1807197
  misc_feature (340)..(610): Pfam Name: Pkinase Pfam Description: Protein kinase domain
  misc_feature (31)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MGHLNYGVSLPLLLRLQLLLPLLLPFAMADIASEKQALLDFASAVYRGNKLNWSPNIPLCSWHGVTCSPDRSHIWALRVPGAGLIGTIPANTLGRLVSLQVLSLRSNRLSGSLPLDVALLPSLQAIFLQHNELLGDLPSFFSPSLNTLDLSYNSFTGQIPSGLQNLTQLSILNLAGNSLSGPIPDLKLPSLRQLNLSNNELNGSIPPFLQIFSNSSFLGNPGLCGPPLAECSFLSSPTPSQVPLLPSSPHREKKAGNGLIIAAVVGGFVIFLLAAVMFTTCFSKRKEKKDEVGYNSKVTDGARIEKRKEDVSSGVQMAHKNKLVFLDGCSYNFDLEDLLRASAEVLGKGSYGTAYKAILEDGTIVVVKRLKDVVAGKKEFEQQMELIGRVGKHVNIAPIRAYYYSKDEKLIVYEYIATGSFSALLHGIKGICEKTPLDWNTRMKIILGIARGIEHIHAEGGSKFAHGNIKSANVLLDQGHNPYVSDYGLSALMSLPINTSRVVAGYRAPETFESRKFTHKSDVYSFGVLLMEMLTGKASLQSQGQDDVVDLPRWVHSVVREEWTAEVFDVQLMKYPNIEDELVQMLHIAMACTSWLPDRRPTMADVVRMMEELGQSASESCTPSNGNPRETNPPSV

SEQ ID NO: 19833 - DNA, 1804 bp, Panicum virgatum
  misc_feature: Ceres CLONE 1807203
  misc_feature: Encodes the peptide sequence at SEQ ID NO. 19834
aactccatcgcctctcctcccctccaccacctaaacccaaaaacaattccagcaaccgcagctacgaggcggaggcgagcggcgggcgacgacaaagtctccggcggaaaccctagcaggcccggcgcgcaatggcggaggacggcgagaaggccgcgccacccgccgcggcgtcagcggcggcggccgcggactaggagaagcagcagggaagggaggcggcggcgaggaggggagcgtgaagctcttcgtggggcaggtgcccaagcacatgacggaggccgagctgctcgccttgttccgggaggtggccgccgtcgacgaggtcaccgtcatcaaggacaaggtcaccaaggtctcccgaggttgctgcttcctcatatgccccacaagggaagaagctgacaaggcagtgaatgcctaccacaacaagcgcacgctccctggggcatcaagtcctttgcaagtaaaatatgctgatggagagttggagaggctggaacataagcttttcattggaatgcttccgaaaaatgttacggatactgagttgactgatctgttttccaaacatggaaatatcaaggatttacaaattttgagaggttcacaacaaacaagcaaagctggctgcgccttcattaaatatgagacaaaagaacaagcattggcagccattgaggctctaaatgggaagcacaaaatagagggttctagtgtgccattggttgtcaaatgggctgatacagaaaaggaaagacaggctagaaaagcacaaaaagctcaactacagttatctaatatgcccaatgcaagtcctatgcagcaatcttcactatttggagctttacagatgggatatatgcctcaatataacggatttagttatcagccaccagggacctatggacttatgcagtaccctctgtcacctatgcaaaatcaaggtcccttccaaaacatggttcaacctgttaatcaagggaactcaataagaggagtcaaccctgaactgtcccccagttctgttcaaaggtcatttaatgcaatgcagttaggcagcccttatcctcctatccctggtatgcagtatcctggatcatatcctggtggtctcatgaacaatcgtccttttggaaattctcacaattcgattaaagttccaaattcaaatgccacttctgccatatctactagtcccagaagcaatactggtgggcagatcgaaggtcctcctggagccaatctatttatttatcatatcccacaagactatggtgaccaagaactttccagtgcgtttcagagttttggtagagtactaagtgctaaggtgtttgtagacaaagcaacgggtgtcagcaaatgctttggttttgtgagctacgattctccagcttccgcacagacagccatcagtatgatgaacgggtttcaattaggcggtaagaaactcaaagtacaactcaagagagaaaacaacaagcatagtaaaccctattgacaaaagcagcagttgttgtgaccatacgacacgatcaggttcccggtacatatttgtcagataattgatcgtttaccacattgtttccttcatctgctccctcccaaccagccagtcagcccttcagactcggggagcccccattgtatcgttctttgttcagttcacattcttgaaagatcgtcacgttgtgtaatgtaattcattgcagcatagtccgtagcatttgtaccgtcagatcacttgtacacaagactgccaattcattcaattgttaccttttccaactgacaaatggcc

SEQ ID NO: 19834 - protein, 410 aa, Panicum virgatum
  misc_feature: Ceres CLONE 1807203
  misc_feature (326)..(397): Pfam Name: RRM_1 Pfam Description: RNA recognition motif. (a.k.a. RRM, RBD, or RNP domain)
  misc_feature (80)..(152): Pfam Name: RRM_1 Pfam Description: RNA recognition motif. (a.k.a. RRM, RBD, or RNP domain)
MTEAELLALFREVAAVDEVTVIKDKVTKVSRGCCFLICPTREEADKAVNAYHNKRTLPGASSPLQVKYADGELERLEHKLFIGMLPKNVTDTELTDLFSKHGNIKDLQILRGSQQTSKAGCAFIKYETKEQALAAIEALNGKHKIEGSSVPLVVKWADTEKERQARKAQKAQLQLSNMPNASPMQQSSLFGALQMGYMPQYNGFSYQPPGTYGLMQYPLSPMQNQGPFQNMVQPVNQGNSIRGVNPELSPSSVQRSFNAMQLGSPYPPIPGMQYPGSYPGGLMNNRPFGNSHNSIKVPNSNATSAISTSPRSNTGGQIEGPPGANLFIYHIPQDYGDQELSSAFQSFGRVLSAKVFVDKATGVSKCFGFVSYDSPASAQTAISMMNGFQLGGKKLKVQLKRENNKHSKPY

SEQ ID NO: 19835 - DNA, 511 bp, Panicum virgatum
  misc_feature: Ceres CLONE 1807204
  misc_feature: Encodes the peptide sequence at SEQ ID NO. 19836
cggcggcttcttcccgtacgggggcctcgggtgggccagcggcggtcccgggcaccggcgcagctcgtcggtgagcgagctctgcctcggcggggccgacggcttcggcttgaagccgtgcctgtactacgcccgcgggtactgcaagaacggcagcgcttgccgcttcgtgcacggcgacgacgccggcgccaccatggagcagcagtgccaggacatcctcctactccgctccaagtcccagcgccttggtgccggcgccttcccctactccccaaccggctcgctccctggctccccctcggtggccagcaagtgcctgagcttgctcttgcagcagcagaacgagaaccagagggcggcagctgcagcggccgccgcagcgctgatgctggggggcgacgaggcgcaccacaagttgatggggcggccgcgcaccgacttggcgagcatgatgaaccccggttcgcggcagatttacctcaccttcccggcggacagcacgttccgc

SEQ ID NO: 19836 - protein, 169 aa, Panicum virgatum
  misc_feature: Ceres CLONE 1807204
  misc_feature (35)..(60): Pfam Name: zf-CCCH Pfam Description: Zinc finger C-x8-C-x5-C-x3-H type (and similar)
GGFFPYGGLGWASGGPGHRRSSSVSELCLGGADGFGLKPCLYYARGYCKNGSACRFVHGDDAGATMEQQCQDILLLRSKSQRLGAGAFPYSPTGSLPGSPSVASKCLSLLLQQQNENQRAAAAAAAAALMLGGDEAHHKLMGRPRTDLASMMNPGSRQIYLTFPADSTF

SEQ ID NO: 19837 - DNA, 556 bp, Panicum virgatum
  misc_feature: Ceres CLONE 1807204-R
actagcacagtaggacctgacctagtagctccatgatatgctactgctacaacagccactagttcatactacacttgacagcactaggtgtgatgcttaccaaccacatgaagataggtaactctaccttgtttgtttgcctgtatgcaaacagccatgcaaggcagtgcacagatgtgacaggctttggcttgaaggaggttggtccagtgtgtgtattgtatgatgtaaaaagatgtcacaagatggagaaacaaacgagtgcagtgtaggtgtgtgattgaaggaccaccaccgtccgcagtctgctgatgccgaactagaaccaagctgtttgtcaatataggaaggagaggtgtcagcgttgttggctgggtggggggttgttcatggatggtcccctcttctttcagcagatgcagctcactacaaaagaaaagatgtttctttttccttttcgtttttttttaacttttgcttctgtcgaatgaatctgctgtagtgacagtgttattgttatacatacaaattaaaggaaagaaagtgaaagatatag

SEQ ID NO: 19838 - DNA, 1835 bp, Panicum virgatum
  misc_feature: Ceres CLONE 1807207
  misc_feature: Encodes the peptide sequence at SEQ ID NO. 19839
aaaaaaaaagctaggctgttcgagctcagaagagccccggtccaccgccgccccgaaaccccagccgatcggcggcgaccgcggccgtcggcggcggagatgtcgctgacctcggtgaagataggcgaggaggtgtggctcacatgcctctcccacgccctcaccaccgagaccgaggaggtcatgggcctcctcctcggcgatgtcgagtcttcgagcaggggcggcgcgaccgccgtgatatggggggcgtcgccgcagatgaggtgcgagcggaagaaggatcgcgtcgaggtcaaccccgagctgctcgccgccgcgtcggcgcaagccgagaaattgacggccaccatcaataaaactacgagggtgatcggatggtaccactcgcacccacatatcaccgtgctgccgtcccatgtagatgttcgtacccaagcgatgtttcagttgctggatacaggctttgtggggctgatattctcttgttttagtgaagatgctcaaaaggctggaaaaatccaagtgattgcctttcagtcacagggtggacaacaacgtaccacacttcctcttgctatggctccagtgattgatcttgattcatcctggagttcatcagataatgcatttgcctcaaattctgcatttgaaggcattgaacaggacacaggggattccagagcttcaaagaatagcaaggcctggggaagatcaccagatatggatctttactctcatcctgacacaaatcattcagcaaagcatcaacccagagaaaatgctattgttccctacaatcctgataacatgcaagaaacatctattgatccatatgattcagatatgacaccaagtatccaggaggctttgcaccggtcaaatatggacataagcggcgcagagtatgtaaggaaggaggtgccacttattgtgcttcctacaagacacctgctcaagctggacactgcaatggcgtcttactgcgatatgcaacgagtcctttttgaagaggagcaatcggcatataatcaagctatgcaacaaaatatttgtgatgggaaaattcatcccctcacatctattcaccatacatctacatacaactcatctctctgcaaactaatggagtattgtttgagtccagctataactgcacttcaggatcgcgtgaaggaaaatgaacttcggctatctatgttacaagaggaggctaaacaacttgcggcagagacccaaagcatgagaaatgattctccccgtcgctttatgaatcatggggctgttggcagcagttcaccaatggcccagaccaggcatcctttctccaatcaagggaacccaaggagccctagaagccctagcggtggcagccggaggagggcctgttgatgtcgatcttcttgccctgtcgtggtgatgaatctcgttgtggcttgaccgaatgctttgcgaaaccccagaccttaagatggacaaagggatagacaatggaactgtacatatccatcttctttcagcgctgcactgctgtggaagctgccaccagtctcgagtttgctttgtggtgtcggggtttcttatccggttgccaaagttgcaccgttacaaatcctttctgtggctggcctgagcttgtagcctgtacatgtagactctgtacctgaactgctgttgctaagatgcaatttatctgggggcgggcaaagatgaagggcgtctttgctatgtaattctggtaaaggaactttgtagcaatccattttgttgaaatgctccaactttgtagcttctgtggtgccaaagctttctatcaaagggaagacatcgaccgg

SEQ ID NO: 19839 - protein, 430 aa, Panicum virgatum
  misc_feature: Ceres CLONE 1807207
  misc_feature (1)..(122): Pfam Name: Mov34 Pfam Description: Mov34/MPN/PAD-1 family
MSLTSVKIGEEVWLTCLSHALTTETEEVMGLLLGDVESSSRGGATAVIWGASPQMRCERKKDRVEVNPELLAAASAQAEKLTATINKTTRVIGWYHSHPHITVLPSHVDVRTQAMFQLLDTGFVGLIFSCFSEDAQKAGKIQVIAFQSQGGQQRTTLPLAMAPVIDLDSSWSSSDNAFASNSAFEGIEQDTGDSRASKNSKAWGRSPDMDLYSHPDTNHSAKHQPRENAIVPYNPDNMQETSIDPYDSDMTPSIQEALHRSNMDISGAEYVRKEVPLIVLPTRHLLKLDTAMASYCDMQRVLFEEEQSAYNQAMQQNICDGKIHPLTSIHHTSTYNSSLCKLMEYCLSPAITALQDRVKENELRLSMLQEEAKQLAAETQSMRNDSPRRFMNHGAVGSSSPMAQTRHPFSNQGNPRSPRSPSGGSRRRAC

SEQ ID NO: 19840 - DNA, 630 bp, Panicum virgatum
  misc_feature: Ceres CLONE 1807208
  misc_feature: Encodes the peptide sequence at SEQ ID NO. 19841
agaagagggaggcccgtggagtatgctacgctttccagaaaggcgagtgcaatcgcggagcttcctgcagatattcgcatgacgagcagaggaatgcaaacaccggttggggttctaaagaggatagcagtgcaccatgggagcatgacaaacaccatgatatgccaaagagtcgtggcatttgctatgctttccagaaaggcgagtgcaaccgtggagcatcctgcaaattttcccatgatgagcagaaaaatacaaacactcgttggagttctagggatggtgaatcatccagatcagagcggtatggagagcgagattctaggagtaggcatgatgatagaaaacaagaatatcgggtgtgtgacaagtcccctgagagatcaagaggtgagaagcggaatgatggcaaatattctcaaggaagaggagaaagatcagaaagacgcagatacgatgacatggatcacaagcgatcaaggtacgatggagatagtgaacgccatgaaagaagtgtgacagatacatgtttgtacttgacttcttgtacaatgtaatcagtttgttaacttttttatattttaacatagataccttcaattgattacatcaagtggtgctttctttcgg

SEQ ID NO: 19841 - protein, 184 aa, Panicum virgatum
  misc_feature: Ceres CLONE 1807208
  misc_feature (56)..(81): Pfam Name: zf-CCCH Pfam Description: Zinc finger C-x8-C-x5-C-x3-H type (and similar)
  misc_feature (3)..(28): Pfam Name: zf-CCCH Pfam Description: Zinc finger C-x8-C-x5-C-x3-H type (and similar)
KREARGVCYAFQKGECNRGASCRYSHDEQRNANTGWGSKEDSSAPWEHDKHHDMPKSRGICYAFQKGECNRGASCKFSHDEQKNTNTRWSSRDGESSRSERYGERDSRSRHDDRKQEYRVCDKSPERSRGEKRNDGKYSQGRGERSERRRYDDMDHKRSRYDGDSERHERSVTDTCLYLTSCTM

SEQ ID NO: 19842 - DNA, 2319 bp, Panicum virgatum
  misc_feature: Ceres CLONE 1807209
  misc_feature: Encodes the peptide sequence at SEQ ID NO. 19843
accccaacagcatcctcctcgcccatctcctcctccctcttcctcattctcggcatcccttcacccgtcgcagacttgcagtctccttcctcctccgcgcgccctttcctagctcgctccgttcacagcggctagcggagcaggagcgaaagcaaaaaaaggccatgggcgccctcctgctcttcgtctgcctcctggcgccgttcgtgctcgcctgcgccgcccgcggcaggcggcggcgggcggcggcgccggcgtcgtcggcgtgcggcaaggcgctgccgctgccgccggggtccatggggtggccgtacgtgggcgagacgttccagctctactcctccaagaaccccaacgtgttcttcgcccggaagcagaaccggtccgggcccatcttcaagacgcacatcctggggtgcccctgcgtgatggtgtccagcccggaggcggcgcgcttcgtgctcgtcacgcaggcgcacctcttcaagcctaccttcccggccagcaaggagcgcatgctgggcccgcaggccatcttcttccagcagggcgactaccacgcccacctccgccgcctcgtctcccgggccttctccccggaggccatccgcgcctccgtgccggccatcgaggccatcgcgctgcgctcgctccgctcctgggacggccagctcgtcaacaccttccaggagatgaagctgtacgcgctgaatgtggcattgctgtccatcttcggcgaggaggagatgcgctacatcgaggagctgaagcagtgctacctgaccctggagaaggggtacaactcgatgccggtgaacctgccgggcaccctgttctacaaggccatgaaggcccgcaagcgcctgggcgacatcgtggcccacatcatctcggcgcgccgcgagcgccggcagcgcgggagagacctcctggcctccttcctggacgaccgcgaggcgctcaccgacgcccagatcgccgacaacgtcatcggcgtcatcttcgccgcccgcgacaccaccgccagcgtcctcacctggatggtcaagttcctcggcgaccacccctcggtgctcaaggccgtcatcgacgagcaggaggagctcgcgcggtccaagtgctcccccgacgcgcccctgacgtgggcggacacccggcggatgcgcatgacgagccgtgtgatccaggagacgatgcgagtggcgtccatcctgtccttcaccttccgggaggccgtggaggacgtggagtaccaagggtacctgatccccaagggctggaaggtgctgcccctgttccggaacatccaccacagccccgaccacttcccctgcccggaaaagtttgacccctcccgattcgaggtggcgcccaagcccaacacgttcatgcccttcggcaacgggacccactcgtgccccggcaacgagctcgccaagctggagatgctcgtgctctttcaccacctcgccaccaagtacaggtggttcacctccaagtccgagagcggcgtgcagttcggccccttcgcgctgccgctcaacggcctgcccatgaccttcacccgcaaggactgatcgagccggcacgcacaggatgcacggtggtattggtattggtatatgctcctacttgtactaagcaatacccaggcacggcacgcggaaaccgctgccggaattgggcgtcggccgcgggcgccggtcgccatcggccatcggatcaggcatgggatcgcagaaagatcacgcaagacgatagcccttgtacagattcttcctcagctctcagctggtaggaccggaccgcaacaagccggaagaggagaccagagacacaaagattaggcgtagccgcgtaggtgtcagtcagtcggtcagtgttaagctaagctaagctgctccagtaggcatcagacgccacaaagaagtggcgctcaactgtaaaccaaacccattttgatcttcttcttatccccccccccctagatttttttttttaaaaaaaaccagccagacagcaccctataggagaagaacaagaaaacaaaaaagaaaggagaagagaggaggcccctgattgggattgtaagcaaaactagttgtccgcctgaaagcaggctggcagctaggccgaataatccatggacggatggatggatgcatcgccggagtcaaaagagaaccacgtcctcgtcccgcagctacggcccgggacggcgacacaccctcttgtattttgtttcgtccaacgcaagagacagtgactgctttcggaacagctactgctcgaactaatttaattgccaagtgcgtgcgc

SEQ ID NO: 19843 - protein, 470 aa, Panicum virgatum
  misc_feature: Ceres CLONE 1807209
  misc_feature (42)..(466): Pfam Name: p450 Pfam Description: Cytochrome P450
  misc_feature: SWISSPROT Homolog: EC 1.14.13.93 (+)-abscisic acid 8'-hydroxylase
MGALLLFVCLLAPFVLACAARGRRRRAAAPASSACGKALPLPPGSMGWPYVGETFQLYSSKNPNVFFARKQNRSGPIFKTHILGCPCVMVSSPEAARFVLVTQAHLFKPTFPASKERMLGPQAIFFQQGDYHAHLRRLVSRAFSPEAIRASVPAIEAIALRSLRSWDGQLVNTFQEMKLYALNVALLSIFGEEEMRYIEELKQCYLTLEKGYNSMPVNLPGTLFYKAMKARKRLGDIVAHIISARRERRQRGRDLLASFLDDREALTDAQIADNVIGVIFAARDTTASVLTWMVKFLGDHPSVLKAVIDEQEELARSKCSPDAPLTWADTRRMRMTSRVIQETMRVASILSFTFREAVEDVEYQGYLIPKGWKVLPLFRNIHHSPDHFPCPEKFDPSRFEVAPKPNTFMPFGNGTHSCPGNELAKLEMLVLFHHLATKYRWFTSKSESGVQFGPFALPLNGLPMTFTRKD

SEQ ID NO: 19844 - DNA, 650 bp, Panicum virgatum
  misc_feature: Ceres CLONE 1807210-R
  misc_feature: Encodes the peptide sequence at SEQ ID NO. 19845
agctggtgcggcaggtcaaggcccccgcgggcgccgccggggtggagctcgccggcgagaacgcgctggagcggtacgacgaggcggccttctcgcaggtggtgtcgacggcgcgcggcgcggggctggccgcgttcacgtacctgcgcatgaataagacgctcttcgacggcgacaactggcggcagttcgtgtccttcgtcaggtccatggccgacggcggcacgaggccggcgctgccgcggtgcgacaccgggcactcggacctgtacgtcggcttcctcgacgcctccaaggagaggaaagcgccggaggccgagggcgccgccaccgccgtggcattgtaggccgtggtgccccaagcccatgcctgtgcgtgcggatcacacacatgcactgttgcaccgtgctgtggaatgtgtgttagggtacgcacaccggagaaggggaagtgtatagattcagggggcttgcaggttgcagagttttataggctgtaatcgagcaggtaggtaaaagcaggcaggcagtgtccagaaccagaccataggctgtcttgcgtttctttgtccatccgaaactgtattataaggagcagcttcgtgattgtacaccttatcgtaaattcagatgaaacaacttgcactgcc

SEQ ID NO: 19845 - protein, 114 aa, Panicum virgatum
  misc_feature: Ceres CLONE 1807210-R
  misc_feature: SWISSPROT Homolog: EC 3.2.1.2 Beta-amylase
LVRQVKAPAGAAGVELAGENALERYDEAAFSQVVSTARGAGLAAFTYLRMNKTLFDGDNWRQFVSFVRSMADGGTRPALPRCDTGHSDLYVGFLDASKERKAPEAEGAATAVAL

SEQ ID NO: 19846 - DNA, 511 bp, Panicum virgatum
  misc_feature: Ceres CLONE 1807210
aattccttcgcttctcgatttcacagcagcctttgcagccgagctgaatcgtctggttcaaatcatctcccctctctctctctctctctctctctctctctctctcgcagcctcccttgttggttggttggttttcgcctccgatccaaagggaagagagccatggcgctgatgacgctgcgttccaccacgtcattcctgtcgcccgtctaccccagctccaagctcctccacaagccctgcgcctacgacgcgccgccgagctgcgtcgccgtgcccgccccgccccacgccaccgcgccgagccacaggctgcgcctcgtcagggcgagcgccgctgcggcgcccgcgccagcggcggaccgcgcgccggccggggccacctcctagctgctgcacgccggcggcgcgcgccacgaccacaggcgcgcgcgcggccgcgaccccgcctacgtgatgctgccgctggacacggtggagccccgcggccaggtcgtcccggcaacacgcg

SEQ ID NO: 19847 - DNA, 2321 bp, Panicum virgatum
  misc_feature: Ceres CLONE 1807217
  misc_feature: Encodes the peptide sequence at SEQ ID NO. 19848
gagaagggggcagtcgactcgagagctgcagcgagagggaaaatccactaatcccccctccaccccagctctctcgaaatccgccattcccctccgccgcaaacacgcgccgaagctcgcggcgggcgccgccgccccgcactcggccgcggggcctccacccccgtcgatctggagccggttgccgcgatctcgccgcgggtccccgcggccgccgtgaattgggttgtgcgctggcgttactggtgggcgggggcgttttgatccagcggcttccgggttgagtggatggcggggaaagagcaggggggcgggggcccgccgccgcggcctcccgtgcccgcggcgtccacgcagccgccgattaagaagctggtgaggcagctcgacttcaacacggcggtgttggcggggaaccccgcgatggcggcggccgccgccgccgtgtccagggcgctgcagccgaggacgttgccggtggggttgcagcaccccccgcagcaagcgagggctgccgtgccgatgggggtgccgcagcagctgcacccgcggctgctgccggtgatgcgcccgcatcaggtggcggggcatgtgccgctgccgcggcacgcggtgccggttgcagtccccgtaccgcagcttcgcccggagccagtgcagcgggccccggtcgccgttcccttgaagccagagtcaccaaaaccacggtcaagactctatgaagggaaagatagcactcccacgaagaaaaagtgctgtaactgcaggaactccagatgtttgaagttgtactgtgaatgctttgcttctggtgctcactgtgatgggtgcaactgcaccaactgttttaacaatcctgagaatgaagttgccaggcgtgaagctattgatgctacattggagcgtaatccagatgcattcaggcctaagattgggagcagcccacatgcaaataggaataatgaggtgtctagcgatctccctttagtagggaagcataataaagggtgccattgcaagaagtcaggatgcctcaagaagtactgcgagtgcttccaagctaatatactatgctctgaaaattgcaagtgtatggattgcaagaattttgaagggagtgaagaaagaagatctcttttccaaggggatcacaaaaattccgttaacatgcagcaagcaacaaacgttgctgtaaatggtgcaattggagctacaggattttcttctccttccacatcaaggaagaggaaacacattgatccgtcacttgaccattcaaataaggaacatgtagcgcaaaggaacctacctcagaagaatgcactacccaatggttcaattccaataagccagtctgtgcatcctcccactctggggccctttaaagttagctacaggccccttttagcagacattgtcaaagaagcggacataaaggatctctgtaagcttttggtgggggtgtcaggagaggcttcaaaggcatatgctggcaggaagacacaggaagagagggatgcagagaaggaaggtgaaagtggtggacagaaggaagatgataaggcaggttcccgagggttgacaaaccatgatagagaaggaaataaccaagatctggatcacaaagcatcaatcaatgacaattcaagcgaaggaactcatacgggcaaagctgttctagaagaatccaggcctaactgtgctgatgatcagaagtccaataggcctatgtctcctggaacgctagcactgatgtgtgatgaacaagatacaatgtttacaacttctcaacatgctgctcctcagcagacagtagctgacaaccagaaccaatccgaactgtatgtagaacaagaaagagttgtgctgacagaattccgtgattgtctccgtaagcttgtgacatgtggaagaatgaaagaggaaaggtactccatggcgatcaaatctgaaacatctggccatcccggacaggtaaatggtgtttctcgagtaccatatccaagagtagatgtacctgctgttgtaaaaacatttccacagggttccagcagtcatcctgttgctggaaaacctgttacggggcatttggacaacaactgaagcctgagaacacgtgtcccaggtttgtattttaggggtgcagcaatgatcaagagcatcatgtttgcaccctcttaacaggttgatcagatacatgtatcagtcttgatcgataatttagaagcttagaatatctgatttattcccattggttagaataagtgtaatgctggcatctggttagtttagtcataaatgcagttaactgtttggtgtct

SEQ ID NO: 19848 - protein, 604 aa, Panicum virgatum
  misc_feature: Ceres CLONE 1807217
  misc_feature (236)..(277): Pfam Name: CXC Pfam Description: Tesmin/TSO1-like CXC domain
  misc_feature (152)..(192): Pfam Name: CXC Pfam Description: Tesmin/TSO1-like CXC domain
MAGKEQGGGGPPPRPPVPAASTQPPIKKLVRQLDFNTAVLAGNPAMAAAAAAVSRALQPRTLPVGLQHPPQQARAAVPMGVPQQLHPRLLPVMRPHQVAGHVPLPRHAVPVAVPVPQLRPEPVQRAPVAVPLKPESPKPRSRLYEGKDSTPTKKKCCNCRNSRCLKLYCECFASGAHCDGCNCTNCFNNPENEVARREAIDATLERNPDAFRPKIGSSPHANRNNEVSSDLPLVGKHNKGCHCKKSGCLKKYCECFQANILCSENCKCMDCKNFEGSEERRSLFQGDHKNSVNMQQATNVAVNGAIGATGFSSPSTSRKRKHIDPSLDHSNKEHVAQRNLPQKNALPNGSIPISQSVHPPTLGPFKVSYRPLLADIVKEADIKDLCKLLVGVSGEASKAYAGRKTQEERDAEKEGESGGQKEDDKAGSRGLTNHDREGNNQDLDHKASINDNSSEGTHTGKAVLEESRPNCADDQKSNRPMSPGTLALMCDEQDTMFTTSQHAAPQQTVADNQNQSELYVEQERVVLTEFRDCLRKLVTCGRMKEERYSMAIKSETSGHPGQVNGVSRVPYPRVDVPAVVKTFPQGSSSHPVAGKPVTGHLDNN

SEQ ID NO: 19849 - DNA, 2541 bp, Panicum virgatum
  misc_feature: Ceres CLONE 1807222
  misc_feature: Encodes the peptide sequence at SEQ ID NO. 19850
ccagtttttcccgttccgcatagtcgtagaatcccagttctttcgttcttccacactcattctttgtagcgcagcctttctaccttgtaatccttccaggtcgtacagatcacggtgttcttcgatcaatttcgctgtatcatcccaagagcagcggcgtatagtgatctgcctacagcaaagatcgttagattttgcaatggcgtcgtgcgcggatttcgctgcgctccgggcgtcgccgtccgacgtgcgggtcgtcgcgtccgacgggagcagcatcgcggcgcactcctccgttcttgccgcggcgtcgccggtgctggagcagatgatcctggacgcgcggcgcgggtgggacgccggctgcaccgtcgtccgcgtcctcggcgcgccatccgacgccgtcgccgccttcctccgtttcctctaccgcggccccggcgccggggggacgccggcggcggcggaggaggaggaggagtgggcggagggcgcggtgggcgcgcacggggcggcgctgctggcgctggcgcacgcgtaccgcgtcccgtggctgaagcggcgcgcggaggcgggcgcggcggcgcggctgaccgcggagcgcgccgtggacgcgctgaagctggcggcgctctgcgacgcgccgcggctgtacctggcgtgcgcgcgcctcgccggcaaggacctggccaccgtcaagcggtccgaggggtggcggttcgcggcccgccacgacgccgcgctcctgggcgagctgctccagctcctccacgacgccgaccaggtgcgtgcctcgcctcgcctcgcctccgtcggccagctgttacgacacttattttcggataataaacaaacaagcagcctagtcatggcactgtcaggtatactagtacggtgtagttttttagaacaactgccagtattatatggatcaacctttgatacggcaagctgcatacgatttcaaatctgcaaggttcatttttaaccgccacttgaagtcattggtgattgcaaacaagatcacacaagatatgtttgtttctatttagagttgcactgcacatcagcctctgttggagatagttcctgctcacctaaaatcttttgaattttcacatggatcataggcagatacactgacatctcattatcattgccaccacactactagtactagcttatcacctaccaaccctccaaaaatccagtattcaatttgacgcgagagtttggctccaagctccagtacagagaccgtactctgcagaagccctagcaaccaccggaatccaaatcgtccacgaccacgattccaaaaatctcttcccatttcttgacacggacacgtcggtctcaacccattttttttctctgacagagaaagaagaggtgggagagggagcgggcgtcgcagcacgtgtaccggcagctcagcgacgccatggccttgctggaccgcatcttcgccgccgacggcgccggcgaagtgcgcgcggaagcttcgccgtgcgaggtcgactgcgtgcgccggggcctcgagcagctcatgctgcacttcgcggcgtgcggcggccgggccaggaagcccaccgccgcctgcccgcgctgcaggcgcgcgctccagctcctccggctccacgcctccgtctgcgaggaccgcgccggcgccggcgagccgtgcagggttcccttgtgcaggtaaaatgcagtgcagatgaacaatctcgcggcagtgcagtgtcgtgtgaaaattttttgattccctcttccatttttgggtgtgcgtgtgaacgatgctgtagtgccagttggtagctccaagcctccaacacgcgggaacggtggtgcttggctttgtggttgcaagtgtcctgtctgtctgtccctactgaagatgtagttttcagtcacgttcccaacttgcacatgaatggcatgaaagaaaatgagatctgaacgaccacctgactattcctgaaagtgcatgcatccaagatgcatgtgttagatggtattcagttattcaccataaccttacatatttaccataactgtgcatgtgctgtttttctcccaaaaaaccccgcttgctcagaacctgaagtatttttttgtttcctgttccagcaacctgaaggccaagatgcaggaagagggagtggacaagacatggaagcttctggtgaagaaggtgaccagggctagggtgatgtctgctctggccagcagggaggtaccagatgttgtgaagaagtcatgggcgaaatccagcagccgtattgctgccagattcagataaaaagggaagaagatggaggaaattgttctgcagaaaaccaatgcaatctgccgtagagaggcttgtatgctttggaagcattccttctgtattttttatggaggaacactgaaattacacgctgcatctacgagtggccaaagaagcctgtggcatccttgtgacactgttgggatggcgccaaagtgcaacctgtaccgatgattttttagattatggaaaaagttccggccttaatc

SEQ ID NO: 19850 - protein, 262 aa, Panicum virgatum
  misc_feature: Ceres CLONE 1807222
  misc_feature (7)..(131): Pfam Name: BTB Pfam Description: BTB/POZ domain
MASCADFAALRASPSDVRVVASDGSSIAAHSSVLAAASPVLEQMILDARRGWDAGCTVVRVLGAPSDAVAAFLRFLYRGPGAGGTPAAAEEEEEWAEGAVGAHGAALLALAHAYRVPWLKRRAEAGAAARLTAERAVDALKLAALCDAPRLYLACARLAGKDLATVKRSEGWRFAARHDAALLGELLQLLHDADQVRASPRLASVGQLLRHLFSDNKQTSSLVMALSGILVRCSFLEQLPVLYGSTFDTASCIRFQICKVHF

SEQ ID NO: 19851 - DNA, 1937 bp, Panicum virgatum
  misc_feature: Ceres CLONE 1807231
  misc_feature: Encodes the peptide sequence at SEQ ID NO. 19852
ctcttccggcggcggcggaccacccatggaggccgacgtcggctccaggtacgagattccccggaccgcggagttcctccgcgcgcgcgcctacaccagggtcgccctccagttccccgacgagatgctcaaggacgccgcggcggtgtcaagggcgctgcggcgggagctcgccacctccggcggcggtggggtcagggtgttcgtgatggccgacacggcgtacaattcctgctgcgtcgacgaggtgggcgcgtcacacatcgacgcgcagtgcgtcgttcactacggtcacgcctgcatgagcccaacatcacatttaccagctttcttcgtattcgggaaggcaccattggatatccatgcctgtgccacctcaatgctggagtgctcgagaaaaggcaataagcgtattctggttttatatggactagagtatgcatatgcactggatgaccttagacgaacttttgaagagtcatgtaaatcaaattcttgcaatcctgaagtccagtatgcagacgttctgtgttcagttatgagcccattgtcaaatactgcagaggaaaggagtggaacctcttgccacgaagaattgtcgataaagagtgatgtgccaacatttctgaatattcgttgtagcatggaatgttctagttccacacagaagtacaatcttggtggtgttacatggaatatttcagctcaggagaaaatggaggactacttaatattttggattggacaagataattcggcatttgccaacattatgctgaccttcaataaatgtgaaatagttagatatgacgcaataaaaaatcaactctcaacagatgtctctcatcttatgaaagttcttaggagaagatattaccttgtggagaaggcaaaggatgcaaacattattggcattttagtgggaactctgggtgttgctggttatcttcatataattgagcaactgaaagaagtgatcagggccgctggaaagaaatcttatacattggtcatgggccggcctaattctgcaaaacttgcaaattttcctgagtgcgaagtttttgtttatgtttcttgtgcccaaactgctctgctggatagcaaagattttttagctccagttattacacctttagaagctgtattagcttttagcaggggaagagagtggactggcgaatatcttatggatttcaaggatttgatcacttcggagaaacaggaagttacaagtgcgtctgaagaagcacggttttcctttatcaaaggtgcctatgtagaagataactgcaatcaagaaagtatggaactgtcagaaacctcacttacattggctgaggtaacagaaaaggcactaagcatccaaaaccagaacaacgacgctgtccttcaccaaggaagagcaatgtcctcaatcgactacctcaaggcacgttcataccatggtttaactggagattatgagggtccagcacctaattcaatcttggtgggcagaaaggggagggcagctggttacaatgatgagaaaacacaaagttcacaatgatggcaattggcagttaatcagttactaaaggtctctggcgaggaaaacacagagttcacttgcacaatgaaaggttcaccattctgtgcaatacctgttatattttggctgggatagatagatttacagacgaccatggatttatcgttggtgtgcaatacctatttctagggcaaggggaacaaacctttggggatgcacttctgttagaaactattgcattcggagagttagttttgatagtcacacgagccttgcagattccagaaactggcatgatttcagaatttgagaaggtatgcgtggtttgctatttgttctgtaaatgtccactatgtacaagacacaatttgccccatatattcttacttattggcaatttctc

SEQ ID NO: 19852 - protein, 508 aa, Panicum virgatum
  misc_feature: Ceres CLONE 1807231
  misc_feature (30)..(392): Pfam Name: Diphthamide_syn Pfam Description: Putative diphthamide synthesis protein
MEADVGSRYEIPRTAEFLRARAYTRVALQFPDEMLKDAAAVSRALRRELATSGGGGVRVFVMADTAYNSCCVDEVGASHIDAQCVVHYGHACMSPTSHLPAFFVFGKAPLDIHACATSMLECSRKGNKRILVLYGLEYAYALDDLRRTFEESCKSNSCNPEVQYADVLCSVMSPLSNTAEERSGTSCHEELSIKSDVPTFLNIRCSMECSSSTQKYNLGGVTWNISAQEKMEDYLIFWIGQDNSAFANIMLTFNKCEIVRYDAIKNQLSTDVSHLMKVLRRRYYLVEKAKDANIIGILVGTLGVAGYLHIIEQLKEVIRAAGKKSYTLVMGRPNSAKLANFPECEVFVYVSCAQTALLDSKDFLAPVITPLEAVLAFSRGREWTGEYLMDFKDLITSEKQEVTSASEEARFSFIKGAYVEDNCNQESMELSETSLTLAEVTEKALSIQNQNNDAVLHQGRAMSSIDYLKARSYHGLTGDYEGPAPNSILVGRKGRAAGYNDEKTQSSQ

SEQ ID NO: 19853 - DNA, 680 bp, Panicum virgatum
  misc_feature: Ceres CLONE 1807243
  misc_feature: Encodes the peptide sequence at SEQ ID NO. 19854
gatctcgcgtctccgcacggagggccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcgaggctcacggcggagaagctgccggcgaggctggctctgggaaccgatccgcggaggagcacggatcctgtgctccgtgccgcaaagatggaagcttcgtgttgcaagaaatcgacaggtactgaaaaggtccactactctgccgatgaagctctcatactacagcaaaaagcccaggatgttctcccttacttggatggccgatgcatttatctagtcggaatgatgggttcaggcaaaactacagttgggaagatattagctgaagtactaggttattctttcttcgacagtgataagttggtagagaaggctgtcggtatatcatctgttgctgagatttttcagctccacagtgaagcattcttcagagataatgaggtacatgcccatttctc

SEQ ID NO: 19854 - protein, 163 aa, Panicum virgatum
  misc_feature: Ceres CLONE 1807243
  misc_feature: SWISSPROT Homolog: EC 2.7.1.71 Shikimate kinase
MEASVGIRARPGAWAGLEKPRGACSARVPAARLTAEKLPARLALGTDPRRSTDPVLRAAKMEASCCKKSTGTEKVHYSADEALILQQKAQDVLPYLDGRCIYLVGMMGSGKTTVGKILAEVLGYSFFDSDKLVEKAVGISSVAEIFQLHSEAFFRDNEVHAHF

SEQ ID NO: 19855 - DNA, 646 bp, Panicum virgatum
  misc_feature: Ceres CLONE 1807243-R
gggtgacccatagcaaaaggtagatactgttgctcactgtcatatgagatttgagctcttgagctccagtctgactaatattctactttggtaaccctttcagtgctaaggccttttgtttcctaatgcaggcttatgcaaaacttacatcactttttgagaaaagaatggactcgtatgctaatgcggatgccagagtttcacttgaacgtaaatttcctataattttcaataacaatgtctgctatgcataatcctgaatttgctgatcctttatactactgacaaactcactaaacacaatgcttcacataattcaattaattgatcaaattcttcctgatgcagatattgcattaaaacaagggcataatgatgtcgctatacttacacctagtaccattgccattgaggcattattaaagatggaaagttttcttactgagaaggccatggtcagaaactgaccgcttgttgctggggaaaagggcaccaacagcatatggcccctgtttgtttaattgtgcttgtacatatgcctttgcatgagctctttacagtactgttagattgttgttcacgcaacatgaaagatgattatttgagtgtttgtacttgtgcgatgaataagagaatagttttaagc

SEQ ID NO: 19856 - DNA, 3371 bp, Panicum virgatum
  misc_feature: Ceres CLONE 1807252
  misc_feature: Encodes the peptide sequence at SEQ ID NO. 19857
tttctgctctgcagtcgctttaagcggctacctttgctgacctttcctcccaaagggctgccgacctgttgggttccggcgctgattggtgaactgctgctgatcgacgggtcctcggagtgttggtctatctgcgctatcaacaggacatttgcgcgggagaagtagactcctgtgcagatacgccttgtgtgaacaaagattctgcttaaccggaagacagagtgctcctcttttttatctgtccggagctcagtacagtgctccaaatccatattggcgtactactaagagtggataaggaggatcttgtcctagactagtggagcaaagccatggatatgcctatgccttccaaccgtgccggctgcaacggcaacatcagcagccccatggggtcttcagatgatccctttggtgttgctgccacgatgaactttgatgggtactcagagctctgcagcccttcagttgctgatcagatattctcgatgttgaatgatccctcagctgcacagcagatgtttgctatgtggtcatccttgggatcgtctccgcgtgcttctgctatgagagatgacatgccattcgacacctattctggacctatggacgcaacagcagcatctactcaaaggagcaattcggtatcggcgttgagtccaactggtgtggacagagagctaaaagtttcagatgagcttgttccacaaaatggtttgcaacaaggaagtaacatcattccgaggtctgtgggcaactttcttgcagacaagatgctcatggcgctgtctttgttcaggaagtcattgagcgatggtgttctcgcccaagtctggatgcctgttgagcatgatggtcgtgtcgtgctgagtacgttcgagcagccttttctacttgaccaggatcttgcaggttacagagaggtgtctaggaatttcctgttttcagtgaaagaggagcctgggctgcacctagggcttccagggagagtcttcatatctggggtgccagagtggacctcaagtgttctctattatagtaagccggagtatttgagaatggatcatgctcttcgtcatgacatacgtgggtcacttgctatgccaatttatgaccccagcaagggctcttgttgtgcagtgcttgaacttgtcacaaacaaggagaagtctgattttgatgcagagatggacagcgtttgcaatgccttgcaggctgtgaacttgctgacaacaacagatcgcagcaatcagaaggtttactctgaaaatcagaaatctgctttcactgagattttggatgttctaagagccatttgccacgcccacatgcttccattggcccttacatgggttccgacatcaaacggcattaataatggttatggtgctggaaagaatattggggttgattcacaatcaggaaaatcagtactccgtatccatgaatcagcttgttatattaatgatgcaaagatgcaggggtttcttcatgcatgtactgaacgtcatcttgagaaaggggagggtatcgctggccgagcacttaaatccaatctgccattcttctcgcctgatataaaagagtacagtattgaagactacccgcttgcacaccatgctcgtaagtttggtctacatgctgctgtagccatccggttgaggagcacgtacactggtaacgatgactacattctagaattctttctcccagtcaactgcaagggctgtggagagcaacagatgttattaaacaacctttccagcaccatgcaaagaatatgcaagagcttgcgaacagtttctgaagcggaggacgataatgctggtgcttctggtacagcaatgcacaagaagactaatggaactttaccaactggcaacactgaaagttcctcacatgatgaccagccaattacagaatccgcattccaagatctatctttgggtgacaagcaaggagatagagaacctgaccaggcacatagtagctcaatgcgagttgcagagaaaaaacgcagtacatccgagaagaattttagtttggatgttcttcgcaaatacttttctgggagcctgagggatgctgcaatgagccttggtgtttgtccaacgactttgaaacggatatgcagacaacatggaatttcgcgatggccatctcgaaagataagcaaggttaatcgttcattgaagaagatccagactgtcattaactcggtccatggtgtggatagatccttgcagtatgatcctgctactggttccctagttccagcagcctctcttccagataagatgcaattctctgcttgtgatacattgcctacttcatctgttggaaaatcaatggagaaaaaatccagcccgaaatcagaacaaggtttctcttcacctgatggatggcaaagagaaacttgccaatttcacgtatccagtatatcgaaaagagaagatgatgaagttcgaatgttggcgaacaacaacaatggaagaagaaactgtgcttctgatgttgcaaaggtcacaccacattcaaactcggaaggtgcaaaaggtccattatataccactggtgctgttaattctttgtgtaccagagaaatagtctacatcaattctccaacctctctccacccaagcatcgatagtgccgaagaccctacaatgggaaggaattcatcattagtacaacaagcagatgtcactatggtcgacggtcatgacaccaaggagcacatccatccttccacctccggtacgactgattcttccagcggcagtgcatcaagtcaacctactttcaaggggaaccttggaaatgcccccaaagatagaagcagcccagcactgacagtcaaggctacctacaacggtgacacagtgcggttcaagttcctaccagcaatgggctggtatcacttactggaacagatagcaaagaggttcaagctgacgacaggagcattccagctcaagtacaaggatgatgaggatgaatgggtgatcctggcgaacgactctgatctccaagagtgtgtggacatccttgattcaatcggctcgcgcaacgtgaagctgcaggtgcgtgacctcccgtgccacatcagcagctcaggcagcagcagctgcttgcaggtggaagcgcacagcccatgacaggatgagaagcctagggcgtcatccctaaaccgtagcctgttgtagtaggtctaatattctgtagcagccatagaggatccgtgtttgtgcttgcgcttgcgcttgcgcaatgccgtctatggaatgtacatatggctagagcgaaaaaaagagtgtaatactcgtcaatctcgtgcaaggttgaaacagtgtcgaaaagatcttggc

SEQ ID NO: 19857 - protein, 941 aa, Panicum virgatum
  misc_feature: Ceres CLONE 1807252
  misc_feature (565)..(616): Pfam Name: RWP-RK Pfam Description: RWP-RK domain
  misc_feature (839)..(921): Pfam Name: PB1 Pfam Description: PB1 domain
MDMPMPSNRAGCNGNISSPMGSSDDPFGVAATMNFDGYSELCSPSVADQIFSMLNDPSAAQQMFAMWSSLGSSPRASAMRDDMPFDTYSGPMDATAASTQRSNSVSALSPTGVDRELKVSDELVPQNGLQQGSNIIPRSVGNFLADKMLMALSLFRKSLSDGVLAQVWMPVEHDGRVVLSTFEQPFLLDQDLAGYREVSRNFLFSVKEEPGLHLGLPGRVFISGVPEWTSSVLYYSKPEYLRMDHALRHDIRGSLAMPIYDPSKGSCCAVLELVTNKEKSDFDAEMDSVCNALQAVNLLTTTDRSNQKVYSENQKSAFTEILDVLRAICHAHMLPLALTWVPTSNGINNGYGAGKNIGVDSQSGKSVLRIHESACYINDAKMQGFLHACTERHLEKGEGIAGRALKSNLPFFSPDIKEYSIEDYPLAHHARKFGLHAAVAIRLRSTYTGNDDYILEFFLPVNCKGCGEQQMLLNNLSSTMQRICKSLRTVSEAEDDNAGASGTAMHKKTNGTLPTGNTESSSHDDQPITESAFQDLSLGDKQGDREPDQAHSSSMRVAEKKRSTSEKNFSLDVLRKYFSGSLRDAAMSLGVCPTTLKRICRQHGISRWPSRKISKVNRSLKKIQTVINSVHGVDRSLQYDPATGSLVPAASLPDKMQFSACDTLPTSSVGKSMEKKSSPKSEQGFSSPDGWQRETCQFHVSSISKREDDEVRMLANNNNGRRNCASDVAKVTPHSNSEGAKGPLYTTGAVNSLCTREIVYINSPTSLHPSIDSAEDPTMGRNSSLVQQADVTMVDGHDTKEHIHPSTSGTTDSSSGSASSQPTFKGNLGNAPKDRSSPALTVKATYNGDTVRFKFLPAMGWYHLLEQIAKRFKLTTGAFQLKYKDDEDEWVILANDSDLQECVDILDSIGSRNVKLQVRDLPCHISSSGSSSCLQVEAHSP

SEQ ID NO: 19858 - DNA, 2258 bp, Panicum virgatum
  misc_feature: Ceres CLONE 1807253
  misc_feature: Encodes the peptide sequence at SEQ ID NO. 19859
atttgaaaacgctgctctgtttccagagtgcggccacgtcgtagggttttgctttccccggcggtaaagcggggaggcggaggcggagggggcgccgcgaccgccgcccggccatggagatcgggcagtaccccgtgagcagctgctccaaggagcaccagaagatctaccaggagtggttcgcgctcgcggactcagatggggatggccgcatcacgggccccgacgccatcaagttcttcggcatgtccaagctctcccgccccgacctcaagcaggtatgggcgatcgcggactccagacggcaggggtacctgggtttccccgaatttgtcgctgcaatgcagctagtctctctggctcaggcagggaatgagatcactcaagatagtcttaagcgcgatgatttaggcagtttgaatccacctttgatggaaggtttggatgctctacttgcgaaatctaagcatatggtgaagcgggtggatccagaattggatggatttcctcaggaacaatcaccttcaaacaaatggttcagctcaaagtcatcaaagaagataccgctgactgctgttacttctgtcatcgatggcttgaaaaaattatacatcgaaaagctgaagcctttggaagttacatacaaattcaatgattttgtttctcctttgctgacgagtagtgattttgaggcaaagccaatggttatgctcttaggtcaatattctactggtaaaacaacttttatcaagcatctgctaagaacaagctatccaggtgctcatattggaccagagccaacaacagacagatttgtcgtagtcatgtcaggatctgatgaaaggactattcctgggaatactattgctgttcaagctgacatgccttttagtggtcttacaacatttgggactgcatttttatccaagtttgagtgctctcagatgcgacatccactgcttgagcatatcacatttgtcgacacacctggtgttctttctggtgaaaagcaacggacacaacgtagctatgatttcactggtgtgacatcatggtttgctgcgaagtgtgatcttattcttcttctgtttgatcctcataagcttgatatcagcgatgagttcaaacgtgtcatcggatctttacgcgggcatgatgataaaatacgtgttgtcttaaacaaggcagatcaagtagacactcaacagcttatgagagtttatggtgcactgatgtggtctctcgggaaagtattgaatacacctgaggtttcacgtgtttatattgggtcattcaatgacaaaccagtaaatgaatcagctgttggtccacttggaaaggaactatttgagagagagcaagatgatctcctttctgatctcaaagatatccccaagaaagcatgtgatcgtcgaatcaatgaatttgttaaacgtgctagagctgccaagattcatgcttatataattggccatctaaagaaggagatgcctacaatgatgggcaaagcgaaagcccaacaacgactcatagacaatttgcaggatgagtttgcgaaggtgcaacgggaataccatcttccagcaggggatttcccctacgtggagcacttcaaagaggtcttgagcgggtatagcttcgacaagtttgagaaagtcaagcccaagatgatacaagcagtggatgatatgcttgggtatgacattcctgaacttctcaagaacttcaggaacccatatgagtgaaccggttggaagatgattttggtcttgcactggaacgagagatcagtcaggcaccgatagatgcctcccgtagtgatgcaactgtctggctacattaatcattgtgatcaaggtcctgtgggtccttcgttgccatccacgcctcaccattgttgtacaactgtattcataagaatgggagagcaattgctcaagctttcacggacatccgatcatgtaaaatcaactagtttgtgatttttagtgctatagagctacaattatcgtttctcccaatgagtatatttattaattttggcaaacaactagaataacgtggtcctgtcaggatcagcgcttcttgaagaatcttggaccagcgtggggcgtggctcctttatttgttcttgtcctgggcgttgtccgtggatgtcttgtatatgttgtggacttgtggcacagtaaaatctgtatctgctaaaactgccttgatatcatagcactcgaaatcaatccaattgaggattttattcg

SEQ ID NO: 19859 - protein, 543 aa, Panicum virgatum
  misc_feature: Ceres CLONE 1807253
  misc_feature (198)..(358): Pfam Name: Dynamin_N Pfam Description: Dynamin family
MEIGQYPVSSCSKEHQKIYQEWFALADSDGDGRITGPDAIKFFGMSKLSRPDLKQVWAIADSRRQGYLGFPEFVAAMQLVSLAQAGNEITQDSLKRDDLGSLNPPLMEGLDALLAKSKHMVKRVDPELDGFPQEQSPSNKWFSSKSSKKIPLTAVTSVIDGLKKLYIEKLKPLEVTYKFNDFVSPLLTSSDFEAKPMVMLLGQYSTGKTTFIKHLLRTSYPGAHIGPEPTTDRFVVVMSGSDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLQDEFAKVQREYHLPAGDFPYVEHFKEVLSGYSFDKFEKVKPKMIQAVDDMLGYDIPELLKNFRNPYE

SEQ ID NO: 19860 - DNA, 681 bp, Panicum virgatum
  misc_feature: Ceres CLONE 1807260
  misc_feature: Encodes the peptide sequence at SEQ ID NO. 19861
tgcaaaccatgtagcactcctgttgacactcatgccaaagttccggctgatatcggtcctcctgtcagtgatcccactcattacaagagtcttgcgggtgctctccattacctcaccttcacccggcctgatatttcctatgctgtccagcagatctgtctacatatgcatgattcgcgagagccccacttgtctgctgtcaagcgagtcatacaatatctttgtggcactctcaattatggtcttcttcatcgtggcaccacttcagagttgactgtatatactaatgctgattaggcctctcctccctctcacaagcaccaacggccactccacaaactcgattggatggtctcgcaagacatacaagcctcggatttacaacacttgatgtgcgcaagcaccgatagcattgaggtatgcaaacctcgcctaactctaagctaacacctaaagcaatgagctgagcagcctaaactagcactgatcaagccctaagacttatgctaatttctttagtcttctcttaagcgctccgatggatagagcacttgaatgtgtgtggaaaccaagcctatagcttccccaagctctagcatccttgaaatggctgagtggagggatatttacaccccaaccaaagaaactagccgttgctcccgtgggcagattgatcgaatg

SEQ ID NO: 19861 - protein, 98 aa, Panicum virgatum
  misc_feature: Ceres CLONE 1807260
  misc_feature: SWISSPROT Homolog: EC 2.7.7.49 RNA-directed DNA polymerase
CKPCSTPVDTHAKVPADIGPPVSDPTHYKSLAGALHYLTFTRPDISYAVQQICLHMHDSREPHLSAVKRVIQYLCGTLNYGLLHRGTTSELTVYTNAD

SEQ ID NO: 19862 - DNA, 672 bp, Panicum virgatum
  misc_feature: Ceres CLONE 1807260-R
tcatgacagtgttgtttgggaagatgtggactatccatgctgcaatggtgtaacgtgattagcataaactagtctatcaacccgtgctcccgcacgggctaattagaattaacataagaatgaggtaaataattataattatctatctcacgctcttttcatctattaaatattataacacatactctaaaacatatatttatcattatctaattacaatagatttcatattgtatcacacctccatatgcattcaatacatgtttagttgaactatttgtttgtgaattggtattcttatctcttccatcatacatgaatatacggtgacatatatcataggtagtatttttatataaataataataataaaatatcaataataatagaaagaataattatatactttagattcagatttatgagtaatttaacttgtaataataatgatataattggataatttatatgcaaatttggggaagtatttgtattatttttataatggcatatgtggataattttcacaaatattagggggttactttagattgtttttataatggcagagatcaatgttgtgctaggcgctgtctaggcggagggtcaccgcctagagcctaggcgttttctaggcgatggctaggcggtacttcatatgtacagatatag

SEQ ID NO: 19863 - DNA, 2019 bp, Panicum virgatum
  misc_feature: Ceres CLONE 1807269
  misc_feature: Encodes the peptide sequence at SEQ ID NO. 19864
gcattgccatcggtcgcctctaaacttcctctcccctgaactcgtcgacgttccatctctgggcgctcacgaacgcttcccgttcctcatcggttcgattcgattagtcgtaggcctttcgagtggagccagcctgtgatcttcttggttcttgagaggcgaaagctctgtgccttttctggttgagaggtgagctgtcgcaatggccggcggcgtggtggtgaacaccggagggggcaaggactaccccggcaagctcaccatgttcgtgctcttcgcctgcatcgtcgccgccaccggcggcctcatcttcggctatgacatcggcatctccggtggcgtgacgtcgatgaacccgttcctgatgaagttcttcccgtcggtgtaccgcaaggagcaggaggcggagcgcgaccagagcaaccagtactgcaagttcgacagccagctgctgaccatgttcacctcctcgctctacctcgcggcgctcgtggcctccttcttcgccgccacggtgacgcgcgtggccggccgcaagtggtccatgttcggcggcggcgtcacgttcctgtttggcgccgcgctcaacggcgccgccaagaacgtggtgatgctcatcctcggccgcgtcctgctcggcatcggcgtcggcttcgccaaccagtccgtgccggtgtacctgtcggagatggcccccgcgcgcctccgcgggatgctcaacatcgggttccagctcatgatcaccatcggcatcctgtgcgccaacctcatcaactacggcaccgccaagatcaagggcggctggggctggcgcgtgagcctcgcgctcgccgccgtgccggcggccatcatcgccgtgggcgcgctgttcctgcccgacacccccaactccctcatcgaccgcggccacaccggcgccgccaagcggatgctgaagcgcgtgcgcggcacggaggacgtggaggaggagtacaacgacctggtggccgccagcgaggagtccaagctcgtggcgcacccgtggcgcaacatcctgcagccgcgctaccggccgcagctggtcatggccatcgccatccccatgttccagcagctcaccggcatcaacgtcatcatgttctacgcaccggtgctcttcaagacgctgggcttcgccgacgacgcctcgctcatgtccgccgtcatcacgggcctcgtcaacgtcttcgccacgttcgtctccatcgtcaccgtggaccgcctcggccgccgcaagctgttcctgcagggcggcacccagatgctcgcctgccagatcgtcgtcggcagcctgatcggcgccaagttcgggttctccggcgtggccgagatccccaaggcgtacgccgccatcgtggtgctcttcatctgcgcgtacgtggccgggttcgcctggtcgtgggggcccctcgggtggctggtgcccagcgagatcttcccgctggagatccggtcggcggggcagagcatcaacgtgtcggtgaacatgctctgcaccttcatcatcgcgcaggcgttcctccccatgctgtgccgcttcaagttcatcctcttcttcttcttcggcgcctgggtggtggtgatgaccatcttcgtggcgctgttcctgccggagaccaagaacgtacccatcgaggagatggtgctcgtgtggaagtctcactggtactggggccgcttcatccgcgacgaggacgtgcacgtcggcgccgacctcgagatgcacggcgccaacggcaacggcaagctcggcggcgcgcagtagcccggacgtcgctcgctgctgacggtgtcgggcaataatctactcatacagaactactccgggtttagcgggaaatttcaaaagtttaaggattcatcactgtattataaatcgtcgcattaggtagggtgactggatgttgaccgttggtcaacaagtcttcgtttcctgtcttcttttttctttgtctcaagatactcgatgtggggggtatggtgtggatcaaatcagatttg

SEQ ID NO: 19864 - protein, 526 aa, Panicum virgatum
  misc_feature: Ceres CLONE 1807269
  misc_feature (26)..(490): Pfam Name: Sugar_tr Pfam Description: Sugar (and other) transporter
  misc_feature (21)..(442): Pfam Name: MFS_1 Pfam Description: Major Facilitator Superfamily
MAGGVVVNTGGGKDYPGKLTMFVLFACIVAATGGLIFGYDIGISGGVTSMNPFLMKFFPSVYRKEQEAERDQSNQYCKFDSQLLTMFTSSLYLAALVASFFAATVTRVAGRKWSMFGGGVTFLFGAALNGAAKNVVMLILGRVLLGIGVGFANQSVPVYLSEMAPARLRGMLNIGFQLMITIGILCANLINYGTAKIKGGWGWRVSLALAAVPAAIIAVGALFLPDTPNSLIDRGHTGAAKRMLKRVRGTEDVEEEYNDLVAASEESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKAYAAIVVLFICAYVAGFAWSWGPLGWLVPSEIFPLEIRSAGQSINVSVNMLCTFIIAQAFLPMLCRFKFILFFFFGAWVVVMTIFVALFLPETKNVPIEEMVLVWKSHWYWGRFIRDEDVHVGADLEMHGANGNGKLGGAQ

SEQ ID NO: 19865 - DNA, 653 bp, Panicum virgatum
  misc_feature: Ceres CLONE 1807306
  misc_feature: Encodes the peptide sequence at SEQ ID NO. 19866
ctgttgcgatatactccccccaattcccctccttctcgtccccacaacaatctggtcgatcactcccgccaaaaccgaaacgaaaacccagttcagttccatcccaatccgatcccacaaaagcagagaaagaacccaacaccatcccagttcagctcgatcgccgttggccaatcacccagaccggaaggaaacgatggccttcagcgtggctcagagcgccgccgccgctgcggcgtccgtcgcgcccggcacgcctcgacacgcgccggcgccggcactggcgcccgcgtcgtccgtctccgtgaggaaagccggcggcgcgccgtcggccagcctcaggctgcagcggctgcagccgtcggtgccgccggcgcgtccggtggtgtgccgggcggcggcggccgagcgcgcctcgaggaggagtgagggggtgccggtgttcgtcatgatgccgctcgacaccgtcaacaagtgcggcaccgcgctgaaccgccggaaggccgtccaggcgagcctggcggcgctcaagagcgcgggcgtcgagggcgtcatggtggacgtgtggtggggcatcgccgagagcgacggccgcgggaggtacaacttcgccgggtacttggagctcatggagatggcgcgcaagacggggc

SEQ ID NO: 19866 - protein, 152 aa, Panicum virgatum
  misc_feature: Ceres CLONE 1807306
  misc_feature: SWISSPROT Homolog: EC 3.2.1.2 Beta-amylase
MAFSVAQSAAAAAASVAPGTPRHAPAPALAPASSVSVRKAGGAPSASLRLQRLQPSVPPARPVVCRAAAAERASRRSEGVPVFVMMPLDTVNKCGTALNRRKAVQASLAALKSAGVEGVMVDVWWGIAESDGRGRYNFAGYLELMEMARKTG

SEQ ID NO: 19867 - DNA, 701 bp, Panicum virgatum
  misc_feature: Ceres CLONE 1807310
  misc_feature: Encodes the peptide sequence at SEQ ID NO. 19868
aaaccagtcgccgccgcctgcccgcctcctcgttcgagtccgatcttgctggaggtcgccgcattctgaatccggttaccaatggctcctcccctcctctcgccgccgctgctccccgactcgctcgcgacactgccgcggtctttcccttgctcccgccccacgcggcagctggccaccgtcgggttcgccggagccgttaggagcgaccgccaggggagttggagtgcgcggaggagggggaacctcaggattcgagccactgcggcggaagcggatcactagaggccggaggaggatgtcgccgaggattactattccgttctgggtgtgatgccagatgcaacacctgaggaaatcaagaaggcatactacagttgcatgaaagcgtgccaccccgaccttagtggggacgaccctgacgtgaccaacttctgtatgttcatcaatgaggtttattcggtaagagccattatgcatgctgcgtgcaagatgttttctttttgctctgaaatttgtcattgcactgagctaacatggggtgtggaagggcaggtgctgagcgatccagcacaacgtgcagtgtatgatgagatccatgggtacacagctacagcaataaaccctttctttgatgacagtgcaccccaggatcaagtgttctttgatgagtttacctgcattggtatattgatagctct

SEQ ID NO: 19868 - protein, 122 aa, Panicum virgatum
  misc_feature: Ceres CLONE 1807310
  misc_feature (2)..(49): Pfam Name: DnaJ Pfam Description: DnaJ domain
MPDATPEEIKKAYYSCMKACHPDLSGDDPDVTNFCMFINEVYSVRAIMHAACKMFSFCSEICHCTELTWGVEGQVLSDPAQRAVYDEIHGYTATAINPFFDDSAPQDQVFFDEFTCIGILIA

SEQ ID NO: 19869 - DNA, 605 bp, Panicum virgatum
  misc_feature: Ceres CLONE 1807310-R
aaccaagaaaattcagacacaggcaggtcttggagcgatgtctggggatccccaccacgagatcaaaacaatggtaatgctaatagattgtcagagctcagaagaaccctggttactctgtagcatttagtaaattcgtatccacttactctctgcctatcaacccttgtattgttgaatatgattgttgctgatgggtactgtcagaggaagaagcgtcagagagaaccaagagagcggcggcggctgccagaaggtggcgagaatactcaaggcgaggcgcagacaggcctccgacatacaagcttccagaagcagtgggcaacaaagattagtccactgaatagagaaaacatctgccattgtttggccaaatttggcaaacctgtactgtacagtgtcgttgtttgcagaggtgatccgaaggtttgctttgccttcccagtcgacacccatgctgctcctgtaaatctagacgtagcgatgttgataacctgtagaagacatgcaccaaatatattacgtgtatattcaagctgtaatataaacaaatgcacatgtatatcttgctggatgtggtactagatgaaaacatgagttattgc

SEQ ID NO: 19870 - DNA, 1872 bp, Panicum virgatum
  misc_feature: Ceres CLONE 1807317
  misc_feature: Encodes the peptide sequence at SEQ ID NO. 19871
atcccctccgaccaccgtcccctcgctccacctcccccttaccggcagcaatggagacgggacccaggtgagccgaccagctagccagcccgccctggctccccgatggcgtgcctagcgccgctgtttatgtgggtcccttccgccgccgcccacgcgccctcctcctcctccaggtgctccaccctccgcgtccactgcgccgtcacctccgccgccgccgttgtcgacgccaactgcgccaacggtggctgtgccgcgcagctgaggctcacttacgccgcgccggcgcttcagaaaaattttgagtccactctagcatcagaggcacttctgaatgaagaagctatagttgaagcagcagcagcagaggcagttgctcttgccagatcagctagcgaagctgttcgagaacttgttcagatggtgcaaaataacaatcaccagccagtgattagacaaaagaagggcgtggacagctacatggcaaatgaaattcttcgtactgagatacaactgagcagtcccgatggatatgcaaatgatgttttgctggaggacttggagtcctatggtatcatggctgcagatggcaaattagatgatgatgcacagtacactgagaacatagctgtgaagtctattcgccagtctgagagaagagctagaagaaccagagcagcaataaaggctgcaacaattgtccgtgcttcacaaaaaactgcaacatcttcaaagaagaaacggctcaagggttcctcacctagcatgaatcctttaggttccttgtggaagatgactggtaggagacttcttacagctaaggaagaagttgagttctcagaaggtattcaggatcttttgaagcttgaggcaattcaagctgagcttacagagtacaatggtggacagccaacattctcgcagtgggcagcagcagctggaactgatgagaaaactttgcggaagcgtctggatcatggtatttattgcaagaacagaatggtaacatctaatgtgagacttgttatatctattgccagggagtttgaaggccctggaatggatctttatgatcttattcaggaaggaatgcagggccttataaggggagctgaaaaatttgatgcgtcaaaaggttttaggttctctacatattctcactggtggatcaaacaagcaatgcgcaaatctgtctcggagcaatcccaaatatttcgcttgccagctcacatggttgaagcaagttaccgtgtaaaggagtgcacaaaacgacttcgccgtaagcttagaagacggcccactaatgaagaaatagcagtggacactggtatgccaatgaaacgagtagaggcagcagtaaacttgccaaagtacagtgtatcccttgatagtaagattggttccacagacatgacttatcaggaagtcacagctgatcccagcgccgagacagctgaagagatgctgaacagattatccatgaagaacgatgtgtaccaggcactggacactttgaccccacgggagaagcaagttgttgtgctgagatttgggctcgaggatggtcgaataagaaccctgcaggagattggcaacatcatgggtgtgagcagggagcgagttcggcaaatcgagtctggcgcatttcggaaactaaggagcaagaaaagggtgagggctctgaaggattatctagtgccagtaggcaattggtgaaccgttttgtctccgcagcatttttttccttttgaattcctcagttttttctttttgaggattctttacttgtaccatttacacgggtcctcatgtacaacacattatcagaagatttgtctcacaagagaagtagtttagttcttcaaggtg

SEQ ID NO: 19871 - protein, 537 aa, Panicum virgatum
  misc_feature: Ceres CLONE 1807317
  misc_feature (467)..(520): Pfam Name: Sigma70_r4 Pfam Description: Sigma-70, region 4
  misc_feature (374)..(455): Pfam Name: Sigma70_r3 Pfam Description: Sigma-70 region 3
  misc_feature (300)..(370): Pfam Name: Sigma70_r2 Pfam Description: Sigma-70 region 2
MACLAPLFMWVPSAAAHAPSSSSRCSTLRVHCAVTSAAAVVDANCANGGCAAQLRLTYAAPALQKNFESTLASEALLNEEAIVEAAAAEAVALARSASEAVRELVQMVQNNNHQPVIRQKKGVDSYMANEILRTEIQLSSPDGYANDVLLEDLESYGIMAADGKLDDDAQYTENIAVKSIRQSERRARRTRAAIKAATIVRASQKTATSSKKKRLKGSSPSMNPLGSLWKMTGRRLLTAKEEVEFSEGIQDLLKLEAIQAELTEYNGGQPTFSQWAAAAGTDEKTLRKRLDHGIYCKNRMVTSNVRLVISIAREFEGPGMDLYDLIQEGMQGLIRGAEKFDASKGFRFSTYSHWWIKQAMRKSVSEQSQIFRLPAHMVEASYRVKECTKRLRRKLRRRPTNEEIAVDTGMPMKRVEAAVNLPKYSVSLDSKIGSTDMTYQEVTADPSAETAEEMLNRLSMKNDVYQALDTLTPREKQVVVLRFGLEDGRIRTLQEIGNIMGVSRERVRQIESGAFRKLRSKKRVRALKDYLVPVGNW

SEQ ID NO: 19872 - DNA, 3102 bp, Panicum virgatum
  misc_feature: Ceres CLONE 1807329
  misc_feature: Encodes the peptide sequence at SEQ ID NO. 19873
gacgagggaggagagaagagactgcaagatttcgcccgcctctccaagtccaagtctcccagccccccacagcatccgaggaggaggccccgttagggtttccaaccgcaccggaggtacccttccgatccgcacaatgctgctgtgatggaccatcctttcaacacgccaggtcgttgcattccgcaaaatatcatatccttcccgcgcctgtcttctgctaatcgaccacatattttttttctatcaggtcctgccgtgccccctgcctccaagccgaggcagatggcagcaagtaacaacccttggaggatccctcaaccacagctgctcaacacacgcgctggcttgggcgatgcaagcctcttctcatcctcgctgccgcttcttcctcatgagaaattgaactttcctgattctgcacatggtaccccgtcaatagatgacacttctgccaaaatcaaagtgcttgatgatgacccagaagagaaggactacccgtttgattttgatcttcgccagatagatgacttgctgcctgacgaagatgagtttttcgctgggataacagatgagatcgaaccagttgggaagacaaataacacggaagaattggaagagtttgatgtatttggcagcggagggggcatggagctggacttggatcctctggagagcgtcacagctagtttcgcgaattcaagtattgctgatggggctagaggcaatggggtcagcccttttggtgtcccaagcgctgtcgggactgtggctggggagcatccatatggagaacacccttccagaacattgtttgtaaggaacatcaatagcaatgtcgaggactctgaactgcgcactttgtttgagcaatatggggatatcagaaccctctacactgcaacaaagcacaggggttttgtaatgatatcttattttgatatccggtcggcacgcaacgcaatgcgtgcgttgcagaacaagcctctgaggaggagaaagctggacatccatttttccatcccaaaggagaatccatctgacaaagatttaaaccagggaactcttgttatatttaacttggacccgtcagtttctaatgaagaggttcgccagattttcggggcatatggggaagtaaaagagataagagagacaccaaacaaaaagcatcataagtttatagagttctatgatgtaagagcagcagaggctgctcttcggtcacttaataaaagtgagatagctggaaagagaatcaagttggaaccaagtcgtcctggtggaacacgtagaaacttgatgcagcagcttggtcatgatttggaccaagaggagcccagaagctatagacatcctcatgttggttcaccaattgctaactctcctccaggggtatgggctcactatagtagtccaacagacaacaatatgttgcaggctttcaacaggtctccaactggaaatggaatgagtcccatcggaatgccttcgctaatgtcaaatgctgtaaagattgcacctattgggaaggatagcaatcggtctaaatatgatcaagtattctcaaatggtaaccagtccctgggaactgcattccagcactcccactcataccaggatcgcaacagtgaacatttgaattctagtcctgggactttatctggcccccaatttctctggggtagtccgaagccctattcagaaacctctcaatcccctgtttggcgtccaccagcaattgggtctgcattgccatccagtagccgctctcaggggcaaggcttcttgcacagcagccgtcaggcttcgttatttgggtcttcagatcagcaccaccaccatcatcatgttggttctgccccttcaggtgctcgatttgagagccattttggcttcttacctgaatcgccagagacatcttttatgaaacaagtcaggttcgggaacatgggaaatattggtactggcagaaacggggctggcctgatgctgaacttggctggccgtccttctttgagtcctgtttcttctctgagtggaagtctgacagataatagttctagtaacttcagaccgatgctgtcaccgagattgggacatgcattctacagtaaccccacataccaaggtcctggctctttcggacttgacagctcgattgaccggcgtaaccgccgagttgacagcagtgcgctccaagtcgatagcaagaggcagtaccagcttgatttggagaagattagcaaaggcgatgatactaggacgacattgatgattaaaaacattccaaacaaatatacatctaagatgcttttggctgcgattgatgaacttcacaaagggacttatgacttcttctacctgccgattgattttaagaacaaatgcaatgttggatatgcattcattaacatgatatcaccaacacacattatatcattctaccaggcatttaatgggaagaaatgggagaagttcaacagtgagaaagtagcctccttggcttatgctagaatccaaggacggaccgcgctgatatcacattttcagaattcaagcttgatgaatgaggataagaggtgccggccgattcttttccatcccaatggtctggaatctggaaatcaggaagcgtttcctatcaatggcatatgcatccacatgcctgtggaagatgggacaggtgattcacttgacgatgaagacgacgtgaaggcaggaggagagagctccatgcatatggccgggagcttgtgatgacgacgaccataaatataaatctaactgtctagagtgaaggtatcgacccccaaattgtataaagaaagaggtggattttgtgcggtggtgtggcatgggatatctagtggtttttgtggcaactgatgtcgaagcctggaagcgagcttgcagttggagctgggagcttgctagtgcttattaggccggcccgtccgcacccctgtgtacagatagatgtgattggatccatgcttgctcgcttgcttttggttgtcatgctgtaaggagacatttggacaaactgtacagtgaaaactttgtgttgatcgattctgcaagaattctttctgatccagc

SEQ ID NO: 19873 - protein, 824 aa, Panicum virgatum
  misc_feature: Ceres CLONE 1807329
  misc_feature (660)..(756): Pfam Name: RRM_2 Pfam Description: RNA recognition motif 2
  misc_feature (176)..(242): Pfam Name: RRM_1 Pfam Description: RNA recognition motif. (a.k.a. RRM, RBD, or RNP domain)
  misc_feature (261)..(327): Pfam Name: RRM_1 Pfam Description: RNA recognition motif. (a.k.a. RRM, RBD, or RNP domain)
MAASNNPWRIPQPQLLNTRAGLGDASLFSSSLPLLPHEKLNFPDSAHGTPSIDDTSAKIKVLDDDPEEKDYPFDFDLRQIDDLLPDEDEFFAGITDEIEPVGKTNNTEELEEFDVFGSGGGMELDLDPLESVTASFANSSIADGARGNGVSPFGVPSAVGTVAGEHPYGEHPSRTLFVRNINSNVEDSELRTLFEQYGDIRTLYTATKHRGFVMISYFDIRSARNAMRALQNKPLRRRKLDIHFSIPKENPSDKDLNQGTLVIFNLDPSVSNEEVRQIFGAYGEVKEIRETPNKKHHKFIEFYDVRAAEAALRSLNKSEIAGKRIKLEPSRPGGTRRNLMQQLGHDLDQEEPRSYRHPHVGSPIANSPPGVWAHYSSPTDNNMLQAFNRSPTGNGMSPIGMPSLMSNAVKIAPIGKDSNRSKYDQVFSNGNQSLGTAFQHSHSYQDRNSEHLNSSPGTLSGPQFLWGSPKPYSETSQSPVWRPPAIGSALPSSSRSQGQGFLHSSRQASLFGSSDQHHHHHHVGSAPSGARFESHFGFLPESPETSFMKQVRFGNMGNIGTGRNGAGLMLNLAGRPSLSPVSSLSGSLTDNSSSNFRPMLSPRLGHAFYSNPTYQGPGSFGLDSSIDRRNRRVDSSALQVDSKRQYQLDLEKISKGDDTRTTLMIKNIPNKYTSKMLLAAIDELHKGTYDFFYLPIDFKNKCNVGYAFINMISPTHIISFYQAFNGKKWEKFNSEKVASLAYARIQGRTALISHFQNSSLMNEDKRCRPILFHPNGLESGNQEAFPINGICIHMPVEDGTGDSLDDEDDVKAGGESSMHMAGSL

SEQ ID NO: 19874 - DNA, 676 bp, Panicum virgatum
  misc_feature: Ceres CLONE 1807341
  misc_feature: Encodes the peptide sequence at SEQ ID NO. 19875
attcccgcagtttctctggtgctagggttcggcgaatggtcgccaaccaggaggcggaggcggcatcggcggcagcgcccggggcagggacgccggtggacccgatgcgtctggcgtcgcggtggcggtccccggcggagtgggagtgtgcggcggcggagctggatgctgagccgctcccgtccgagctcaacaccgtcaacagctctggacttttcgccgtcgtctccaccgacaagttgtccgtcaaatacctcggcagccatcaccatggccacgacgtcggggtcgtgcaagccgaccgccccgcgcccacgcgccgggccgtgtactactttgagatgcgggtcaagaacgccggctacaaggggcagacctcaatcgggttcacaagcgaaagcttcaagatgcggcgacaaccgggttgggagcctaacagttgtggataccacggtgatgatggccatctttaccgaggtcaagggaaaggtgaaccattcggggccaaatttacatctggcgacacaatcggtgctggcatcaactacttgtcacaagaatttttcttgacgaaaaatggatctctggttggagcctttccaaaagaaattaaaggtccactatatcctaccgttgcagttcatagtcagggtgaaaaattgactgtgaactttgg

SEQ ID NO: 19875 - protein, 213 aa, Panicum virgatum
  misc_feature: Ceres CLONE 1807341
  misc_feature (96)..(213): Pfam Name: SPRY Pfam Description: SPRY domain
  misc_feature: SWISSPROT Homolog: EC 2.7.10.2 Non-specific protein-tyrosine kinase
MVANQEAEAASAAAPGAGTPVDPMRLASRWRSPAEWECAAAELDAEPLPSELNTVNSSGLFAVVSTDKLSVKYLGSHHHGHDVGVVQADRPAPTRRAVYYFEMRVKNAGYKGQTSIGFTSESFKMRRQPGWEPNSCGYHGDDGHLYRGQGKGEPFGAKFTSGDTIGAGINYLSQEFFLTKNGSLVGAFPKEIKGPLYPTVAVHSQGEKLTVNF

SEQ ID NO: 19876 - DNA, 658 bp, Panicum virgatum
  misc_feature: Ceres CLONE 1807341-R
atcagggctgaacaactggaggatgctgtgaaatatgctcgtgctaacctggcaagcttcttgacgcacaaagctttcgaggggttgctgaaggagagtgtggccctgcttgcgtatgagaagcctgcagaatcatgcatcggatacctgctggactccccccagcgtgaattcgtggcggatgcagtgaacgcagctgtcctgtctacgaacccagccatgaaggaccccaagagctgtctttactcgtgtctcgagaggttactaaggcagctcacagtatgtagctttgagcgacgcaccttcaacaatgaccaaggagatgcattcttacttcacaaagaagtgcgcaactgtgaaaggtcctggcgttcataggcacatctgagaattctcggatgttagactccaactgctgttgggaggaccaaggatcacctcggatggagttgttgagcatggcacgcgcaagcacagatccttccttttgaaggtctgcagcgtccatgggctttctaattccgataggtgcacttaattgcacagagctctgaaggagtttccttcctgtaatcagaaaacttgttcagaatcggccaacgtgtctgttcccatagtttgatggttggctaatagaccatttgattttgtgaatgcc

SEQ ID NO: 19877 - DNA, 2082 bp, Panicum virgatum
  misc_feature: Ceres CLONE 1807345
  misc_feature: Encodes the peptide sequence at SEQ ID NO. 19878
atctccaaatcctccaatggctcctccacctccgccaccccgcgccgtcctcctcctcctggtgctcctcctcccgcacaatgccgccgccgggggtgccgcgccgtccccggcggtgaacccgttcacggcgaaggcggccttcatccggtactggaaccgcaaggtgcccaacaaccgcccgcacccggccttcttcgtctccaagctctccccgctcgcggccgccgacaccgcctccttcccctccgcgctgcccgacatccgcgcccgcctccccgcgctctgctcccgggccggcctcctctgcgccggcccggccgccgacgctgacgcggcgtcgctcgccaagcccgccggcccgttcaagagctacagcaacgccaacttctccaactacggcaccggcggcgacgggggggccgactccttccggaactactccccggacctcaacatcgccgccgactccttcctccgctacagccgcgactcgtccggccgcgccgaccgcttcgactcctacgaggccgacggcaacgtcgtcaccgccaacttcacctcctacgccggcggcgccaccggcgggtccggctccttcgccgcctacgccgccgggaccaacgtcccggactccaccttcaccaactacgacgcccaggccaacggccgcgcccgcggcttcgcgtcctactccaaggaggccaaccacggggagagcggcttctccggctacggcaggggcggcaacggcgtgcgggagaccttcgcgtcctacggcaacgagtcaaacgtcctggcctccgccttcgccagctacggccagtccgccaacggcgccaccgacaccttcacgggctacggcgtcgaggggaacgtccccgagaacacgttccggagctacggcgccggcggcaacgccggcgtcgacaccttcaagaggtaccgcgacgacgccaacgtcggcgacgaccggttctcctcctacgccaagggcgccaacggcggcgccgccgagttccagagctacggcaactcggccaaccccgggagcaccgccttcaagggctacggcgagggcaccaaccccaaccaccacattggcttcaaggagtacgccggcgagaacaacaccttcaagggctacgccagcaccggcgtcgacttcaaggagtaccacaacacctccgccgccgcctccgcggagctgacggtgacggcggaggcggcggcgtcgatgcgccaccagcacctccggtggtcgccggagcccgggaagttcttccgggagcgggagctcgtggccggcaaccgaatgccgatgccggacatccgggacaagatgccgccccgggcgttcctgccccgggacatcgccgcccggatcccgttcgagccgggcgccgtgtcggaggtgttcggggtgcccctcgacacggcgatggggaaagccgtggcgtccacggtggccgagtgccggcgcgcgcccagccggggcgagacgaagcggtgcgcgacctcggccgaggacgtcgtggacttcgccgtggagatgctgggcagcgacgtcgtggtccgcagcacggcctccaccgccggcagcggcggcgacgtccggctgggcgccgtcacgggcgtggacggcggcagggtgacccggtccgtgtcgtgccaccagagcctgttcccgtacctggtgtactactgccactcggtgcccaaggtgcgggtgtacgaggccgacatcgccgccgccgacgacgacggcgagaagatcatcaaccgcggcgtggccatctgccacctcgacacgtcggactggagcccggggcacggcgcgttcgccgcgctcggcgggaggcccggcgagctcgaggtgtgccactggatcttcgagggcgacatgacgtggacggtcgcggattgaccgacgtggcccgaggcgaataatccttcttcctcttcttgcagggtcggcatttttttttcttcactgctttctcaacctaccttaccttacctcaaggtggtaagtcagaaatttgtgcgatttgtataggagagaaaagagaagggttggtc

SEQ ID NO: 19878 - protein, 636 aa, Panicum virgatum
  misc_feature: Ceres CLONE 1807345
  misc_feature (420)..(635): Pfam Name: BURP Pfam Description: BURP domain
MAPPPPPPRAVLLLLVLLLPHNAAAGGAAPSPAVNPFTAKAAFIRYWNRKVPNNRPHPAFFVSKLSPLAAADTASFPSALPDIRARLPALCSRAGLLCAGPAADADAASLAKPAGPFKSYSNANFSNYGTGGDGGADSFRNYSPDLNIAADSFLRYSRDSSGRADRFDSYEADGNVVTANFTSYAGGATGGSGSFAAYAAGTNVPDSTFTNYDAQANGRARGFASYSKEANHGESGFSGYGRGGNGVRETFASYGNESNVLASAFASYGQSANGATDTFTGYGVEGNVPENTFRSYGAGGNAGVDTFKRYRDDANVGDDRFSSYAKGANGGAAEFQSYGNSANPGSTAFKGYGEGTNPNHHIGFKEYAGENNTFKGYASTGVDFKEYHNTSAAASAELTVTAEAAASMRHQHLRWSPEPGKFFRERELVAGNRMPMPDIRDKMPPRAFLPRDIAARIPFEPGAVSEVFGVPLDTAMGKAVASTVAECRRAPSRGETKRCATSAEDVVDFAVEMLGSDVVVRSTASTAGSGGDVRLGAVTGVDGGRVTRSVSCHQSLFPYLVYYCHSVPKVRVYEADIAAADDDGEKIINRGVAICHLDTSDWSPGHGAFAALGGRPGELEVCHWIFEGDMTWTVAD

SEQ ID NO: 19879 - DNA, 2413 bp, Panicum virgatum
  misc_feature: Ceres CLONE 1807365
  misc_feature: Encodes the peptide sequence at SEQ ID NO. 19880
acacccggtcgaagcggcgggttcctgctcccgatccagccagcggcgacccgggatggcggcggcgccgccggacggccaggagaaggtgatcgcggcggcgcagcacatcgtcaagtcgctcgccagctccaagaacgccgccgacgacatgatccgcatcctctccggcttcgacaaccgcctctctctcatgtccgacctcttccccccgccccctggcgccggcgccggcgccgcggccggcggtcccatcctcgaggcggacgaggggacctcccagggggacggggaggggcacgaggaggacgagcccgaccccgacgacgccgccgcggcgcgggccgagcaggagtgggacgccgcggcggaggtgatcgagcgctgggagtccccctccgccggggacaggacggtgttcggcacgcgggaggacgccgaggagtacctcgccgcggccgcctgcctcgcgggcgcgccgggcccgcgcgccgaggccgcgctgcaggccgcgatggcgcggcttgaggacgagttccgccacctgctcatccgcggggcctcgccgctcgctgctgaggacctgcaggcgtcgctcctccgccggctctcgctcacggtaccctccttcaactcctccgccgtagacctagattgcccctccttcgccaaccacgccggcgagggccgggacgagccggccggcaggagctcggtctccgacgacgagatctcgccctacctcaccgctccggacaccgtcggcgccctcagggacatcgcggacgtcatgctgcgcgcgggctacgcgcccgagctgtgccaggtttacggggaggtgcgccgggacacgctcatggagtgcctcgccgtgcttggggtcgacaagatgagcctcgaggaggtacagcgcgtggaatggggcgttcttgatggcaagatgaagaaatggatccaggcgctcaaggtcgtcgtccggggccttctcgctgaggagcgccgcatctgcagccagattcttgcggctgacccaaatgctgaggaggagtgcttcgctgaggctgccaagggatgcgtcctgcagctgctcaactttggtgatgccattgcaattgggaagagatcatctgagaagctgttccgcatccttggtatgtatgaagcgttggctgatgtgctgccagagctcgagggtttgttctcaggtgaggccaaagatttcatcaaggaagaggctgaggggatacttgtgcggcttggtgatgcagtgcgtggcacgattgctgagtttgccagtgccatacagggagagacttctcggaggccgctgcccggtggggagatccaccccctcacacgttatgttaagaactatgtacggcttcttgcagattacagtgcctcgctgaatcaacttctcgaatattgggacactgagctgaatgggggtgataatccaaacatgactccattggggcattgcgtgctcatgctgatcacacacctacagagcaaaattgatgagaaatcaaggctgtatgaggatgaggcgctgcagaacatatttttgatgaacaatctgctgtacattgtgcagaaggtgaaggattcagagctgaagacattgcttggtgataactggatacgcaaacgccgtggtcagataaggcaatactctacagggtatctccggtcgtcatggactagggtgttagcttgcctgagagatgatgggttgccacagacaatgggttcatcaagtgcactcaagaacgcactgaaggatagattcaagaatttcaacttggcctttgaggagctgtacaggacacagacatcatggagggttgtggatcctcagttaagggaagagctgaagatttccatctcggagaaggttcttcctgcataccgttcgtttgttgggagatttcggggccagttggagggagggagggggtctgcaaggtacataaagtacaaccctgaggatttagagaaccaggtttcagatttctttgaagggaaaaggccaaatgcttgatggtcaaggaatgttcatatcaatgatgcctccaagtcccatggaaattttgatgatgctagttccaagtcccgtccaaattttattggcactactgtacagggaacttgaccttccatacgtcttttgaaggtctgaagatggaaatataaacttctcctgaactgaccgaaatgaagtgaactgcaaagcaacctaaattgaatgatttagcttctcatccttgatcctgtcaaggtgagtggtgacattattgaggcttgcacaaggaattatgacaactgaatctgtcatgagctgtgtaatccgattcttacactttgcccttcttttgttgattgtaacatctggtcactattgtttgacttc

SEQ ID NO: 19880 - protein, 662 aa, Panicum virgatum
  misc_feature: Ceres CLONE 1807365
  misc_feature (89)..(656): Pfam Name: Exo70 Pfam Description: Exo70 exocyst complex subunit
MAAAPPDGQEKVIAAAQHIVKSLASSKNAADDMIRILSGFDNRLSLMSDLFPPPPGAGAGAAAGGPILEADEGTSQGDGEGHEEDEPDPDDAAAARAEQEWDAAAEVIERWESPSAGDRTVFGTREDAEEYLAAAACLAGAPGPRAEAALQAAMARLEDEFRHLLIRGASPLAAEDLQASLLRRLSLTVPSFNSSAVDLDCPSFANHAGEGRDEPAGRSSVSDDEISPYLTAPDTVGALRDIADVMLRAGYAPELCQVYGEVRRDTLMECLAVLGVDKMSLEEVQRVEWGVLDGKMKKWIQALKVVVRGLLAEERRICSQILAADPNAEEECFAEAAKGCVLQLLNFGDAIAIGKRSSEKLFRILGMYEALADVLPELEGLFSGEAKDFIKEEAEGILVRLGDAVRGTIAEFASAIQGETSRRPLPGGEIHPLTRYVKNYVRLLADYSASLNQLLEYWDTELNGGDNPNMTPLGHCVLMLITHLQSKIDEKSRLYEDEALQNIFLMNNLLYIVQKVKDSELKTLLGDNWIRKRRGQIRQYSTGYLRSSWTRVLACLRDDGLPQTMGSSSALKNALKDRFKNFNLAFEELYRTQTSWRVVDPQLREELKISISEKVLPAYRSFVGRFRGQLEGGRGSARYIKYNPEDLENQVSDFFEGKRPNA

SEQ ID NO: 19881 - DNA, 1378 bp, Panicum virgatum
  misc_feature: Ceres CLONE 1807375
  misc_feature: Encodes the peptide sequence at SEQ ID NO. 19882
gacccgagctcgtgagctcactccctcgtcctccccacttattctccccgccagctactgaactaaaaccaaccaacaaatacctccgggctccggctctgcctctcccatggattggaggttggaggcctgaagggtaggtaggtcaccggacagggacggggagacggcgagaggtgttccgccggagccgttcgcgtgcttcctccaccggccggccgacgcgcggcgccgctgtttcaggttccagaatttccagtattggctgttttaggatactatgggaaagtccccggggaagtggatcaagtctgtgctcttggggaagaaatcaactaaatccggatctaccaaggcaaatgagtcgaaggctacaaataacaacggacactcagctggggaggagcgtgcattttctgagaattctccagtgatctctgaaccggtgcttgttaaggcccacaaaaatggagctgtttcaattaatgggaaggctgaagatgtcaatttgccaagtgatcgggctggccaacaagatctgcagaaccaaaacattgttgattccgaaacttcagttcctgggcaattgggagaagaccaagctgcagtgaaggcacaggcagcctttcgtggttacctggcacgaaggtcattccgtgcattgaaaggtatcataagacttcaggcactgattcgagggcatcttgtaaggagacaggctgtttcaacccttcgaactacttggttgattgtgaagtttcaatctctagttcgtggaagaaatgtcagactctctggtgctgacatgcaattcaatgtgaagcttggccaacataaccttggaggcgctagatcatctgatgcatggaaagagaagttatcttcaaatgcctatgttcggaagcttctgtcttcaccaattgtgctagaacctcttcacttccagtatgacaagagggatcccaattcaacctacaactggctagagagatggaccataggctccatctggaagcctgtttttcaaccaaaaagagttcctgatgggaaactgctggtaaggaaggctagttatgcgatggaaactgaatcagccaagttaaagcgcaacactaggaagggttcagccacaacagttgagagtttcaatacaagcgtgactggtgaatctgagaaacttaaacgtaatccaaagaaatcctctaacttccctgctgactcagtaccagatagccagttatctgaacttgagaaggttaaaaggaacctcaggaaggtaactgattccatggctgaagcctcaaagatctctagttccagggttgattcctcaaggtatctgattctacacccgatgctcctaaagtatctaatcctg

SEQ ID NO: 19882 - protein, 365 aa, Panicum virgatum
  misc_feature: Ceres CLONE 1807375
  misc_feature (106)..(126): Pfam Name: IQ Pfam Description: IQ calmodulin-binding motif
MGKSPGKWIKSVLLGKKSTKSGSTKANESKATNNNGHSAGEERAFSENSPVISEPVLVKAHKNGAVSINGKAEDVNLPSDRAGQQDLQNQNIVDSETSVPGQLGEDQAAVKAQAAFRGYLARRSFRALKGIIRLQALIRGHLVRRQAVSTLRTTWLIVKFQSLVRGRNVRLSGADMQFNVKLGQHNLGGARSSDAWKEKLSSNAYVRKLLSSPIVLEPLHFQYDKRDPNSTYNWLERWTIGSIWKPVFQPKRVPDGKLLVRKASYAMETESAKLKRNTRKGSATTVESFNTSVTGESEKLKRNPKKSSNFPADSVPDSQLSELEKVKRNLRKVTDSMAEASKISSSRVDSSRYLILHPMLLKYLI

SEQ ID NO: 19883 - DNA, 742 bp, Panicum virgatum
  misc_feature: Ceres CLONE 1807375-R
ggaagaaagaggaaccaaagtccaaggaagagcatctgtctaatggaagccttagaagtagcaagagaaagtcttcatccccaaacaaatcagaatatgtggaaaatgggactcgcgctacccctgttcagccatggaagccaagctatatggctgcaacggagtctgcgaaggcgaaattgcgagcacagaattcacccagggtggattctgattcatcagcagagaagaatagcttcgctcgacgccactctcttccttccggtacaaacagtagggcgatcaaagctgaatggaagcgctgaagaggcgaccagtcattgacttgaactgaatagtgcgatgctctgaatctctgctggaagaactctgccgctgcttgctcctttttattttatcctgcgatgtaaagagagacgttgtccttgtattgaacaacctttgtgatgagtgcctctggttcagtctgttgtaggttcatgtgccacgccttgtgcctcgtgtcattgtatccagtggcgaagctagagtaagttggaggggtgcgtctgactcgtgggtgcataaggttgagtcatggaacatgcaccccctaataacaacgtggcttcgccccctgattgtatagtcacagttctctcgggatttgaaatcgattcctcgtcgaaggaattatgcatgtgtaagctaatgttaagactgcagtctgattgaataacatcatccgcttgcacactgcctt

SEQ ID NO: 19884 - DNA, 2351 bp, Panicum virgatum
  misc_feature: Ceres CLONE 1807407
  misc_feature: Encodes the peptide sequence at SEQ ID NO. 19885
gcgctctcttctctctcctcgcgacgccgccgttgggagccctgccctgactccgggagagcccccaacctttatcaaaccctaaaccagaaaacctaccccaaaaaaatccgcaaaaaatcccagaaaaaaaatcaccaccacccgatcggagatggcggcgcaggggcaacaggcggcggcggcggcggctggatccgagtccggcggcggctccccggccgctacggccggggcggcggcggcggccggggcggcgttccccgcgacctcgctgtacgtgggcgacctgcacgagagcgtgcaggacgcgcagctcttcgacgtcttcagccaggtcggcggcgtcgtctccgtacgcgtctgcagggacatcaactcccgcaagtcgctcgggtacgcctacgtcaactacaacaacccggccgacgctgcacgggcccttgaactgcttaacttcactcctatcaatggaaagcctatcaggatcatgtattctaaccgtgaccccagctcacgcaaaagtggcgcaggaaatatatttattaagaatcttgataaatcaatagacaacaaagctttgtatgacacgttctgtgcatttgggaacatcctttcatgcaaaattgctacagacccatcaggagaatcaaggggctatggctttgttcagtttgagagggatgaatctgctcaatctgctattgataagcttaatgggatgcttatcaatgacaagaaagtgtatgttggaccttttgttcgcaagcaggaccgtgaaaatgtctccagcaatgtcaagttcagcaatgtttatgtgaagaatctttctgagactgtaactgatgatgagttgaaggagatgtttggaaaatatggaaccataactagcgctgttgttatgagggacagtgatggaaaatccaggtgttttggatttgtcaattttgaaaatgctgatgatgcttctcaggctgttcaagagttgaacggcaaagtattcaatgataaggaactgtttgttggaagagcacagaaaaagtcagaaagagagatggagttgaaggagaaatttgaaaagaatattcaagaagtaactgagaagttccaaaacactaacttgtatctgaaaaacttagaggacaatgttgatgatgagaagttgcgtgaactctttgctgagtatggctctattacttcctgcaaggttatgcgggattcaaatggtgtcagcagagggtctggatttgttgctttcaaatccgcggatgatgctgctcgcgctctcacggaaatgaacggcaaaatggttggaagcaagcccctttatgtagctcttgcacagcggaaagaagacaggaaggcaaagctacaggcacaattttctcaaatgcgtcctgttgcaatggcaccttctgttggtcctcgcatgcccatgtttccacctggcgttcctggagttggtcagcagctgttttatggtcagccacctccagcctttatcaacccccaggctggatttgccttccagcaacctttgatgcctgggatgaggcctggggctccaatgccaaattttatgatgccaatggttcagcaagggcagcagccacagcgtcctgctggtaggcgtgctggtactggtggaatgcagcaacctatgccaatgggtggtcagcaacagatgttccctagaggtgggcgtggctaccgctatcccactggtcgcggaatgcctgatcctggcatgcatggtgttggggctgtgataccagctccatacgagatgggtgggatgccaattagagatgctggcgtgtcacaacctgttccaattggagcactagccactgcgcttgccaacgccccaccggatcagcagaggctgatgcttggtgagaacctgtatcctctagttgatcagctggagcatgagcaggctgccaaggtgactggcatgcttttggagatggaccagacggaggtcctgcacctgctggagtcgccagatgcgctcaaggccaaggttgctgaagccatagaggtcctccgctccgcccagcatctccagcagacctccccggagcagcagctggctaatctgtccctgaacgatggcgtcgtctccagctgaatgtgtccgatgacttgatcggaggctgctggcaatttttgcttatacttatcctatctagagtgcaatgacttgatttgctttgtttattggagttctagcttgctctataattagctgaactaggtttggtctagttttgtcctggattggttgttttgatcgtatggatatgttgtttcgtatggatatgttgtttcgttgtcgggttgtcacc

SEQ ID NO: 19885 - protein, 659 aa, Panicum virgatum
  misc_feature: Ceres CLONE 1807407
  misc_feature (220)..(290): Pfam Name: RRM_1 Pfam Description: RNA recognition motif. (a.k.a. RRM, RBD, or RNP domain)
  misc_feature (323)..(393): Pfam Name: RRM_1 Pfam Description: RNA recognition motif. (a.k.a. RRM, RBD, or RNP domain)
  misc_feature (41)..(112): Pfam Name: RRM_1 Pfam Description: RNA recognition motif. (a.k.a. RRM, RBD, or RNP domain)
  misc_feature (129)..(199): Pfam Name: RRM_1 Pfam Description: RNA recognition motif. (a.k.a. RRM, RBD, or RNP domain)
  misc_feature (561)..(632): Pfam Name: PABP Pfam Description: Poly-adenylate binding protein, unique domain
  misc_feature: SWISSPROT Homolog: EC 5.2.1.8 Peptidylprolyl isomerase
MAAQGQQAAAAAAGSESGGGSPAATAGAAAAAGAAFPATSLYVGDLHESVQDAQLFDVFSQVGGVVSVRVCRDINSRKSLGYAYVNYNNPADAARALELLNFTPINGKPIRIMYSNRDPSSRKSGAGNIFIKNLDKSIDNKALYDTFCAFGNILSCKIATDPSGESRGYGFVQFERDESAQSAIDKLNGMLINDKKVYVGPFVRKQDRENVSSNVKFSNVYVKNLSETVTDDELKEMFGKYGTITSAVVMRDSDGKSRCFGFVNFENADDASQAVQELNGKVFNDKELFVGRAQKKSEREMELKEKFEKNIQEVTEKFQNTNLYLKNLEDNVDDEKLRELFAEYGSITSCKVMRDSNGVSRGSGFVAFKSADDAARALTEMNGKMVGSKPLYVALAQRKEDRKAKLQAQFSQMRPVAMAPSVGPRMPMFPPGVPGVGQQLFYGQPPPAFINPQAGFAFQQPLMPGMRPGAPMPNFMMPMVQQGQQPQRPAGRRAGTGGMQQPMPMGGQQQMFPRGGRGYRYPTGRGMPDPGMHGVGAVIPAPYEMGGMPIRDAGVSQPVPIGALATALANAPPDQQRLMLGENLYPLVDQLEHEQAAKVTGMLLEMDQTEVLHLLESPDALKAKVAEAIEVLRSAQHLQQTSPEQQLANLSLNDGVVSS

SEQ ID NO: 19886 - DNA, 1877 bp, Panicum virgatum
  misc_feature: Ceres CLONE 1807413
  misc_feature: Encodes the peptide sequence at SEQ ID NO. 19887
aattacctgctctgctcggctccactgctccctgctgctcctccgtcccctcccatacccaatagtcccatccctgagacccaggccagaccaggcatgccgcgcacggcggcggctgcggcgccccccgcgcggaaggtgcccctccgcaagctgctgcgcgcggcgtcggtggcctgcggggtgcagttcggctgggcgctgcagctgtcgctgctcaccccctacgtgcaggagctcggcatcccgcacgccttcgccagcctcgtctggctctgcggcccgctctccggcctcctcgtccagcccctcgtcggccacctctccgaccgcatcgccccggccgcctccccgctcggccgccgcaggcccttcatcgccgccggcgccgcctccatcgccgccgccgtcctcaccgtcggattctccgccgacctcggccgcatcttcggcgacgacatcaccccggggaggacgcgcctcggagccatctgcgtctacctcgtcggattctggctgctcgatgtcggcaacaacgccacgcaggggccctgcagggccttcctagcggacctcaccgagaacgacccaaggaggactcggattgctaatgcatacttttcactcttcatggccctgggaaacatacttggatatgccaccggagcatacagtggctggtataggatatttcctttcactgttacaccatcctgcagcatgagttgtgccaacctcaagtctgcctttcttcttgacattattgttctggtgattacgacatacattactgtagcatcagtgcaagagccgcaaacttttggaggtgatgaagcagaatacccaggtaccgaacaggaagctttcctctgggagctttttgggtcattcagatacttcacgctaccagtttggatggtcttaattgtcactgcccttacatggattggatggtttccttttatcctctttgatactgattggatgggccgagagatctaccgaggaagcccagacaacccaggagagactcaaagataccatgatggtgtgagaatgggttcttttggtctaatgctgaactctgtccttcttggattcacctctgttgtactagaaaagttatgtaggaagtggggagctggactagtatggggtgtctccaatatactgatggcgttatgctttgtggctatgcttgttattacatatgtcgcaaagaacacggattatcctcccaatggagtacctccaactggcattgtcattgcttctcttgtggtttttacaattttaggagcacccctggcgattacatacagtataccatatgcaatggctgctagtcgtgttgaaaatctgggccttggccaaggtctagcaatgggcattctaaatttagctatcgtcataccacaggttattgtgtcacttggtagtgggccatgggatcaactgttcggcggtggcaatgcgccggcttttgcggtggcagccggtgcatcgttcatcggtgggctggtggctattctggggcttccacgagctcgcattgcatcatcgaggaggagaggcgggacacaccgataaggtgcatagtacgtacataatgtgtatgatgtggaagtgttgcaacttgcgacaattctttgcggggaaatttatggggaggcgggttttggagaagagcaggaagctcgtgaatgatgtccttttcctttcctttttggcggtttgccctgttgagctatttttggctttgtctccgatccatcatttgtggtttggaatgtatgtatgtgtatgtatgtacgtcggtcatgtgtagggaggttaataattaataaataaaagttacaggagttacgtttactggc

SEQ ID NO: 19887 - protein, 497 aa, Panicum virgatum
  misc_feature: Ceres CLONE 1807413
  misc_feature (21)..(458): Pfam Name: Sugar_tr Pfam Description: Sugar (and other) transporter
MPRTAAAAAPPARKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDDITPGRTRLGAICVYLVGFWLLDVGNNATQGPCRAFLADLTENDPRRTRIANAYFSLFMALGNILGYATGAYSGWYRIFPFTVTPSCSMSCANLKSAFLLDIIVLVITTYITVASVQEPQTFGGDEAEYPGTEQEAFLWELFGSFRYFTLPVWMVLIVTALTWIGWFPFILFDTDWMGREIYRGSPDNPGETQRYHDGVRMGSFGLMLNSVLLGFTSVVLEKLCRKWGAGLVWGVSNILMALCFVAMLVITYVAKNTDYPPNGVPPTGIVIASLVVFTILGAPLAITYSIPYAMAASRVENLGLGQGLAMGILNLAIVIPQVIVSLGSGPWDQLFGGGNAPAFAVAAGASFIGGLVAILGLPRARIASSRRRGGTHR

SEQ ID NO: 19888 - DNA, 2012 bp, Panicum virgatum
  misc_feature: Ceres CLONE 1807448
  misc_feature: Encodes the peptide sequence at SEQ ID NO. 19889
gcggctgcttctggattcccctgcagtctcggaccccggcccagcgacctcctccccggccccgccgccgatcaagtccaggcctttttcttccgccaggtcaatcagcccaactaggaaacaccgatctgtgtcagggagtatggctgggggtggcacaggcatcaggaagtacgtcggggctctcaaggacaccacaacagttagcatagcaaaagtgaacagtgattataaggagctggatattgctattgtgaaggccacaaaccatgttgagcgtccagcaaaggagaagtacataagagatcttttttaccatctttctcctggaaggcctcgtgcagatgtagcctactgcatccgtgcccttggtagacgtctttcaaagacacgcaactgggcggttgctctgaagacattagttgtcatacaccgtgctcttcgggaagtagatcctactttccgtgacgagtttataagttatggaagaactagctcccatatgctccatctgtcctactttaaggatgattctagtgcagaagcctgggattactctgcatgggtgcgcaattatgctttatatttggaggagagagtcgaatcattccgtgtactgaagtatgacattgaaaaggatccatctagaactcgggatcttgatacgattggattgctcgaacagttaccagcattacagcagcttctttttcgtctacttgattgccagccacaagggtcatcatcttataacatcataattcagcatgcactatcaatggttgctctagagagtgttaggatccaaacagccatcaatgatgcaatactcaatcttgttgacaagttttttgagatgcaaagagatgatgctataagggcccttgacatgtataaaagagcgattagccaggcagaacaactttcagaattttatgaagtgtgtaaaagtatacatattgggcgtggtgagagattccttaaaattgaaaagccacctgcatcgttcttggcaactatggaggagtatgtgagcaatgctccccttgcttcaatggttcagagaaatcaggctgtactagctatagaatacaacagaaaattggaagctgaagaaccatcaatgccaccgcctccagctccagcttcagaacctgtacctgagccagttaaagaagtccctcccgcggctgaaccaacagatctgctgggaatgaatgaatcaacccctgacacatctgaaatagatcaaaagaatgcttcagcattggcaattgttccacaagcagataatgcgcctaaagcacctactcctaccggtactgaaagcgtggccaccagctgggagctggcgctagtcactgcacccagtgcaaatgaaactgctgttacttcaagcaaattggctggtggactggacctgcttacacttgacagtctatacaatgaggcgcaccgtcaagcacagcaggcacagcagaatgcgagccagaacccttgggagaccgttccagcatcaggtccaatgatgcagcaaccgatgtacgacccgttctacgcctccaactccattgccgcagcccgcaacgtgcagatggtggcgatggcgcagcaacagcatgccttcatgctccagcaggagcagcagcggcagatgatgatggtgatggcacagcagcagcaagcctcttcgaatccgttcgccgacccgtatatgcaccctggtgcagggatgcagctccatgccagaaacgcatacactggaactggtatgatgtagggcgccacagaacatactactctgtttttggcacctttggttcctttccttcccattgtaagaatgacaatatgagcacagccatagaagaattttttgcttctttctggctgttcatgagcaagaaggtcgatgtacacctgggaactgaactactgaaggactagtatccttgcaaaatttagtacgagaaacacagtcattttctgatgtgaatataaaaggctttgtt

SEQ ID NO: 19889 - protein, 545 aa, Panicum virgatum
  misc_feature: Ceres CLONE 1807448
  misc_feature (30)..(300): Pfam Name: ANTH Pfam Description: ANTH domain
MAGGGTGIRKYVGALKDTTTVSIAKVNSDYKELDIAIVKATNHVERPAKEKYIRDLFYHLSPGRPRADVAYCIRALGRRLSKTRNWAVALKTLVVIHRALREVDPTFRDEFISYGRTSSHMLHLSYFKDDSSAEAWDYSAWVRNYALYLEERVESFRVLKYDIEKDPSRTRDLDTIGLLEQLPALQQLLFRLLDCQPQGSSSYNIIIQHALSMVALESVRIQTAINDAILNLVDKFFEMQRDDAIRALDMYKRAISQAEQLSEFYEVCKSIHIGRGERFLKIEKPPASFLATMEEYVSNAPLASMVQRNQAVLAIEYNRKLEAEEPSMPPPPAPASEPVPEPVKEVPPAAEPTDLLGMNESTPDTSEIDQKNASALAIVPQADNAPKAPTPTGTESVATSWELALVTAPSANETAVTSSKLAGGLDLLTLDSLYNEAHRQAQQAQQNASQNPWETVPASGPMMQQPMYDPFYASNSIAAARNVQMVAMAQQQHAFMLQQEQQRQMMMVMAQQQQASSNPFADPYMHPGAGMQLHARNAYTGTGMM

SEQ ID NO: 19890 - DNA, 2179 bp, Panicum virgatum
  misc_feature: Ceres CLONE 1807460
  misc_feature: Encodes the peptide sequence at SEQ ID NO. 19891
atccatccgtctccgctgcttgcgatccagcggaattcccgggtagcctggcccctccattggcggacctccggcaacggcaagcccccccggcggcacaaaccgtctcccgcgcctgcttccccccgtgggctccgtttctctcaagtgggccccggaagatccagctactcgcgtgcatccacgtggcactggccgtcgaaccggctataaatcccccgccccgggcgctcctccccgatcacaccccagagcagcgcagccgcctccttcctcctcctcttctccctctctctcgcgctgctcttcgcgttccgttccaggagagcagtgaggcaggtagatagtggtggtcgatcgaccgagagggtagggcaggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtaccacttccggaccagcaccgccgtccccaagctcggggtgctgctcgtagggtggggcggcaacaacgggtccacgctgacggctggggtcatcgccaacagggaggggatctcatgggcgaccaaggacaaggtgcagcaagccaactacttcggctccctcacccaggcctccaccatcagggttggcagctacaacggggaggagatctacgcgccgttcaagagcctcctgcccatggtaaaccctgatgacattgtgtttggaggctgggacattagcaacatgaacctggccgatgccatgaccagggccaaggtgctggacattgacctgcagaagcagctcaggccatacatggagtccatggtgccacttcccggcatctatgatcccgacttcatcgcagcaaaccagggttctcgcgccaacaatgtcatcaagggcaccaagaaagagcaggttgaccagatcatcaaggacatcagggagttcaaggagaagaacaaggtggacaaggtagttgtgctgtggactgcaaacactgaaaggtacagcaatgtctgtactggtctcaacgacacagtggagaacctcctgaaatctgtagacaagaacgaggcggagatctcaccgtcgacgttgtatgccattgcctgtgtcacggagggtgtaccattcatcaatggaagcccccagaacacctttgtgcctgggctgattgaccttgctatcaagaacaactgcttgattggaggagatgatttcaagagtggacagaccaagatgaagtctgttttggttgatttccttgttggtgctggaattaagcccacctcaattgtgagctacaaccacttgggaaacaatgatggcatgaacctgtcggcccctcaaacattccggtccaaggagatctccaagagcaatgtggtggatgacatggtctcaagcaacgctatcctttatgagcccggcgagcatcctgatcacgttgtcgtgatcaagtatgtgccgtacgttggggacagcaagagagccatggatgagtacacctctgagatcttcatgggcggcaagaacaccatcgttctgcacaacacctgcgaggactcgctcctcgccgcaccaatcattcttgatctggtgctcctggctgagctcagcaccaggattcagctaaaagctgagggagaggagaagttccactccttccacccagtggccaccatcctgagctacctcaccaaggcacccctggttccccccggcacgccggtggtgaacgccctagcgaagcagagggcgatgctggagaacatcatgagggcctgcgtcgggctggcccctgagaacaacatgatcctggagtacaagtgagcgctgcgggcggccgcctactggaagggaacaagaaaggcgagactagctatgggactgtgttggcttctcgtttgttttttttgccttctttcctgctcattgttgtacaagtatgggtttgttcgtcaggtcgtaattatcagggctctgctattagcggcacgaatcctgtaactgtgtcgtatgataatgtactgagggtgctagttcccctctctattcctaagggactcctactagtgttcgttgc

SEQ ID NO: 19891 - protein, 510 aa, Panicum virgatum
  misc_feature: Ceres CLONE 1807460
  misc_feature (62)..(494): Pfam Name: NAD_binding_5 Pfam Description: Myo-inositol-1-phosphate synthase
  misc_feature (310)..(423): Pfam Name: Inos-1-P_synth Pfam Description: Myo-inositol-1-phosphate synthase
  misc_feature: SWISSPROT Homolog: EC 5.5.1.4 Inositol-3-phosphate synthase
MFIESFRVESPNVRYGPSEIESEYRYDTTELVHEGKDGASRWVVRPKSVKYHFRTSTAVPKLGVLLVGWGGNNGSTLTAGVIANREGISWATKDKVQQANYFGSLTQASTIRVGSYNGEEIYAPFKSLLPMVNPDDIVFGGWDISNMNLADAMTRAKVLDIDLQKQLRPYMESMVPLPGIYDPDFIAANQGSRANNVIKGTKKEQVDQIIKDIREFKEKNKVDKVVVLWTANTERYSNVCTGLNDTVENLLKSVDKNEAEISPSTLYAIACVTEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACVGLAPENNMILEYK

SEQ ID NO: 19892 - DNA, 2033 bp, Panicum virgatum
  misc_feature: Ceres CLONE 1807487
  misc_feature: Encodes the peptide sequence at SEQ ID NO. 19893
aggaacagaagattctctcccactccaactacctcgcccaagtagaggctagagcagcactgcaccataatcctgcctcgctcaaacaccctccccgaccccgacccagccgtcaaaatccaatctttctgctcccctccgccgttttccgccacctccgcccccaagatcggtcttttttgttttctttttcggtccgagcgatcaaaccccactgtatcaacccaatccagtccgtccctagaggctggattggaccatggggtttcgatccgtcggcggggtgctggggttactggtgtgggcggcgttcctgctgggctgctcccacgccaggttcgtggtggagaagaacagcctcaaggtgacggcgcctgacgacctcaagggcacctacgagtgcgccattggcaacttcggcgtgccccagtacggcggcaccatggtcggcttcgtcgcctaccccaaggccaacaagaaggcctgcaaaagcttcgacgatttcgacatctcatacaaggccaagcccggggctttccccactttcctactggtcgacaggggagattgctacttcacaaagaaggcatggaatgcacagaatgcaggagctgcagcaatccttgttgctgatgacaaggatgaacccctaattacaatggacacccctgaagagggtggaagggcagatcatttagacaacatcactattccttcagcactgataaccaagagctttggggataggctcaagaaagcgattgataacggtgacatggttaatgtgaacttggattggagggaggccctgccccatcccgatgagcgtgttgagtatgagttttggaccaacagcaatgacgaatgtggtccaaagtgtgatagccagattgattttgtcaagaccttcaaaggggcagcacaggttcttgagaagaagggttacacggagttcactcctcattacattacctggtactgcccagaggccttcattctgagcaagcagtgcaaatcccagtgcatcaatcatgggagatactgtgcccctgacccagaacaggactttagcagaggatatgatgggaaggacgtggtggtccagaatttgctccaagtttgtgtgtttaaggttgctaaggagcacaagaagccttggttatggtgggactatgttacggattttgcaattcggtgcccaatgaaagaaaagaagtataccaaggagtgtgctgatggagttatcaagtcatttggtcttgaccataaagcaatagataagtgtattggtgatccaaatgctgatgaagaaaatcctgttctgaaagctgaacaggatgcacaaattggcaagggctctcgtggtgatgttaccatcttaccaactctagtaatcaacaatagacaatacagagggaagcttgacaaaggaccagttcttaaagcactttgtgctggctttcgagaaactactgagccagctgtatgcttgagtgaagatatacaaacaaatgagtgcctggagaacaatggtggctgttgggaagacaaggctgctaatatcactgcatgcaaggatactttccgtggaagagtttgtgagtgtccagttgttaaaggggtaaaatttgttggcgatggctacacccattgtgaagcttcgggatctggacgttgtgagattaacaatggaggatgttggaaagagactcggaatggccatacttactctgcctgcactgatgagggctgtaaatgcccagttggtttcaagggtgatggtacgcacaaatgtgaagatattgatgaatgcaaggaaaggactgcatgccagtgcaaagaatgcaaatgcaagaacacatggggaagctatgagtgcggatgcagtggaggtttgctttacatgaaggaacatgatacatgcataagtatgtattcttcatacagtcatacatgtgtaatgttactgtcagcttattattgaattgtgatgctcatgctgaattaatcaaccagtgagacttattggtcat

SEQ ID NO: 19893 - protein, 574 aa, Panicum virgatum
  misc_feature: Ceres CLONE 1807487
  misc_feature (57)..(168): Pfam Name: PA Pfam Description: PA domain
MGFRSVGGVLGLLVWAAFLLGCSHARFVVEKNSLKVTAPDDLKGTYECAIGNFGVPQYGGTMVGFVAYPKANKKACKSFDDFDISYKAKPGAFPTFLLVDRGDCYFTKKAWNAQNAGAAAILVADDKDEPLITMDTPEEGGRADHLDNITIPSALITKSFGDRLKKAIDNGDMVNVNLDWREALPHPDERVEYEFWTNSNDECGPKCDSQIDFVKTFKGAAQVLEKKGYTEFTPHYITWYCPEAFILSKQCKSQCINHGRYCAPDPEQDFSRGYDGKDVVVQNLLQVCVFKVAKEHKKPWLWWDYVTDFAIRCPMKEKKYTKECADGVIKSFGLDHKAIDKCIGDPNADEENPVLKAEQDAQIGKGSRGDVTILPTLVINNRQYRGKLDKGPVLKALCAGFRETTEPAVCLSEDIQTNECLENNGGCWEDKAANITACKDTFRGRVCECPVVKGVKFVGDGYTHCEASGSGRCEINNGGCWKETRNGHTYSACTDEGCKCPVGFKGDGTHKCEDIDECKERTACQCKECKCKNTWGSYECGCSGGLLYMKEHDTCISMYSSYSHTCVMLLSAYY

SEQ ID NO: 19894 - DNA, 635 bp, Panicum virgatum
  misc_feature: Ceres CLONE 1807508-R
  misc_feature: Encodes the peptide sequence at SEQ ID NO. 19895
cgcccccccggccgcggtcccggcggccaagaaggcggcggcgccggcgttggaagacgccgagctgcagcggaggaagcggctggtggtgtacaagacgtacgacgtggagggcaaggtccgggagtcggtgcgccgcggcgtcagctggatcaagggtaagtgctcccgcgtggtgtacggctggtggtgatcgatcgctccgccgccgtcttccaccgggccgatctcaccacgccgccgcgccatgcctgacgatctcctggtcctggaacgagcgtgagattatttcgatcgatcatgtggttcagagtgtactggtactgctaccacctatgggttgagcgtttcttggtggatgctgtcatcgtctatagagactctctacaacttgatgtctttttgttcttggagataggatatgatttgattttttaggagttcgatttggtggcatgtagcagagcagtggagcttctcttggtggtttgtgagggagggtagctaggatactcgaggagaatgctccagcaggtgttgtccttcctgtacagataccatctttccagtgtacttactagcagtatctggttgatgtaatttaggtactatacatgtatagaataagttttggt

SEQ ID NO: 19895 - protein, 63 aa, Panicum virgatum
  misc_feature: Ceres CLONE 1807508-R
  misc_feature: Functional homolog of the protein sequence given in SEQ ID NO 50886
  misc_feature: Useful for making plants with modulated biomass
  misc_feature: Useful for making plants with modulated nitrogen use efficiency
APPAAVPAAKKAAAPALEDAELQRRKRLVVYKTYDVEGKVRESVRRGVSWIKGKCSRVVYGWW

SEQ ID NO: 19896 - DNA, 548 bp, Panicum virgatum
  misc_feature: Ceres CLONE 1807508
ttgagttcctgtccctgttctaggacggacacatatcccatccaccccagatttgcgcaatccctctgagcgcacactggcaccgcccgggccgtctgatctctaggtgcaggctatttgtcgacggcgatggcggacgcgcggccggcctacggattcccctgatccaggaaaaggaccgcctgtgatgatgcggacgtgctggcggccgccgaagaggaggagcgacgggttcttcatagaggatgacaaggccggatgaggtgctgaccgatacctcctccatcggagcgccctcgccgacgccctccggcttctccattggcgacaactcctcctctgatgccgccgaacaccatcggagaggaggaggttgaaaacgagctcaaggacggtgatgcgctcggatgcttggacgccctcccggaccccttgcacatcaagaagggtctctctcgcttctactccggtcagtctaagtccctccccatcctaccccagcccatgtcaaccgaggcagcggtacaatgatctggtcaatccataca

SEQ ID NO: 19897 - DNA, 1105 bp, Panicum virgatum
  misc_feature: Ceres CLONE 1807514
  misc_feature: Encodes the peptide sequence at SEQ ID NO. 19898
gtgtcatcgtcgtcgtctccttcctccctccttccttcctggtcgcccatggaggattccttagatacgacctaggtgccctgcccaggcattcccctccccctccgccaacgcaccctcggtttcccccattcccatccccgaatcgcgaatcgaaaggtagatatttcggttgtaatcgtcatcatctcctcacgccctattggaagccgcctccccccgcaaaattcctataaaaaaatgggtggagccatcacccacgccgccaagatcctgtcatcttgcgcggccagctcgtagctccacgccggattagataaagcggccaatcttttgcccagctcgtcccccccttttttttcttttggcagggttgcatcttcccccatgtgacacctgagaaagtgagagcaccgatttccttccccttatcgctgttgtttcttgtttctgctcgtgggttcgtcatagataaacctcccataaagcttggtttctcggctctcgatctcaccggcagggttggcttgctttccccgctccaagacccctagcttccccggttcttttgccgccaacccgcggaaatccctgggcgaggcgcagaaatttgcagcgagggattttccgaggtgaatttgtttccacttttgacaggttcttggtcgccgtgcccccaaatttctcactttttttcgttttcttggttcaagaagaggttttccttccctgctgcggcggcctctgtaggattcttgatccggggagcgcacctgtggcgcgccaatgcagccggacccgaccgggaacgccaatgccaaggcgaagctgccgcagccggtgacggcgccggcgccgtcgtcggggcggcctgcgtccgtgctgccgtacaagacggcgaacgtgcgggaccactaccgcatcggcaagaaactggggcaggggcagttcggcaccacctaccagtgcgtgggcaaggccgacggcgccgagtacgcgtgcaagtccattcccaagcgcaagctcctgtgccggggaggactacgaggacgtctaccgcgagatccagatcaatgcaccacctctccgagcaccccaacgtcgt

SEQ ID NO: 19898 - protein, 106 aa, Panicum virgatum
  misc_feature: Ceres CLONE 1807514
  misc_feature: SWISSPROT Homolog: EC 2.7.11.1 Non-specific serine/threonine protein kinase
MQPDPTGNANAKAKLPQPVTAPAPSSGRPASVLPYKTANVRDHYRIGKKLGQGQFGTTYQCVGKADGAEYACKSIPKRKLLCRGGLRGRLPRDPDQCTTSPSTPTS

SEQ ID NO: 19899 - DNA, 593 bp, Panicum virgatum
  misc_feature: Ceres CLONE 1807514-R
  misc_feature: Encodes the peptide sequence at SEQ ID NO. 19900
gcagctgatattgacaacaacggtacaattgactacggtgaattcatggcagctacgttgcacatgaataagctggagagggaggaaaacttggtttcagcattctcattttttgacaaagatggaagtggctttataaccattgatgagctgtcacaagcatgccgtgaatttggtcttgatgatgttcaccttgaggatatgattaaagatattgaccagaacaatgatggacaaattgactacagcgagttcacggcaatgatgaggaagggcaatgctggtgcaacaggaaggagaaccatgaggaacagcttgcacttgaatcttggcgagctcttgaaccccagcaaaacctagcttatgcaggaaggccttgccgggtacattcgtctgaagttttggcgcgtcatcgacttgctatcaactggtctagtatgagatgttgagtggctgtcctgtggtattattgaggtgctggaggattttcgtagtactggtggtatcagctagagaagagagatggtacaatgtggttactgcttatatgtattactgttgatgtagattgaacatagtctaaaatcttccct

SEQ ID NO: 19900 - protein, 119 aa, Panicum virgatum
  misc_feature: Ceres CLONE 1807514-R
  misc_feature (64)..(92): Pfam Name: efhand Pfam Description: EF hand
  misc_feature (30)..(58): Pfam Name: efhand Pfam Description: EF hand
  misc_feature: SWISSPROT Homolog: EC 2.7.11.1 Non-specific serine/threonine protein kinase
AADIDNNGTIDYGEFMAATLHMNKLEREENLVSAFSFFDKDGSGFITIDELSQACREFGLDDVHLEDMIKDIDQNNDGQIDYSEFTAMMRKGNAGATGRRTMRNSLHLNLGELLNPSKT

SEQ ID NO: 19901 - DNA, 673 bp, Panicum virgatum
  misc_feature: Ceres CLONE 1807523
  misc_feature: Encodes the peptide sequence at SEQ ID NO. 19902
ccgtcctctctcgtccctgtgctcctgtccatccaacgtcctccattcctcctgtgtgatcggcggcggcggcgcaccgccggcggtttctcgatcggttcagttccagggcatgtgctttttctggtaaagcgtgctgccccgtgcgtgccttgggccggagcaaggaatatttccgagttcttcagcacgggaaggtatcttcgaactagatgcatcacaaagttcctgcgtgaggatctttgcgcggcaaaccgcgagatttcttgggcggagatggaaaagggagggttcaagatgttcaacttagtctcatcctggaacaagaggaggagaagcagatcacttgatcagctgaatccatgggtgtacaagtcggccgagctgtggcaggccaaggagcagagcccgccgccgaagaagcgcagctgcacgatggtgttcacgctcaaggagatggaggaggccaccaacatgttcagcgaccggaacctcatcggcaagggcggcttcggccgggtttacagaggcgtgctcaaggatggccagatcgtcgccatcaagaagatggacctgcccacctccaagcacgccgacggcgagcgcgagttccgggtggagatcgacatcctgagcaggctagagcaccccaacctggtgacgctgatcggct

SEQ ID NO: 19902 - protein, 132 aa, Panicum virgatum
  misc_feature: Ceres CLONE 1807523
  misc_feature: SWISSPROT Homolog: EC 2.7.11.1 Non-specific serine/threonine protein kinase
MEKGGFKMFNLVSSWNKRRRSRSLDQLNPWVYKSAELWQAKEQSPPPKKRSCTMVFTLKEMEEATNMFSDRNLIGKGGFGRVYRGVLKDGQIVAIKKMDLPTSKHADGEREFRVEIDILSRLEHPNLVTLIG

SEQ ID NO: 19903 - DNA, 674 bp, Panicum virgatum
  misc_feature: Ceres CLONE 1807523-R
  misc_feature: Encodes the peptide sequence at SEQ ID NO. 19904
gtgtacgcgttcggcgtggtgctgctggagctgctgacggggcggcgcgccatcgacctgagccaggggccgcaggagcagaacctcatcgtggggatccaccaggcggtgggcgactggcggaagctgcgcagggtggtggaccgggacatggccagggggtcctacacggtggagtcggtgtccatgttcgccgggctcgccgcgcgctgcgtctccttcgacggcgccgcccggccgtccatgccggactgcgtcaaggagctccagttcatcatgtacgccaacatgaagatctgatcgcgctcgccgcctcgctcgggtgtctggagtcgcgcatgggttttgggacggggcgcggccgccggatgggttgcaactgcaggtctgcagcttttctttggtcgatgaaatcagaatcggagaggattggtctcatgatcgggatacttgtacagggttatagtaatttctcattgcgataggaatgcatttcggtctgcataagggcaatgctattttttccaaaaagagaaaaagatgtttggggccgcaaattcttatacgagagattgaagagagatctcgcatgtctgtcatgttgtcgtgtgcaagcctgcaaggacttcattgtgttgtattctctctgctcttaattatggatcgttttggcg

SEQ ID NO: 19904 - protein, 99 aa, Panicum virgatum
  misc_feature: Ceres CLONE 1807523-R
  misc_feature: SWISSPROT Homolog: EC 2.7.11.1 Non-specific serine/threonine protein kinase
VYAFGVVLLELLTGRRAIDLSQGPQEQNLIVGIHQAVGDWRKLRRVVDRDMARGSYTVESVSMFAGLAARCVSFDGAARPSMPDCVKELQFIMYANMKI

SEQ ID NO: 19905 - DNA, 1429 bp, Panicum virgatum
  misc_feature: Ceres CLONE 1807547
  misc_feature: Encodes the peptide sequence at SEQ ID NO. 19906
aaaaacttctttcaaaccctcttcgtagtttgcctccaaagaaacaattagcgcccctcctcgcggcagcacgatgctcaccacagcacacagccggcagcatcatcatgccttcgagaagagccctagcagccacgtgaagaacctcgacaggaagctgcagcaggccatgaacaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgctgctgtatggcggcaccttcagcccctggggcgatgtgctggtgtctctggagatgaggagagaggacgacgacaaggccagtgaccacgacgttgaagggggtgaggacgacttcgattgcagcgagccggggagcttgcataggtgcagctggatcaccaagaacagtgatgaggcgtacgttcagttccacgacgagtgctggggcgtccccgtgtacagcgacaaccgcctcttcgagcttctgtcgctgtccgggatgctcatagaccacaactggacggagatactcaagaggcgagacatgtacaggtgattctcagaacactcctgctcccagtttgcagtgtctctgttcatgtcagttttcatcacaacggccatggctggctgcatcagggaggtgttcgccgacttcgaccccagcactgtggcgaagatggacgaggacgccatcgccgagatcagcggcaacaaggagctcaagctggccgaggccagggtccgttgcatcgtcgagaacgccaagtgcatccagaaggtggccaaggaattcgggtcgttcagcgggtacatgtgggggcacgtgaaccaccggccggtggtgggcaagtaccggcaccacaagtacatcccgttccggacgcccaagtcggaggcggtgagcaaggacctcgtccgccggggcttccgcctcgtcggccccgtcatcgtctactccttcatgcaggccgccggcatggccatcgaccacctcgtcgactgcttccgcttcccggagtgcgtccgcctcgccgagcggtcctggggcatcaccaacatcgccgcgtagccaccggccggccggtcggcggcggcgtgctcgctcgctcgctcggcgctccaatttttttttacaccttcttctggtgtcattttcttgaagtgtgtgtgaaatgtagagtagtaaatgctaagttatgatgtaataattttattttctctttaaacttgaaaagttctccagtagtagtactgaaataggggctgcaacaggcttgtgtaacaataaggtttttttctaagatttttttaccaaatattaattcaggttgttgagctt

SEQ ID NO: 19906 - protein, 149 aa, Panicum virgatum
  misc_feature: Ceres CLONE 1807547
  misc_feature (1)..(133): Pfam Name: Adenine_glyco Pfam Description: Methyladenine glycosylase
  misc_feature: SWISSPROT Homolog: EC 3.2.2.20 DNA-3-methyladenine glycosylase I
MAGCIREVFADFDPSTVAKMDEDAIAEISGNKELKLAEARVRCIVENAKCIQKVAKEFGSFSGYMWGHVNHRPVVGKYRHHKYIPFRTPKSEAVSKDLVRRGFRLVGPVIVYSFMQAAGMAIDHLVDCFRFPECVRLAERSWGITNIAA

SEQ ID NO: 19907 - DNA, 3028 bp, Panicum virgatum
  misc_feature: Ceres CLONE 1807549
  misc_feature: Encodes the peptide sequence at SEQ ID NO. 19908
aatacgactccccctccgccgccgccgtctccgtctccgtctccgtctccgccgccggccgccatcccactgccttctcctccgtcctccgtttcctgactcagccgccgccctaagtttggctttttggcaaggcgcgacctccctccctccgtttgctgactcgcctacactacaaattggatttctgagttgttggatgcaacagaggcgctctccaaggcaagcgtaacatgtgcccaaccatctattcattaactcaagacctgcctcggatcaatcccgccactttcgtctacctcttcgagtccggctgatgggaggtgcccgtcagcaaccgggcgtggacggaccttccctcagagatgccagactgcttgggaacggcgccgtgggtgtggctggaggctatgggctccagcagggggaggacgacttgaggagcagtgacccggatgtcctgctcagcgggccaacagctggtccgcagcagggtgacatggaaaaccaccagcaggtctgctgggagcgcatcctccagaagaagactatcaaagtcttgctcgtggagagtgacgattcaactaggcaggtggtcagtgccctgctacgtcgctgcatgtatgaagttatcccagccaaaaacggccagcaagcatggagttatcttgaagatatgcaaaacagcatagatcttgttttggctgaggtttttatgcctggtgtatctggaatatctctgctgagtaggatcatgagccacaatatttgcaagaatgttccaatgattatgatgtcttcgaatgatgccatgggtactgtctttaaatgtttgtcaaaaggcgctgttgactttttagtcaagcctatacgtaagaatgaacttaagaacctttggcagcatgtatggagatggtgccacagttccagtggtagtggaagcgaaagtggcattcagacacagaagtgtgccaaatcaaaaagcggtgatgaatccgataacaacagtggtagcaatgacgacgatgacgatgatgatgcaagcatggggcttaatgcaagggatggcagtgatactggcagtggcactcaagtgcagagctcgtggactaagcgtgctgtggagatcgaaagtccacaggctatgtctccagatcagttagctgatccacctgatagcacttgtgcacaagtgatccaccaaaaatcggagatatgtagcaacagatggctaccaggtacaaacagcaggaacttcaagaagcaaaaagacactaatgatgtggggaaggacttggagataggtgcccctagatatttaaatatggattgtcaatcttccccaaatgagggacccatcaaaccagcagatggacgttgtgagtacccaccagaaaacaattcaaatgagtcaatgatggaaaatttagaggagccaactgttcgagctgctgatctaattggttcgatggccaaaaacatggatgcccaccaggcagcaagagctgcagatgcccctaattgctcttccaaagtaccagaagggaaagatatgaaccgtgataatgttttgccattacttgagttgagtttgaagaggtcaagatcatctgcaggttgtgccaatacagtccaagatgaacagcggaatatattaagacgatcagatccctcagcattcacaaggtaccatacatctgtggcttccaatcaaggcgggacaggatttgtcgggagctgttcgccgcatgataacagctccgaggctacgaaaacggactctacttacaacatgaagtcaaattcagatgctgctctgttaaaacaaggctccaatggcagtagcaataacaatgacatgggttccactacaaagaatgttgtgacaaagcctactgcaaataaggagagagtgatgtcacccacagctattaaggctaatgcacacacatcagcgtttcatcctgtgcatcactggacggctccagctaatgcagcaggaaaagcaaaggctgatgaaatggcaaacaatgcaactaagaatggtcaccctggtgaagtgcagagcaacctcgtgcaacaccctcggccaatcctttatgtccattttgatgtgtcacgggagaatggtgggtcaggagctccgcaatgtggttcctccaatgtatttgatcctccacttgaaggtcaagctgccaactatggtgtgaatgggagcaactcaggcagtaacaatggaaccaatgggcagaatggaagcactgctggtgcaagtacggctgctgcaaatgatgaaaggacaaacaaggagattgctaatggtgccattgaaaaaactggacctgaatgtggcaatgggagtggaagtggcagcggcaatgacacatatgtgaaacgcttcgccccagccattacaccacgagaagcacgactgatgaaatatcgggagaaaaagaaagatcgaaactttgggaaaaaggtgcggtaccagagcagaaagaggttggccgatcagcggccacgggtccgtggacagttcgtgaagcaagctgtgcaagatcagggcagacgtaaggagctggagatagattgaccccccccccccctggtgtggctcccgcttctggcatggctgcattggactccaaacacttgacaattacacagttgattcttccatcgctgttgatctgatatggtcgacaacaccccatccttcatttccatcattggtttttccacactcagagtctactaccttaccctagaaagaataaacaacgaactcctatcaatcaatccccgtaagcatgtagaggagcaagtgcatgtcttgactccagatgggctgtaattcgacgtgcggagtcatgctcgctcctatgtaactaagcttgtacaagtgtactcgtaatgtctgaacgccactactgttgtgtgttgtcatggtttggtcttggatcaattgtcaatagaatgcactgcgcagcagttggcttgctgctggtacggtgcgccagtttcagtc

SEQ ID NO: 19908 - protein, 758 aa, Panicum virgatum
  misc_feature: Ceres CLONE 1807549
  misc_feature (702)..(746): Pfam Name: CCT Pfam Description: CCT motif
  misc_feature (79)..(195): Pfam Name: Response_reg Pfam Description: Response regulator receiver domain
  misc_feature: SWISSPROT Homolog: EC 3.1.4.17 3',5'-cyclic-nucleotide phosphodiesterase
MGGARQQPGVDGPSLRDARLLGNGAVGVAGGYGLQQGEDDLRSSDPDVLLSGPTAGPQQGDMENHQQVCWERILQKKTIKVLLVESDDSTRQVVSALLRRCMYEVIPAKNGQQAWSYLEDMQNSIDLVLAEVFMPGVSGISLLSRIMSHNICKNVPMIMMSSNDAMGTVFKCLSKGAVDFLVKPIRKNELKNLWQHVWRWCHSSSGSGSESGIQTQKCAKSKSGDESDNNSGSNDDDDDDDASMGLNARDGSDTGSGTQVQSSWTKRAVEIESPQAMSPDQLADPPDSTCAQVIHQKSEICSNRWLPGTNSRNFKKQKDTNDVGKDLEIGAPRYLNMDCQSSPNEGPIKPADGRCEYPPENNSNESMMENLEEPTVRAADLIGSMAKNMDAHQAARAADAPNCSSKVPEGKDMNRDNVLPLLELSLKRSRSSAGCANTVQDEQRNILRRSDPSAFTRYHTSVASNQGGTGFVGSCSPHDNSSEATKTDSTYNMKSNSDAALLKQGSNGSSNNNDMGSTTKNVVTKPTANKERVMSPTAIKANAHTSAFHPVHHWTAPANAAGKAKADEMANNATKNGHPGEVQSNLVQHPRPILYVHFDVSRENGGSGAPQCGSSNVFDPPLEGQAANYGVNGSNSGSNNGTNGQNGSTAGASTAAANDERTNKEIANGAIEKTGPECGNGSGSGSGNDTYVKRFAPAITPREARLMKYREKKKDRNFGKKVRYQSRKRLADQRPRVRGQFVKQAVQDQGRRKELEID

SEQ ID NO: 19909 - DNA, 2066 bp, Panicum virgatum
  misc_feature: Ceres CLONE 1807562
  misc_feature: Encodes the peptide sequence at SEQ ID NO. 19910
acggcacacccgcgcgagcactcagcacacgagcctggagcgcagctcagacgcgcacgcgcgagatttagaacagagcaacgagggagagccaggagccagcagcagcagccgcagcagcaggtggaactgtggaaggaactgctcttcgtcatgggcgcggacgcagccgcgctgcccgtcgctctggcgagctccctgcagccgcaggtggtggccgccgtcttgttcgcctcggccgcgtgcacggtggccctggccgtcctcctggcctcgctgcggctgcggccgccgtggtggtgcgcgtgcgcggtgtgcgaggcctacgtgacggcgtcgtgggcgggggagttcgacaacctctgcgactggtacgcgcacctcctgcgccgcgccccggggcggaccgtgcacgtgcacgtgctcggcaacgtgctcaccgccaacccggccaccgtcgaccacatgctgcgcggccgcttcgacaactaccccaagggcgcccccttctcctccatcctcgccgacttcctcggccgcgggatattcaacgtcgacggcgactcgtggctcttccagcgcaagctcgccgcggccgagctcgcggccccggccctgcgctacttcgcggcgggcgtcgtggcctccgagctgcggtgccgcctcatccctctgctccactccgcatccagcggcggcggcggcggcgacggcggcgagaagctgcttgacctccaggacgtgttccgtcgctttgccttcgactgcatatgcaggatctctttcggactcgaccccggctgcctcgagctctcgctgcccatgtcggccttcgcgaacgccttcgacacggcctctatgctctctgcgcgccgcgcgacggcgcccgtgcacgtgttctggaagctgaagcggctactcaacatcggggaggagcgggagctccgcgactcgatccgcctcgtcgacacgctcgcggcggaggtcatccggcagcgccggaagctcgccgccgccgcctcgggcgacgacctcctgtcgcgcttcatgggctctatcaacgacgacaagtacctccgcgacatcgtcgtgagcttcatgctcgccggccgcgacaccgtcgcctcgggtctcaccgccttcttcttgctgctgtccgaccaccccgacgtggccaccgcgatccgggacgaggtcgcccgcgtcgccggaggcagagacggccacaccgcggtcgccgcctccgagaagctcaaggacatgcactacgtgcacgcggcgctgtacgagtgcatgcggctgttcccgccggtgcagttcgactccaagttcgccgccggcgacgacacgctcccggacggcacgttcgtcgccaggggcatccgggtaacctaccacgcctacgccatgggccgcatggagtccgtctggggccccgattgcgccgagttccgtccggagcgctggctccgcgacggccggttcgtgccggagagcccctaccggtacccggtctttcagggcggcgtgcgtgtctgcgtcggcaaggaactcgccatcatggagatgaagtccgtcgtcgtctccgtcgtgcagagcttcgacatcgaggcggtcggccgtagctcccgccggcccaagttcgcaccaggccttaccgccacattcgctgggggcgtgccggtgagagtgcaccggcgagctcgtgccagcgcgctccgaccaccaagctagcgacaccacacggcacgcgcgaatcgctggccgtactcttctgctttgaaacagggcattagattacattcttgacgccgtgatctatgtgttattcgcgacgaccccgctgcctggcgagtgcgctgggttcttgcctccactggagcccggagattcccccggtaggtcatgacacagcggattagtctaataatctgatgcccgacggcacttgttctcgcacatgggaaaaaggggccgcttaaaagtcgactctgcatgtcagcatttccaacttcaaagcagaactgttgaaaagaaaaattgcagattcaaagttgcagaatgcg

SEQ ID NO: 19910 - protein, 526 aa, Panicum virgatum
  misc_feature: Ceres CLONE 1807562
  misc_feature (42)..(511): Pfam Name: p450 Pfam Description: Cytochrome P450
  misc_feature: SWISSPROT Homolog: EC 1.14.15.3 Alkane 1-monooxygenase
MGADAAALPVALASSLQPQVVAAVLFASAACTVALAVLLASLRLRPPWWCACAVCEAYVTASWAGEFDNLCDWYAHLLRRAPGRTVHVHVLGNVLTANPATVDHMLRGRFDNYPKGAPFSSILADFLGRGIFNVDGDSWLFQRKLAAAELAAPALRYFAAGVVASELRCRLIPLLHSASSGGGGGDGGEKLLDLQDVFRRFAFDCICRISFGLDPGCLELSLPMSAFANAFDTASMLSARRATAPVHVFWKLKRLLNIGEERELRDSIRLVDTLAAEVIRQRRKLAAAASGDDLLSRFMGSINDDKYLRDIVVSFMLAGRDTVASGLTAFFLLLSDHPDVATAIRDEVARVAGGRDGHTAVAASEKLKDMHYVHAALYECMRLFPPVQFDSKFAAGDDTLPDGTFVARGIRVTYHAYAMGRMESVWGPDCAEFRPERWLRDGRFVPESPYRYPVFQGGVRVCVGKELAIMEMKSVVVSVVQSFDIEAVGRSSRRPKFAPGLTATFAGGVPVRVHRRARASALRPPS

SEQ ID NO: 19911 - DNA, 1090 bp, Panicum virgatum
  misc_feature: Ceres CLONE 1807565
  misc_feature: Encodes the peptide sequence at SEQ ID NO. 19912
gccgctgctcacggctctaccaaccaagcatccccagcctccaaaggggagacaagcggcgagacgcttcttccccgcagcaggcccgcgcacggtctcgtgaaggtgaatcgcctgggagttacctgcgccgccgcaaaggtttttactccctcgcggtcgcggaaccgcacgcgcgctgcgacagccaccaaagcagagtattcctctgtttctccagccgccatggcgtcgtgccgggacggggcgccgccccatggggacgaggcccgcgccctgctcccccccttgctcgctaaggagggggaggtccgcatcacggtgcccgccgacgaggtgccggtgctcacgagcaagccgcccgggcggctcgcggccgccgcgaaggaagccgtgtccctgtccctgggcttcgcgttccccacgacgccgtcggtgtcgtccagcgacgcgcgcggcgaggcgcggtctattctcgccctcgccctcccgatgatcctgaccgggctcctgctctacctccggtcgatgatttcgatgcttttcctcggtcgcctcggcggcctggcacttgctggcgggtctctcgccatcggctttgccaacatcaccgggtactctgtcctctccggcctcgccatgggcatggagccaatatgcggccaggcattcggcgcgggcaacttctcgctcctgggcaccaccatgcagcggacggtgctcctgctcgccgcggccgccgttcccatcggtggcctgtggatgcacatgcggcctatcctcctcctgtgcggccaggaagccagcatcgccgcggccgccgagacctacattctggcctcgctcccggacctcgctctgcaggcattcatccaccccgtgcggatatacctgaggacgcagtccatcaacctgccgctcacggtctgcgcggcgctcgccattgccatccacctccccatcaactatgtcctcgtcaccgtcctgggcctcggcatcaagggggtggcattcgcctccgtgctggcaaacctgaacctcctcctctttctcctcgcgtayatcctcttcaaaggcgtacacaaccgca

SEQ ID NO: 19912 - protein, 288 aa, Panicum virgatum
  misc_feature: Ceres CLONE 1807565
  misc_feature (89)..(249): Pfam Name: MatE Pfam Description: MatE
  misc_feature: Functional homolog of the protein sequence given in SEQ ID NO 50321
  misc_feature: Useful for biocontainment applications
  misc_feature: Useful for making plants with modulated biomass
MASCRDGAPPHGDEARALLPPLLAKEGEVRITVPADEVPVLTSKPPGRLAAAAKEAVSLSLGFAFPTTPSVSSSDARGEARSILALALPMILTGLLLYLRSMISMLFLGRLGGLALAGGSLAIGFANITGYSVLSGLAMGMEPICGQAFGAGNFSLLGTTMQRTVLLLAAAAVPIGGLWMHMRPILLLCGQEASIAAAAETYILASLPDLALQAFIHPVRIYLRTQSINLPLTVCAALAIAIHLPINYVLVTVLGLGIKGVAFASVLANLNLLLFLLAYILFKGVHNR

SEQ ID NO: 19913 - DNA, 759 bp, Panicum virgatum
  misc_feature: Ceres CLONE 1807565-R
  misc_feature: Encodes the peptide sequence at SEQ ID NO. 19914
gggcagcccgaggaggccagccgcgccgccacggtggggctcatgctcgggttcgcgttcggcggcttcgcctccgcgttcgcgttcctggtgcggaacgtgtgggcgagcatgttcacggccgacccggcgatcatcgcgctcaccgcgtcggtgctgccgatcctgggcctgtgcgagctcggcaactgcccgcagacgacgggctgcggcgtgctccgcggcagcgccaggcccaaggacgccgccagcatcaacctccggtccttctacatcgtgggcacgccggtggcgctcctcctggcgttctggttccagtacggcttcaagggcctgtggttgggcctcctggcggcgcaggccacctgcatggtgcgcatgatgctggtcatcggccggacggactgggccagcgaggccaagcgctcgaggttgctcaccggcgctgacgccaaggctgccgcggccggcggggacgagaaggcgcgctgcttgctcctggacacggacatggagcgggcgaatgatcactcggatcggtgttgatagctacagcgccggccgcatacccgcatgtgtgctccctctaatatactcttttccccccttttctgtttcccccattttctcccaatattttggcgggggagggatcagaggctgacagactgccaattttgttcaccatttgctaatgagcatgtaaagatttttccgattgtcatattaaagagattgaaaatactccagtactgtatg

SEQ ID NO: 19914 - protein, 181 aa, Panicum virgatum
  misc_feature: Ceres CLONE 1807565-R
  misc_feature: Functional homolog of the protein sequence given in SEQ ID NO 50321
  misc_feature: Useful for biocontainment applications
  misc_feature: Useful for making plants with modulated biomass
GQPEEASRAATVGLMLGFAFGGFASAFAFLVRNVWASMFTADPAIIALTASVLPILGLCELGNCPQTTGCGVLRGSARPKDAASINLRSFYIVGTPVALLLAFWFQYGFKGLWLGLLAAQATCMVRMMLVIGRTDWASEAKRSRLLTGADAKAAAAGGDEKARCLLLDTDMERANDHSDRC

SEQ ID NO: 19915 - DNA, 3519 bp, Panicum virgatum
  misc_feature: Ceres CLONE 1807591
  misc_feature: Encodes the peptide sequence at SEQ ID NO. 19916
aatttgaagcagcttcagaagcaatctatattgaactggtcgaccatgtggaggctaaaggtctcagagggaggaggggcatggctgcagacggtgagcaactttcatgggcggcaggtgtgggagttcgaccccgacgccggcacggaccaggagcgcgccaaggtggagcagcttcgccgggagttctgggagaaccgcttccgaaggagggaatcgcaggacctcctcatgcgcatccagttcacgggactatatcatctgcgggcggatatgcccgcggccgcgaaactggaagacggtgacgaggtaacggaagaaattctgaaggagtcgctcacacgagcgctcggttggatgtcagacctccaagctgaagatggccactggccaggtgatttaagtgggatcatgtacctgctgcctttctggattttcgcgctgcacatcacaggatcaatcgatgatgtactatccaaagagcacattcgtgagatatgccgccatatctacaaccatcagaacgaggacggcggctggggcttcaacgttttggacgagagtgccatgtttggcacatgcttaaactacgtcacattgaggctgctcggacaagtgcaaaaggatgagaatgatggactagcaaaaggtcgcgcatggatcttgtcccatggcactgcaactgcagcgccacaatgggcaaagatattactctcggtccttggtgtatatgattggtccggaaatcgcccagtgatccctgaactttggttggtcccacggtttctcccaattcatccaggacgattctggtgcttcacaagggttacctacatgtcaatagctttcctatatgctaagagagttgttggtccagttacaccgatcatcttagcattgaggaacgaactctacagttccccttatggtgagattgattgggatgaggctcgtagttcttgtgccaaggtttgtcattatccttcctgttttcaggaacattcttgccactctatttaacatctatgtaaaatatgcagtagatacaaaacctttttttgtatatacttttagtatcatgcgtcaaataatgtgtaaacattttgagcactcagatcagaacaaaatacagaaacaatagtggattaatgttcaatggcaggatagaatttaatgtcgaaattagatcgagaggtaagaacagaaaaaaaatatattctgaccaaagagtagatatcgcaatgtagagaaacaatacagatacacattttttatacctcctagcaccatttgataatgtgtgatgtataatttattattagctccaatccgacagtttttagcatcaatgttatagaaccagggcacaatgaaagcaactgacttactgaaagttgtcatgtctgtttaaattagcatacatatacatcaatattgaataagtttataacttgcaggatactgaaatcttcatttattcatctcatgaacattcatgaccacattgatatcaaatttcgagggaagtttaacttgatttaaccaaaaaatcaggtctgagtttacacgttagtgacgtgttcagcccatgcacggttctagtgatagaatatactttttggcccatgtcagcccacctattttttttatagaagttttttatttagtccagatctatttttatttcactttgatgagaagtcgaacctaggccagttgaatgctattcaagtgatttaaccactacgccaaaggtcctttcgcagtgacagaatattttcatcggtgacatatgtttttattgaggcgcatcattattagtatttcccccaattggtatattttgttggaggtggagacataggtgacgcgttgtaattttgtccatctctaatctcaatcagagacgtgttttcaggtcactaatttgggtgtttcctatgtgcatttttttacgtgatgaaagatgcatggatgcaatagtcgctcgcgttttcattacattaattctttgttcaactgtctgactatggagcactccgttgagatataaaacaacagtattacttttagtctatggtttgtattttgatataggaggacatgcgctaccgtccctcagcagtgtacaaagctatttcaaattgtttgcacacgtttgtggagccagtcttgaacagttggccgatgaacaagctaagagagagagctttgagtcacatattgcaacatatccattacgaagatgaaactactcaatacgttggcttatgtcctgttacaaagatatatgatgggacccagaactgggatatagcacttatagttcaggccttcttatcaacagagcttatagatgaatgtgggccaacaattgataaggccctcagatatattaagaaagcacaagtgactcaaaatcctcctggcaacccaaagtattggtttcggcatagatcaaaaggttcgtggacactttcaactgtagataacagctgggcttcaactgacgtttctgctgaagtaattaaggctgtattgttgctatccaagctgtcccctaaccttgttgggaacgtaacagaagaatggatatatgatgctattgattgccttcttaccttcaagaataaagacggttcattctctacacttgagtgccaaagaacttattcctggctagagattttgaatccattggagagtttccggaatcttatcgtcgatcacccgacagttgaatgtacttcgtcaatagtgcaggctctggtaatgtttggggagagttatccaagataccgcagtgaacagataagagaatgtgtcaacaaagctgctatatatattgagaataatcaaaagaatgacggatcctggtttgcaaaaagatatcatctcttttctgtacaaaatgttgtcttcatacaaaatgttgtcttttattctgcaactaataattacatcgattctaggtatggcacatggggcatatgtttcatctatgggacactctttgcaataaaaggcttagtggctgctggaagaacttatgagaacagtgtttgcatcaggaaagcatgcaactttctgctgtcaacacagctgaaaacagggggctggggggaaagctatctttcttgtgaacgcgacgtctatgtagagggtaatcataccaatgctgtgagcaccgcttgggcaatgctaggattgatttctgctcggcagatggaacgtgatcaaacaccattacatcgtgccgcgaaggtattaattaatatgcagttggagactggtgattatcctcaacaagaacatatgggaaacaccaattcttctgtctacttcaactatccaaactaccgcaatttgtatcctatttgggctcttggagagtaccgtcgggggctgcgagcaaagaagaattgaaatattagactaatgtaatgcaaatatatgtcagacacaacaaatgggtgcgccatgctggagcaaaaacaataaaatggatatttaatgagt

SEQ ID NO: 19916 - protein, 324 aa, Panicum virgatum
  misc_feature: Ceres CLONE 1807591
  misc_feature (146)..(189): Pfam Name: Prenyltrans Pfam Description: Prenyltransferase and squalene oxidase repeat
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
MWRLKVSEGGGAWLQTVSNFHGRQVWEFDPDAGTDQERAKVEQLRREFWENRFRRRESQDLLMRIQFTGLYHLRADMPAAAKLEDGDEVTEEILKESLTRALGWMSDLQAEDGHWPGDLSGIMYLLPFWIFALHITGSIDDVLSKEHIREICRHIYNHQNEDGGWGFNVLDESAMFGTCLNYVTLRLLGQVQKDENDGLAKGRAWILSHGTATAAPQWAKILLSVLGVYDWSGNRPVIPELWLVPRFLPIHPGRFWCFTRVTYMSIAFLYAKRVVGPVTPIILALRNELYSSPYGEIDWDEARSSCAKVCHYPSCFQEHSCHSI

SEQ ID NO: 19917 - DNA, 3008 bp, Panicum virgatum
  misc_feature: Ceres CLONE 1807592
  misc_feature: Encodes the peptide sequence at SEQ ID NO. 19918
acacgcgcaccgtcgccactgcaaaacaaaaggccaccgggtagaggagaggacgaggagtagagagttgggggcggcgaagatgctgagcgggatcatcgacgggctgacgggggcgaacaagaatgcgcggctcaagggcacggtggtgctcatgcgcaagaacgtgctcgacctcaacgacttcggcgccaccgtcatcgacggcatcagcgagttcctcggcaagggggtcacctgccagctcatcagctccaccctcgtcgaccccaacaacggcaaccgcggcaaggtgggcgccgaggcgaacctggagcagtggctgacggcgagcctgccgtcgctgacgaccggcgagtccaagttcggcgtgaccttcgactgggaggtggagaagctgggcgtgccgggcgccttcatcgtcaagaacaaccacgccgccgagttcttcctcaagaccatcaccctcgacgacgtgccggggcgcggcacggtgactttcgtcgccaactcctgggtctaccccgtcgccaagtaccgctacaaccgcgtcttcttctccaacgatacgtacctgccgagccagatgccggcggcgctcaagccctaccgcgacgacgagctccgcaacctccgcggcgacgaccagcagggcccctacgaggagcacgaccgcgtctaccgctacgacgtctacaacgacctcggcgagcccgaccgcggcaacccgcgccccgtcctcggcggctccgccgaccacccctacccgcgccgctgccgcaccggccgcaagcccaccagcaccgaccccaactcggagagccggctgtcgctggtggagcagatctacgtgccgcgcgacgagcgcttcggccacctcaagatgtcggacttcctggggtactcgatcaaggccatctcgcaggggatcgtgccggcggtgcgcacgtacgtggacaccacccctggcgagttcgactccttccaggacatcctcaacctctacgagggcggcatcaagctgcccaggatccaggcgctcgaggacatgcgcaggctcttcccgttccagctcgtcaaggacctcctccccgccggcggcgactacctcctcaagctccccatcccgcagatcatcaaagaggacaagaatgcgtggaggaccgacgaggagttcgcgcgggaggtgctcgccggcgtcaacccgatgatgatcacgcgcctcacggagttcccgcccaagagcgcgctcgatcccagcaagtacggcgaccagacgagcaccatcacggcggagcacatcgagaagggcctggagggcctcacggtgcagcaggcgctggacggcaaccggctcttcatcctggaccaccacgaccggttcatgccgttcctgatcgacgtcaacaacctggagggcaacttcatctacgccagccggacgctcttcttcctgcgcggcgacggcaggctggcgccgctcgccatcgagctcagcgagccgtacattgacggcgccctgaccaaggccaagagcaaggtctacacgccggcgtccagcggcgtcgacgcctgggtgtggcagctcgccaaggcctacgtcgccgtcaacgactccggctggcaccagctcatcagccactggtacgaactcatcatagtctccttagatgcgcacgtgtgaatttatatacgatgagatgagactatcctgaacttaatcgatggatcgacggatcccaggctgaacacgcacgcggtgatggagccgttcgtgatcgcgacgaaccggcagctgagcgtgacgcacccggtgcacaagctcctgcacccgcactaccgcgacacgatgaccatcaacgcgctggcgcggcagacgctcatcaacggcggcggcatcttcgagatgaccgtgttcccgggcaagtacgcgctggccatgtcctccgcggtgtacaggggctggaacttcaccgagcagggcctccccgccgacctcgtcaagcggggcgtggcggtggcggacccgtcgagccccaccaaggtgcggctgctgatcgaggactacccgtacgcgagcgacgggctggccgtctggcacgccatcgagcagtgggtgggcgagtacctggccatctactaccccgacgacgccacgctgcagggcgacgaggagctgcaggcgtggtggaaggaggtgcgcgaggtcgggcacggcgacctcaaggacgcgccctggtggccccggatgcgggccgtgccggagctcgccggcgcctgcaccaccatcatctggatcgcgtcggcgctgcacgcggccgtcaacttcgggcagtacccgtacgcggggtacctgccgaaccggccgacggtgagccggcggcggatgccggagcccggcaccgaggcgtacgcggagctggagcgcgacccggagctgggcttcatccgcaccatcacgagccagatccagaccatcatcggcatctcgctcatcgaggtgctctccaagcactcctccgacgaggtgtacctgggccagcgcgacaccccggcgtggacctccgacgcccgggcgctcgcggcgttccagcggttcagcgacgcgctggtggagatcgagggcaaggtggcgggcgccaaccgcgacccgcagctcaagaaccggaccgggcccgccgcgttcccctacacgctgctgtaccccaacacctccgaccgcacgggcgccgccgccgggatcaccgccaagggcatccccaacagcatctccatctgagcaccggcgtgcctgcagtctgctactagccgttgagcgttctcgaggccatgagagcgaggttggtgcttgaacaaggcacgccgctttcgtgtgtgactgtgtgtgacagtgtgagcgtcgtcgtgtcaatgccgcatgagagcttgtagagagatcggttaataatagtttttgtgtcggccggtaaatggaaaataacacgtaataaacgaagtgaatgttgcat

SEQ ID NO: 19918 - protein, 533 aa, Panicum virgatum
  misc_feature: Ceres CLONE 1807592
  misc_feature (170)..(532): Pfam Name: Lipoxygenase Pfam Description: Lipoxygenase
  misc_feature (51)..(158): Pfam Name: PLAT Pfam Description: PLAT/LH2 domain
  misc_feature: SWISSPROT Homolog: EC 1.13.11.12 Lipoxygenase
  misc_feature: Functional homolog of the protein sequence given in SEQ ID NO 50887
  misc_feature: Useful for making plants with altered lignin content
MLSGIIDGLTGANKNARLKGTVVLMRKNVLDLNDFGATVIDGISEFLGKGVTCQLISSTLVDPNNGNRGKVGAEANLEQWLTASLPSLTTGESKFGVTFDWEVEKLGVPGAFIVKNNHAAEFFLKTITLDDVPGRGTVTFVANSWVYPVAKYRYNRVFFSNDTYLPSQMPAALKPYRDDELRNLRGDDQQGPYEEHDRVYRYDVYNDLGEPDRGNPRPVLGGSADHPYPRRCRTGRKPTSTDPNSESRLSLVEQIYVPRDERFGHLKMSDFLGYSIKAISQGIVPAVRTYVDTTPGEFDSFQDILNLYEGGIKLPRIQALEDMRRLFPFQLVKDLLPAGGDYLLKLPIPQIIKEDKNAWRTDEEFAREVLAGVNPMMITRLTEFPPKSALDPSKYGDQTSTITAEHIEKGLEGLTVQQALDGNRLFILDHHDRFMPFLIDVNNLEGNFIYASRTLFFLRGDGRLAPLAIELSEPYIDGALTKAKSKVYTPASSGVDAWVWQLAKAYVAVNDSGWHQLISHWYELIIVSLDAHV

SEQ ID NO: 19919 - DNA, 2075 bp, Panicum virgatum
  misc_feature: Ceres CLONE 1807605
  misc_feature: Encodes the peptide sequence at SEQ ID NO. 19920
cttgcgagccgcgctagagcagcagctgctcctcggtggtgtggtgcccgcggcctccctcctcggctcctcccttgcggcagggcagatcccgaggcggctcgcatttccaggccagcgcgctgcccccgccattcccaaggtcgagcgaggtcaactcgctcgaatccaccacccccactcactcccgcgcccgccttaaacgccgccgcgtcgcgtcgtccaccacgacgcagtcgcagccgcagccggagccgccgccgccgccgccgccgcagcagcagatccaccaccgacgcgtacgcgcacgcaggcgcggagccctggatcccgcggagcaggaggcggtcaagccgtcgcccacgccccccgggcgcatccgctaccgcacgccctcctccccggacctcctcctccccaccgacgccaagatgcgcccgcgctactccgccctgcccaacggccgccaggacacgctcgccgaccgcctccaccgctaccgcggcgtcctgctgctcctcctcgccccgctcgccctcgtctccctcgtgctcctcctcatgcccgcctcctcctcaaccgcctccccctcctccagaaggtcgggacccttggatgccgccgcgggtgctaagaggtacgccgtcatcttcgacgccgggagctccggcagccgcgtccacgtcttctgcttcgacgccaacctggatctcgtcaacattggcaccgacatcgagctcttcgtccagaaaaaacccggacttagcgcctacgccagtgacccgcgggaggctgcccagtcgctcgtctctctccttgatgaagccaagcgagtggtacctgcggaattgcgcgaccaaacgcccgtcagagtcggggccaccgctgggctgaggaatttgggagctcagaagtctgaagagatcttgcaagcggttagggatcttcttcgtgacaagagttccttcaaaaaccaagcggattgggttacagttcttgatgggtcgcaggaaggggcgtacgagtgggtcactatcaactatctgttgggaaatttgggaaagacttatgcagacacagttggagtggtcgatcttggtggtggatctgtccaaatggcatatgctatcgcggagaaggatgcagaaaaggctcctaaaccatctgaaggggaagattcatatgtgaagaaactcttccttaaaggaaccacgcattatctttatgttcacagctatttgcactatgggttgctggctgctagagcagaggtcttaaaagctggcaatggcaatggttacagcaactgtatgttagaaggatatcaagggcaatacaaatatggcgatgaaacatttgaagcctcagcttcaccttctggtgcaagttattcaaaatgcaaggatgatgcagtgaaagctctaaaagtggatgaagcatgcacccacatgaaatgttcttttggtggcatctggaatggtggtggtggtgctggacagaagaatctctttgtagcatcctttttctttgacagggctgctgaggctggatttgtaaaccccaaggcagctgtggctaaggttaaaccctcagactttgaacaagctgccaagcgtgcttgtaagttaaacgtgaaggatgccgaagctgcataccccagtgtacaaaaggataacattccatatatctgcttggatcttgtttaccagtacacactacttgtggatggatttggcgttgatgcagaccatgagatgaccttggtaaagaaggtcccttacaacggcgcatatgtagaagcagcgtggcctcttggcagtgccattgaggttgcatcttcataggaagaaaacagtttagcagggaacatcagaaggtgttgacatatgaaattttgggtcgagaggtttccatatacgatcgattggtgttgcacttgctgaagtcaccattttgtcattcgattcattccgcctcctatactatagctttatacacaaggcattgttgtacttcgtccattgtaagccctattttttgtactaatgcaagtaagttgagagcctttatcattc

SEQ ID NO: 19920 - protein, 470 aa, Panicum virgatum
  misc_feature: Ceres CLONE 1807605
  misc_feature (61)..(470): Pfam Name: GDA1_CD39 Pfam Description: GDA1/CD39 (nucleoside phosphatase) family
  misc_feature: SWISSPROT Homolog: EC 3.6.1.15 Nucleoside-triphosphatase
MRPRYSALPNGRQDTLADRLHRYRGVLLLLLAPLALVSLVLLLMPASSSTASPSSRRSGPLDAAAGAKRYAVIFDAGSSGSRVHVFCFDANLDLVNIGTDIELFVQKKPGLSAYASDPREAAQSLVSLLDEAKRVVPAELRDQTPVRVGATAGLRNLGAQKSEEILQAVRDLLRDKSSFKNQADWVTVLDGSQEGAYEWVTINYLLGNLGKTYADTVGVVDLGGGSVQMAYAIAEKDAEKAPKPSEGEDSYVKKLFLKGTTHYLYVHSYLHYGLLAARAEVLKAGNGNGYSNCMLEGYQGQYKYGDETFEASASPSGASYSKCKDDAVKALKVDEACTHMKCSFGGIWNGGGGAGQKNLFVASFFFDRAAEAGFVNPKAAVAKVKPSDFEQAAKRACKLNVKDAEAAYPSVQKDNIPYICLDLVYQYTLLVDGFGVDADHEMTLVKKVPYNGAYVEAAWPLGSAIEVASS

SEQ ID NO: 19921 - DNA, 1771 bp, Panicum virgatum
  misc_feature: Ceres CLONE 1807616
  misc_feature: Encodes the peptide sequence at SEQ ID NO. 19922
aactctctctcctctctcgccgccgatctcctcttcgtcgctccaaagtccaaacccacagcgatcgatcctcttggcacgccgcggcaagcgcatccgcctcggatcagttcgcgggatatcggagcagctagcgttggcgcacgcgaatcgcgatggccgcgcagccgtggaggtcgctgctctgctgcgtgggcggcggcggcggcgggggcgggaccagccgctgctgctccctgcctcctcgtcgtcggcggcgtcgcgggtgtcgctgtcgagcctcggctcgtcggggccgctcacgccggaggacctctcgctcacgctgtccggctgctccgacctgcacgccttcacctacgccgagctgcgcggcgccaccgcggggttctcccgcggtaactacctcggctgcggcgggttcggccccgtctaccggggccgcgtcgacgacggcctccgcccggggctgcccgcgcaggaggtggccgtcaagtacctcgaccccgactgcggcacgcagggccaccgggagtggctcgccgaggtcttcttcctcggccagctccgccacgggaacctcgtcaggctcctcggctactgctacgaggaccaccaccggatgctcgtctacgagtacatgagcaacggcagcctcgagaagcacctcttcaaaagtcttgacggcgccatgccgtggaagaggaggatggagatcgccttcagcgccgccaagggcctcgccttcctccaccacgccgacacgccggtcatctaccgcgacttcaaggcgtccaacatcctgctcgactcggactacaacgccaagttgtccgactttgggctcgccaaggatgggccccagggcgacacgacccacgtcacgacacgtgtcatggggacaaacgggtatgcggcgcccgagtacatcatgacggggcacttgaccgccaagagtgatgtctacagcttcggagtggtgctcctggagcttttgacaggccgccggtccgtcgaccgggctcggcgccctagagagcagagcctggtggactgggctagaccctacctcaagaagcccgacaagctctaccgggtcatggacccagccatggaaggccagtactcgtgccaaggggcggaacgggctgctatggtggcgtacaagtgcctgagccagaacccgaagtccagacccaccatgcaggaggtggtccaggccctcgagcccatactcggcatggacgattacctccagattggcccatttgttttcacggttatagtggaggacatcagcgagggcaaaggcaagatggttgatggtgagaaggtgaacatgagggtcaagacgacggtggaggagaagcaccagagccaccaggaactgcaccggcaaaagttcccgaactctgcggtccacgccaaggtgctgcaccgggacggcgacctcgggccgcacatcagcgcgctgcggcggcaccggaggacggcgagctacgtcggggagagaggagcgtaggtttcatggtcgattagcacggcaggtactaggaaagaagcagctaagggaagattgattgtgtacataattgagctagatcgtagagggatgtgagtatgtgacacaagaagccacacaaaaagaccacgccgcattggctgggtcgccacatttttttgttcaattttttcgttctggatagtgatacttggtgtaattgcccatggtgtcatgattataaatgacatattaattgtcatattgttc

SEQ ID NO: 19922 - protein, 506 aa, Panicum virgatum
  misc_feature: Ceres CLONE 1807616
  misc_feature (130)..(408): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
TLSPLSPPISSSSLQSPNPQRSILLARRGKRIRLGSVRGISEQLALAHANRDGRAAVEVAALLRGRRRRRGRDQPLLLPASSSSAASRVSLSSLGSSGPLTPEDLSLTLSGCSDLHAFTYAELRGATAGFSRGNYLGCGGFGPVYRGRVDDGLRPGLPAQEVAVKYLDPDCGTQGHREWLAEVFFLGQLRHGNLVRLLGYCYEDHHRMLVYEYMSNGSLEKHLFKSLDGAMPWKRRMEIAFSAAKGLAFLHHADTPVIYRDFKASNILLDSDYNAKLSDFGLAKDGPQGDTTHVTTRVMGTNGYAAPEYIMTGHLTAKSDVYSFGVVLLELLTGRRSVDRARRPREQSLVDWARPYLKKPDKLYRVMDPAMEGQYSCQGAERAAMVAYKCLSQNPKSRPTMQEVVQALEPILGMDDYLQIGPFVFTVIVEDISEGKGKMVDGEKVNMRVKTTVEEKHQSHQELHRQKFPNSAVHAKVLHRDGDLGPHISALRRHRRTASYVGERGA

SEQ ID NO: 19923 - DNA, 2290 bp, Panicum virgatum
  misc_feature: Ceres CLONE 1807625
  misc_feature: Encodes the peptide sequence at SEQ ID NO. 19924
acgtagcagcagaccgagatctgaagaaaggcatcgcgcctgaaccaaatagcagtgtcagagtgagagtcttgacagagaagcagcagcgagatggggcggtggtggtcgccggcgtcggcggtgatggagccgcggtcggtgcagctcctgctcgtgggcgtcgccctcgtcgccgcttccttctacgccggcaccctcttcggctcctccgcctcccccgcgctcgtactgccccctctttcgcgccccggatcgccagattcctccaggtccaaagttgcagatgctccaatgtttacaaacagagtttctcttacataccggacggaaccagttagagttccagatcatggagttgatgtgtgtcctctgaaatacaatgagtatgttccctgccatgatgtggcctatataagcagattaaagaacctcgatagatctaggcatgaggatcttgaaaatatttgtcctccacgagagaaacgattgttctgtttggtgccaccaccaaatgactacaagataccaataagatggccaacaagccgagactatgcatggcgtagtaatgtcaaccattcacatcttgctgaggtcaaaggaggacagaattgggtgcatgagaagggcaagctttggtggtttcctggaggaggcactcacttcaaacatggtgcatcagagtacatagagaggatgggaaatatgacaacaaataatactggtgatctccgttcggcaggagtagttcaagttttggatgtcggatgtggtgttgccagcttttctgcttatcttctacccctagatattcagaccatgtcatttgccccaaaagatggccatgagaatcaaattcagtttgctgtagaacgtgggattggtgcaatgatctctgtgttggccacaaagcaattaccttatcctggaaactcatttgaaatggttcactgctcccgatgtcgtgttgattggcatgaaaatgatggaatattgctcaaagaggtagatcgtcttttgcgtcctaatggatattttgtatactctgctccaccagcttacagaaaagataaagactttcctgttatctgggagaagctaattaatattacaacatcaatgtgttggaagcttattgctaagcgtgttcagactgctatttgggtcaaacctgaagatgaatcctgccgacagaaaaatgctgatatgaagctactgaatatttgtgaatctaatgacaatgtttcaccatcatggaaaatcccattaatgaactgtgtgaggcttaacaaggacaaatcagagattcagaaattgcattcaaggcctgatcgcctgtcattttatttcaagagtttggagatgataggagttacaccagcgagttttgagaagaataatgagttttggaagaaacaggttcacaagtattggtcacttctggatgttgaaaagaacagcgtccgaaatgtcatggatatgaatgctaattatggtggatttgctgcagcactaagcaatgaccctgtctggattatgaatgtagtaccgtataccatgagcaacacgttaccagttatctacgaccgtggattacttggttcttaccatgactggtgtgagccattctcaacatatcctaggtcctatgacttgctgcatgctttccacctcatcactcattatgaaagtcgcaatgaagattgttcgttggaagatatcatgttagaaatggaccgcatcattaggccccagggtatgatcatcattagagatgataagaacactctttcaagaatcattgatcttgcaccgaagttcctttgggatgttagcacacatatgttggaaaatgaggaaaacgggaccgagctagttctgatttgcaggaagaaattctgggctattgtttaagttactcttgggctggaagctgccagatcctaccatggggtgtcctttgtgtcagtacagaacagaaagtaaggacaacttttcagcatgttgtagtttgagatgtcgctccagtgaacttagtatttcatcgacctttctctgcagctgagagtattgcattgttgagaaagcatatggtaccattgggaggtttcttcacaaactatcaaactaacttggctccttttctttttttggtgcttttgagctgtactggttgtaaaggacatgcgcaaggtgtaaagaggcgagattttgatttgtgcagtcttactaatagctaacgttttgtagtttctcaaaagaaatagccatttgtagccagctactc

SEQ ID NO: 19924 - protein, 607 aa, Panicum virgatum
  misc_feature: Ceres CLONE 1807625
  misc_feature (223)..(318): Pfam Name: Methyltransf_11 Pfam Description: Methyltransferase domain
MGRWWSPASAVMEPRSVQLLLVGVALVAASFYAGTLFGSSASPALVLPPLSRPGSPDSSRSKVADAPMFTNRVSLTYRTEPVRVPDHGVDVCPLKYNEYVPCHDVAYISRLKNLDRSRHEDLENICPPREKRLFCLVPPPNDYKIPIRWPTSRDYAWRSNVNHSHLAEVKGGQNWVHEKGKLWWFPGGGTHFKHGASEYIERMGNMTTNNTGDLRSAGVVQVLDVGCGVASFSAYLLPLDIQTMSFAPKDGHENQIQFAVERGIGAMISVLATKQLPYPGNSFEMVHCSRCRVDWHENDGILLKEVDRLLRPNGYFVYSAPPAYRKDKDFPVIWEKLINITTSMCWKLIAKRVQTAIWVKPEDESCRQKNADMKLLNICESNDNVSPSWKIPLMNCVRLNKDKSEIQKLHSRPDRLSFYFKSLEMIGVTPASFEKNNEFWKKQVHKYWSLLDVEKNSVRNVMDMNANYGGFAAALSNDPVWIMNVVPYTMSNTLPVIYDRGLLGSYHDWCEPFSTYPRSYDLLHAFHLITHYESRNEDCSLEDIMLEMDRIIRPQGMIIIRDDKNTLSRIIDLAPKFLWDVSTHMLENEENGTELVLICRKKFWAIV

SEQ ID NO: 19925 - DNA, 518 bp, Panicum virgatum
  misc_feature: Ceres CLONE 1807628-R
  misc_feature: Encodes the peptide sequence at SEQ ID NO. 19926
tggacgccccaccaacgagaccgggccgctgaccgcccccgtcgtcgggttcggcgaccgctgcctgcaggcggacggcgtgggggcggtctccctcgcggcctgcggcggcgggatggcgtggtcgctgtaccccgacgggtccgtgcggccgccggcgtggctgtttctccagtggaggtgcctggcggcggacgccggcgggcgggtggcggtgaggttctgcgacgggtccggctcggcctgcgagcgctgggtgttccgcagcgatggcaccgtgctcaacaccggcaccgggatggtcctggacgcgaggccgtcggccggcaagagcggccgctacgacgtcgtcgtgtcgccggccaccggcagcgccacccagcagtgggcactcatgctgtgagctctgatggctgatccgatccgtctgcaacagggctagacagtgtgtcgtgtacaataaagtcgtgtgttgcatggttgctgaataaagtctagctctataagtacattgctac

SEQ ID NO: 19926 - protein, 133 aa, Panicum virgatum
  misc_feature: Ceres CLONE 1807628-R
  misc_feature (11)..(129): Pfam Name: Ricin_B_lectin Pfam Description: Ricin-type beta-trefoil lectin domain
  misc_feature: SWISSPROT Homolog: EC 3.2.2.22 rRNA N-glycosylase
GRPTNETGPLTAPVVGFGDRCLQADGVGAVSLAACGGGMAWSLYPDGSVRPPAWLFLQWRCLAADAGGRVAVRFCDGSGSACERWVFRSDGTVLNTGTGMVLDARPSAGKSGRYDVVVSPATGSATQQWALML

SEQ ID NO: 19927 - DNA, 182 bp, Panicum virgatum
  misc_feature: Ceres CLONE 1807628
gaagcatggaacgatgtcccctcatggtgcttgcctgagcgtgacggcaccagcaacgggaggagcgggacgccgtcagacccttcaacctcccaacaacggcaaagtacggttcgccaccgcctccgccaccaccgctaccgtgtaccacccttttggccggtgatgataccacaatgtcg

SEQ ID NO: 19928 - DNA, 3188 bp, Panicum virgatum
  misc_feature: Ceres CLONE 1807643
  misc_feature: Encodes the peptide sequence at SEQ ID NO. 19929
gcgagaaactaaaaaagcccaaatagcggggaggaggtcgtcgtctcccctcccagcgatcccctcccaccgcgacgccatttccgccactccatgatcacttgggtttcgctcttctccccataaaccctcgtcccgatgcgctggtggaggcgctctggttctccctccggctcctcccaatcatcgcccgcatccacgcccgcgtcccccgcgcgcgcctccacctcccgcctcatcggcggcgggggcagcggccccagctcccgccgcgatggaggtgggggtagcggcgaaccgcagccgcggctgagcagggcgcgtcggatgcgctacgtcgtagacgacctcgaggtcggggtccccgcgatcggcgtggaccctacggcgaggagggacgcggcggccgggttcgggcttgcgaccgcgagctcgacgccgatcttgaggtcgccgagtaacatggaggtggcaccagcgagatcgtcatcgacgcccatgctgctaccgcatccgctgcccctgccaggagatggggagccttcgtaccgcgggacagggaggccgcttccgtcgccgacgccgaggatgaccgacggggagtggaacttgcctgcagcggaggcaccaggggttttggagactgggagtgaaaggatgccgccattgctcgcgcggagagtggtggcccaaactctaccaaagactcacgagcacaatgactttcggttaaatgggactacttgtggtcaacagagaaaagctttcaaagagaaattccaggataagaactcagatgagactttgaacttcagattgaacattcctgctaggagtgcaccaagtagtgggttttcgagccctgtgcaaagtccccgaagattgagcaatgtagacttctcatctgctgcaatatccatccaagataccaatgtatggtcagcacggtctatctggtcttctgatctgacgggatcttcgcctccttctgcttcacctgacaaatttgcgggttgtcaggagcgttctccttgctcaagtccactgagaagtccagttttaagatcaagaaacccaagtgcacctccatcaccaatgcatccaaagttgtttcttgagaaccatgttcctcgtaatgaaggcaatggaagtgccagttttcacccgttgcctctccctcctgcttctgtaagcccaaagcagacaaatactaaccaccaggtagtttcaaaagttgagatgccgtcagtggctggtcaatggcaaaaaggaaaactcctaggcagtggaacatttggatgtgtatatgaggccactaataggcatactggagctctttgtgccatgaaagaggtcaacataattccagacgatgctaaatcgcttgagtctcttaagcaattggaacaggaaattaagtttcttagtcaattcaagcatgaaaacatagtgcagtactatggcagtgagactattgaagatagattctacatatacctggaatatgttcatcctggttcaatccataagtatgttcatcaacattgtggatcactgacagaatcagtcatccgtaacttcacgcgacatatcctcaagggtcttgctttcttacatagccagaagattatgcatagggatatcaaaggtgcaaatttgttagtggatattaatggtgtagtgaaattggctgacttcggaatggctaagcatctgagtactgcagctcctaatctttcattgaagggaacaccatactggatggctcctgaggttgttcgggccacactcgataaaaatgcaggttatgatcttgctgttgatatttggagccttggttgcacaatcattgagatgtttacaggaaaaccaccttggagcggtcttgaagggcctgccgcaatgtttaaggtgttgcgcacggacccaccaatcccagataatctgtcccctgaagggaaggattttctgagatgctgcttcaaaagaaaccctgttgagagaccaacagcaagcaaattgcttgaacacccatttatccaaaattcgaatcatttcaaccagcatggctctacaccctacaaccagcatggctctacaccctcatttgcagcaataaaatccccagatactgggcacaacggtgcaagagacaaagtaccctggaagaatgattcgtgcatgagagggaaacatgcaaatggtagtgaaacaagcagtgctcggtcttctgggtcattggcgtttcgattgacaacacccctacccaactcaggaaccaatagcttgtctcctccacctttgagttcggcctccagttctggctctgcagcccatacaccaaatggtatgaatttttcagtcacataccctaagcctagtccattgccaaagcctaacgggaaggaagcaataaatttgattttacattgaagcacggcatgccacctataacaatatcctggccaaaaaggcacacaaacagtctgagggtaccacctttccctaacctctgatccgtgtatcgccagtcatatttgacaattttctgggtgttgtaaagtattttccatgtaaaggagatcgccacggtatgatcacaggaaaatgctgctaaatgagggggctttgtgaaagggtgcatagtcggattggttaggtggcctcagtagcactcctcaggtgctgggttcgactcctggtgggagtgaattttaggctaaggttaaaaaaaatcctctcgcctgcttacacgccaaagcacatggaaataggtcccggctcacccggcccgctctcacacaggttacggtatgagttacggcgcccctgtgtaagggtggggcaggggttcgggggttttctcagcctgcgtgagaggtcttcttcttacattaatgtccggagggcgacttgccccttgcaggtcgagttttttttttttttttgagggggccttgtgaagtctgttgtaatatttggttctgaggggaatgattgcattccccatgtaacatagtatttattaggatttagctgtaggtaaaactaatggtcctgtttgtcgacacataggacattaggtttagcatgtgttgttgatgttgtataatggtcatacttgatgtaatcattgttgatgattttttgggcccaagtaataatatggcaactggcaaggtggctgc

SEQ ID NO: 19929 - protein, 701 aa, Panicum virgatum
  misc_feature: Ceres CLONE 1807643
  misc_feature (312)..(571): Pfam Name: Pkinase Pfam Description: Protein kinase domain
  misc_feature: SWISSPROT Homolog: EC 2.7.11.25 Mitogen-activated protein kinase kinase kinase
MRYVVDDLEVGVPAIGVDPTARRDAAAGFGLATASSTPILRSPSNMEVAPARSSSTPMLLPHPLPLPGDGEPSYRGTGRPLPSPTPRMTDGEWNLPAAEAPGVLETGSERMPPLLARRVVAQTLPKTHEHNDFRLNGTTCGQQRKAFKEKFQDKNSDETLNFRLNIPARSAPSSGFSSPVQSPRRLSNVDFSSAAISIQDTNVWSARSIWSSDLTGSSPPSASPDKFAGCQERSPCSSPLRSPVLRSRNPSAPPSPMHPKLFLENHVPRNEGNGSASFHPLPLPPASVSPKQTNTNHQVVSKVEMPSVAGQWQKGKLLGSGTFGCVYEATNRHTGALCAMKEVNIIPDDAKSLESLKQLEQEIKFLSQFKHENIVQYYGSETIEDRFYIYLEYVHPGSIHKYVHQHCGSLTESVIRNFTRHILKGLAFLHSQKIMHRDIKGANLLVDINGVVKLADFGMAKHLSTAAPNLSLKGTPYWMAPEVVRATLDKNAGYDLAVDIWSLGCTIIEMFTGKPPWSGLEGPAAMFKVLRTDPPIPDNLSPEGKDFLRCCFKRNPVERPTASKLLEHPFIQNSNHFNQHGSTPYNQHGSTPSFAAIKSPDTGHNGARDKVPWKNDSCMRGKHANGSETSSARSSGSLAFRLTTPLPNSGTNSLSPPPLSSASSSGSAAHTPNGMNFSVTYPKPSPLPKPNGKEAINLILH

SEQ ID NO: 19930 - DNA, 2659 bp, Panicum virgatum
  misc_feature: Ceres CLONE 1807653
  misc_feature: Encodes the peptide sequence at SEQ ID NO. 19931
gaactagctcccctccctctcccagtctccctctctcgcgtctccagcagcagcaacaccgcctgcctccgcctccattccccattccccatcacatcacatctgccccacaccaacccgaaccctagccagcgtcccggtcgcggtgccggcctccgcgagccgcagcgttggtctcccccctcagcttcagagcttctccccgagatcggcggcggaatctcaggaaggggtggtggaggcggggccatgaggctccatggctgaggatgcctgtgctgcgtagcgcggcgcggagggcccgagaggcgcaggggagtccggcggcggcagcaccggcaccggtgccaccgccggcaaacacgaggcggagggcgacgagggccgccgcaagggcggaggagagggagcgggaggagatcaggcccgcggaggtcgtcgcgggggaaggcggcggcgacggagaccagggtaggcgtggaatggacgagccggacagcggggcgcgcagcgccgacaggctggtagccgatgacgagggcggccctcctgtccctgacacggtccaggtgggaaattcaccaaagtatagagtcgacagaaagcttgggaaaggaggttttggccaagtatatgttggccaccgcatgtcagctactggtcctggtgcagttgaggtggcattgaagtttgagcataagaccagtaaaggatgtaactatgcccctccttatgagtgggcagtctacaatgccgtcggtggcattcatggggttcctcgagtccactacaaaggacgccaaggggagttctatgttatggttatggatatgcttggacccagtctatgggatgtttggaataataactctcacacaatgtcagttgagatggttgcttgcatcgctattgaagctatctccatacttgagaaaatgcattcaaaagggtatgttcatggggatgtcaaaccagaaaatttcttgctagggactccagggacacctgaagaaaaaaaactcttccttgttgatcttggattagctacgaagtggaaggacagtgcgacaggactccatgttgactacgatcaacgacctgatgttttcaggggaacagttcgctatgctagtgttcatgcacatcttgggagaataggtagcaggagagatgatttagaatctctggcatatacagtagtctttcttctacgaggacgtctaccttggcaaggttatcagggtgaaaacaaaggcttccttgtctgcaagaagaaaatggccacatctccagaatctctctgttgcttctgcccacagcccttcagggagtttgtagagtatgtagtcaacttaaagtttgatgaggaacccaactatgcaaagtgtgtgtcgctttttgatagtgtagtgggcccaaacccagatatcaggccaattaacactgatggtgctcagaagcttatacatcaagttggccaaaagagaggccgcttattgatagaggaagaggcagatgaacaaccaaagaagaagatcaggatgggaatgcccgcaacacagtggataagtgtttataatgctaggcggcctatgaaacaaaggtaccattacaatgttgcagattcaaggcttgtacagcatattgaaaaagggaatgaagatggcctctttatcagttgcataacatcttgctccaatctctgggctctaatcatggatgctggcactgggttcagttctcaagtttatgagcttacaccacatttccttcacaaagaatggataatggaccagtgggagaggaactactatataactgcacttgctggagcaaacaatggcagctccctggtagtgatgtctaaaggcacaacgtatacgcaacagtcttacaaagttagtgatacttttccctacaaatggataaacaagaaatggcgagatggtttctatgttacttccatggcaactgctggaactagatgggcagttgtcatgtctcgtaatgcaggtttttctgatcaggttgttgaactggacttcttgtatcccagtgagggaatccataagaggtgggacaatggttaccgcataaccgcgactgctgcaacttgggatcaggctgcatttgttttaagtgtgccaaggagacggcctactgatgaaacccaagagacattgaggacgtctgcgtttcctagtcagcacgttaaggagaaatggtccaagaatctctacctagcatcagtatgctatgggcgtactgtatcctaggaatcttttcacgcggtttggagccattttgtgctgagtcctgtcggcgtcatcttttggtctagctagctcagtgtagcagttcctatatgcggtctagttctgaaggcgactcagccttaccctgaccgttgttgcgaaggcgtctgctcattgttcctgattatagactagcatgtacagtagtaaatttttttagttggttttagctgttaatttagccaactattagctgtagtgtaaggcttgccagatgtgtacacctgaccagttaggtcactgactggccggagtgaaaatgcaaatatcggcaggactgtctttattcatactgttatgttcgggcttttttttttttgcagtgataaaagtttccttgaccc

SEQ ID NO: 19931 - protein, 668 aa, Panicum virgatum
  misc_feature: Ceres CLONE 1807653
  misc_feature (107)..(377): Pfam Name: Pkinase Pfam Description: Protein kinase domain
  misc_feature: SWISSPROT Homolog: EC 2.7.11.1 Non-specific serine/threonine protein kinase
MPVLRSAARRAREAQGSPAAAAPAPVPPPANTRRRATRAAARAEEREREEIRPAEVVAGEGGGDGDQGRRGMDEPDSGARSADRLVADDEGGPPVPDTVQVGNSPKYRVDRKLGKGGFGQVYVGHRMSATGPGAVEVALKFEHKTSKGCNYAPPYEWAVYNAVGGIHGVPRVHYKGRQGEFYVMVMDMLGPSLWDVWNNNSHTMSVEMVACIAIEAISILEKMHSKGYVHGDVKPENFLLGTPGTPEEKKLFLVDLGLATKWKDSATGLHVDYDQRPDVFRGTVRYASVHAHLGRIGSRRDDLESLAYTVVFLLRGRLPWQGYQGENKGFLVCKKKMATSPESLCCFCPQPFREFVEYVVNLKFDEEPNYAKCVSLFDSVVGPNPDIRPINTDGAQKLIHQVGQKRGRLLIEEEADEQPKKKIRMGMPATQWISVYNARRPMKQRYHYNVADSRLVQHIEKGNEDGLFISCITSCSNLWALIMDAGTGFSSQVYELTPHFLHKEWIMDQWERNYYITALAGANNGSSLVVMSKGTTYTQQSYKVSDTFPYKWINKKWRDGFYVTSMATAGTRWAVVMSRNAGFSDQVVELDFLYPSEGIHKRWDNGYRITATAATWDQAAFVLSVPRRRPTDETQETLRTSAFPSQHVKEKWSKNLYLASVCYGRTVS

SEQ ID NO: 19932 - DNA, 2401 bp, Panicum virgatum
  misc_feature: Ceres CLONE 1807655-R
  misc_feature: Encodes the peptide sequence at SEQ ID NO. 19933
agcttagtcgatccaagtacccagccaagtgacacccactggcccacccacttggtcatcgggctgtcggatccacatgtttctcgtcgaacacgcaattcctactagatccgagttgcttggttgtgtttataagataaataaaagggattggaaatctgcctcttcttcatctcttctcctggctccttactgctcctattgtgactctcacctcagaagctcgggcgcttcctcagcatcgtcaagctagtcgaatccaagtacccagccaagtgacacccactggcccacccacttggttattgggctgtcggatccacatgtttctcgtcaaacacgcaagcaaccaatttctctcttctcgttgatttcactcgatttatcttagaagatttgaaaagttatggactcccttgcttctcatccgaaccgtgcagttcctactagatccgagttgcttggtcatgtttataagataaataaaagggattggagatctgccgctcctctgtctcctccctggcttcctgctgctcctatattgtggtaaaagaaaaaaaatacacaaattcctctcttaattcgatatattatcttcccattgatttccctcgatttaattaccatagtaccccaaagaaaaaatcttcaaaccccttcttctcatctcaactgtgcagcctctactagattcaatttgctccgttgtttttgaagataaaaaaggattgcagctcccacttcaccaggcttcctgctacggaggcgcgccgctgcccaccaagcctcttcgacaagctcagctgtcgagcacctcgcgtgcaccgtgatgccgcccaccaaggcacgccgccgccggcggaggcgtggacccaggcgcgcccctcggtccccagcgcagcttgtggaagacaccgtcggcgagatcctcctccggctcccacccgacgaccccgcgtgcctcgtccgcgcctccgccgtctgcaagacctggcgccgcgccctcgtcgaccccaccttccctgcccgctaccgcgcgttccaccggacgcctcccgtgctcggcgccttctggggggacgcggtcttcgtccccaccgcgtcgttccgcccgcccgccgccgaccacagcggctgcaacgtgctcgactgccgccacggccgcgtgctcctcgagaacctcggctccgggggcctctccgtctgggaccctatcaccggcgacctgcgccgcctcacggatgtgcccggcatcttctcgctcgtctgcaatggcgcggtgctctgcgccgcgggcgcgggctcccgctgcgatcacctcgcctgccacgggggtgccttcctcgtggccttagtgggcgccggcatccaagggaaagtgcacgcctgcctctactcgtcggagaccggtgcgtggagcgcactgacctccgccccgatcgattacatctacctcccgccggattacgcttactccaccacctcctgcatcaccgtcgacaatgtgcccgccgcgctgttggggaacgaactctacttcattggtgacttcggcaatgagatcctgcggtgcgacctggtcggggaaaacctcgccgtggtcgacccgccggacgtggaaacttgctacgacggcgtcgtcgtcatgccggaggagaacggcaggcggggatttgccttcgtgaaggccaacagcctccatctgtggttgatggagacgggccctgaacctgatggatacggccgaggggaaaagcgcagggtcatcgatctggagacgctgttcccaattctcaacctctcaccgtatttgagtggctttgtggatgcaatcaactgcattgttgtgacaacaggtgatgctctttacaccattgagctcaagacattactgacaaggaaggtgtgcaagacggagaaaccctactcttattgctggctgtacactagtttctacattccagcatgtgctagtggaatacttgcggcacctgtggcgaatggaggctgagtgaacttctgtgagccatttgaggacataaccaggcaaatggaatgcaaatccatcactgtgcagtgctgatgctgtccggtgttttatttcctactaagcatttgagcaaatctatcatctgcagagctgaggctcatgagaaagtttcagagaagaatagtatcagcagttatcttggtcgactagcattcttcaaatcaaaatttctgtttgtatgaatcaaaaactatgtatcagtttattgcagtcgtgagtcttttaccggtccgtgtgtggtgcaatcactagaaagtagaaactcaatatgccatgttttgcttgaaaactgaatcactgttgttcaattttggacaaggttccaaaatatcatcatgattattactt

SEQ ID NO: 19933 - protein, 393 aa, Panicum virgatum
  misc_feature: Ceres CLONE 1807655-R
  misc_feature (20)..(70): Pfam Name: F-box Pfam Description: F-box domain
MPPTKARRRRRRRGPRRAPRSPAQLVEDTVGEILLRLPPDDPACLVRASAVCKTWRRALVDPTFPARYRAFHRTPPVLGAFWGDAVFVPTASFRPPAADHSGCNVLDCRHGRVLLENLGSGGLSVWDPITGDLRRLTDVPGIFSLVCNGAVLCAAGAGSRCDHLACHGGAFLVALVGAGIQGKVHACLYSSETGAWSALTSAPIDYIYLPPDYAYSTTSCITVDNVPAALLGNELYFIGDFGNEILRCDLVGENLAVVDPPDVETCYDGVVVMPEENGRRGFAFVKANSLHLWLMETGPEPDGYGRGEKRRVIDLETLFPILNLSPYLSGFVDAINCIVVTTGDALYTIELKTLLTRKVCKTEKPYSYCWLYTSFYIPACASGILAAPVANGG

SEQ ID NO: 19934 - DNA, 1099 bp, Panicum virgatum
  misc_feature: Ceres CLONE 1807655
gcacaaaggtcttctccagcttggctcctgagatgctaaagatcggcttatatacccttgttgtcgctgctcctagtcgatcactcaccattctctgcatctgaccggcgcagatgtgttgaggaaccagtgtcagtaggcaagtgatttcaataagtggagatttctcgagaaatccgtccatgcgtgcagtccccaaactggatctggattgcttgaagataaaaaaaggattggagatctgcctcttcttcatctcttctcctggctccttactgctcctattgtgactcttacctcgaaagctcgggcgcttcctcagcatcgtcaagctagtcgaatccaagtacccagccaagtgacacccactggcccacccacttggtcatcgggctgtcggatccacatgtttctcgtcaaacacgcaattcatactatattctatttgcttggatgtgtttataatataaataaaagggattggaaatcatggtcttctttgtttcttctcctggctccttactgcttatattgtgacagttgcttggtaatgtttgtgacataaatcaaaatggattggagatctgaatctcctctgtctcctcactggcttcctgtggctcatatattggggtaaaagaaagaaaatatcacaaattcctctcttaattcgatatattatcttcccattgatttccctcgatttaattaccatagtaccccaaaaaaaaaatcttcaaaccccttcttctcatctcaactgtgcagcctctactagattcaatttgctccgttgtttttgaagataaaaaaggattgcagctcccacttcaccaggcttcctgctacggaggcgcgccgctgcccaccaagcctcttcgacaagctcagctgtcgagcacctcgcgtgcaccgtgatgccgcccaccaaggcacgccgccgccggcggaggcgtggacccaggcgcgcccctcggtccccagcgcagcttgtggaagacaccgtcggcgagatcctcctccggctcccacccgacgaccccgcgtgcctcgtccgcgcctccgccgtctgcaagacctggcgccgcgccttcgtcga

SEQ ID NO: 19935 - DNA, 2197 bp, Panicum virgatum
  misc_feature: Ceres CLONE 1807657
  misc_feature: Encodes the peptide sequence at SEQ ID NO. 19936
ataaaacctgcagcccatccggccatcccaacggcctcccgccaccctctcactactctctccgatccccccggccgggccggcttctctgcagtctgcactgcccctgctgttcgtttgctcaccagattggatcagctcggattccggttccggcgcggccccccggagaggagctgctgctgctgctggtcctggagcggagggaagagaggctgctgaacaagacgtgtgtgagtgtgcctggaaggaagagaactagaggggcgaggaacttgcttcccggggtgagaggaaatcaggcggagcgggaagggggggctcggagatggcaggcgggttcggcggcggcggggcggcccccgggagggcggagctctacgagggcaggatcaccagctacttcatcctcgcctgcatcgtcggctccttcggcggatccctcttcggctatgatctcggagtctccagcggcgtgacgtccatggacgacttcctgaagaagttcttcccggacgtgtaccaccggaagcaggcgcacctgcgcgagacggactactgcaagtacgacaaccaggtgctgacgctcttcacctcctcgctctacttcgccggcctcgtctccaccttcggcgcctcctacgtcaccaagcgccgcggccggcgcgccagcatcatggtcggcgccaccagcttcttcctcggcggcgccgtcaacgccgccgccgtcaacatcgccatgctcatcgtcggccgcgtgctcctcggcgtcggcatcggcttcggcaaccaggccgtcccgctctacctctccgagatcgcgccctaccgcatccgcggcgccgtcaaccagctcttccagctcaccacctgcctcggcatcctcgtcgccgacatcatcaactacttcaccgaccgcctgcacccgtgggggtggcgcctctcgctggggctcgccatgggccccgccaccgccatcttcgtcggcgcgctcttcctgccggagacgcccaacagcctcgtcgagcgggggctgttcgaggaggcccgccgcgtgctggagaaggtgcgcggcacgcacaaggtggacgccgagttcgaggacctcaaggaggccagcgaggcggcgcgcgccgtcaagggcacgttccggaacctgctcgccgcgcgcaaccgcccgcagctcatcatcggcgcgctcggcatcccggcgttccagcagttgtcgggcatgaactccatcctcttctactcgcccgtcatcttccagagcctcggcttcggctcctccgccgcgctctactcctccatcatcacgggctccatgctcgtcgtcggcgcgctcatctccatggtcaccgtcgaccgcctcggccgccgattcctcttcatcgaggccggcgtccagatgatctcatccatggtgattgtggccgtgatcctggcgctcaagttcgggcacggcgaggagctgtccaagggcgtgagcacggtgctggtggtggccatctgcctcttcgtcgtcgcctacggctggtcctgggggccgctggggtggcttgtccccagcgagctgttcccgctggagatgcggtcggcggggcagagcgtggtggtgtgcgtgaacctcttctggacggcggccgtggcgcagtgcttcctcgccgcgctgtgccacctccggtggggcgtgttcgtgctcttcgcgtcgctcatcgtcgtcatgtccatcttcgtcatcctcctgctgccggagaccaagcaggtgcccatcgaggaggtctggatgctgttcgacaggcactggtactggaagcgcatcgtccgcaaggaccccaagtaccagggaaacctccaccagcagcaggagatggcgcgagcttgacgatgatactaagtttcaataaggtgcatgtgggatgtttactagacagaccaagttgtgattatgttcttgatgcaatgcaaagaggagctaggattggagatgctgcttaattgcctttgtcgtccatggtttcgtgttcttggaagttcaggcttgtggggcaaaaagttgtcccaacgtgtatttggtggcaggtagatgctaaatgtgctaggcctctatgaatctatgatgttactcgctgttcggatttgattgagatcgaatttatatcttatgaatgcagtgtttgcactctgaatgcttcac

SEQ ID NO: 19936 - protein, 518 aa, Panicum virgatum
  misc_feature: Ceres CLONE 1807657
  misc_feature (29)..(489): Pfam Name: Sugar_tr Pfam Description: Sugar (and other) transporter
MAGGFGGGGAAPGRAELYEGRITSYFILACIVGSFGGSLFGYDLGVSSGVTSMDDFLKKFFPDVYHRKQAHLRETDYCKYDNQVLTLFTSSLYFAGLVSTFGASYVTKRRGRRASIMVGATSFFLGGAVNAAAVNIAMLIVGRVLLGVGIGFGNQAVPLYLSEIAPYRIRGAVNQLFQLTTCLGILVADIINYFTDRLHPWGWRLSLGLAMGPATAIFVGALFLPETPNSLVERGLFEEARRVLEKVRGTHKVDAEFEDLKEASEAARAVKGTFRNLLAARNRPQLIIGALGIPAFQQLSGMNSILFYSPVIFQSLGFGSSAALYSSIITGSMLVVGALISMVTVDRLGRRFLFIEAGVQMISSMVIVAVILALKFGHGEELSKGVSTVLVVAICLFVVAYGWSWGPLGWLVPSELFPLEMRSAGQSVVVCVNLFWTAAVAQCFLAALCHLRWGVFVLFASLIVVMSIFVILLLPETKQVPIEEVWMLFDRHWYWKRIVRKDPKYQGNLHQQQEMARA

SEQ ID NO: 19937 - DNA, 1913 bp, Panicum virgatum
  misc_feature: Ceres CLONE 1807658
  misc_feature: Encodes the peptide sequence at SEQ ID NO. 19938
aaaaatcagctcaactcatcactcgaccacccaggcacccacatcaatccttccattccatttccatcaccatcagccagttgccggctgcgtcagcaacgccgcagcccctatagctcgtgcgtacgtcccgatggagcttccaccatgggcggcttttctcggcgtggtgctcgccaccgtgatgcttctcaaggccgtcctcggccgccgcgggcgccgcgcgtacaacctcccgccggggcccaagccgtggccgatcatcggcaacctcgacctgatgggcgcgctcccgcaccgctccatccacgagctgtcaaggaagtacggcccgctgatgcagctccggttcgggtccttccccgtggtcgtcggctcgtcggtggacatggccaagttcttcctcaagacccacgacgtgatgttcacggaccggcccaagaccgccgccggcaagtacaccacctacaacaaccgggacatcacctggtccccgtacggcgcctactggcggcaggcgcgcaagatgtgcctcaccgagctcttcagcgccaagcgtctccagtcgtacgagtacatccgcgccgccgaggtccaagcgctgctgcgcgacctgcacgcggcgtccggctccggccgcgccgtcatgctcaaggactacctgtccacggtgagcctgaacgtgatcacgcgcatggtgctcggcaagaagtacctggacaaggaggtggtggccggtgggtgctccgtgaccacgccgggggagttcaagtggatgctcgacgagctgttcctgctcaacggcgtgctcaacatcggcgactccatcccgtggctcgactggatggacctgcagggttacatcaggaggatgaagaagatcagcaagatgttcgaccggttcctggagcacgtcgtggaggagcacaaccagcggcggctgcgcgaggggaagagcttcgtcgccaaggacatggtcgacgtgctgctccagattgccgacgaccctaccctggaggttgagctgaacaaagaaagcgtcaaggctttcactcaggacctcatcgccggcggcacggagagctctgcagtcacagtggagtgggccatctcggagctcctgaagaagcccgaggtcatcgccaaggccacggaggagctggaccgcgtcatcggccgcagccgctgggtcacggagaaggacattccccagctcccatacgtggacgccatcgtcaaggagaccatgcggctgcacccggtggcgccgttgctggtgccccgccttgcgcgcgaggacgccaccgtcgacggctacgacatccccgccggcacgcgcgtgctcgtcagcgtgtggtccatcggccgcgaccccgcgctgtgggacgccccggaggagttcatgccggagcgcttcctcggcagcaagctcgacgtgaagggacaagattacgagctgctgccgttcgggtcgggccggcggatgtgccccgggtacagcctcggcctgaaggtcatccaggtgagcctcgccaacctgctgcacggcttcacctggagcctccccaacggcatgaccaaggaggagctgagcatggaggagatcttcgggctgtccacgccgcgcaagttccctctcgaggccgtcgtcgagcccaagctgccggcacatctctacgccaccgaggcttgatcgacgatgtgcgccgtgcgcgtggtttgttcagtataggtgccgttaattttgcgtgttgctgtccagtgtccacttgctgctcccgctgttgttatagtcactctgtaatgtttctctccaagcttgcgtcgtgtgtggcttgtgactgtagtgtggaataatgttgtaactcagttatacccttacttttatatacacgacacagaaaaatacccct

SEQ ID NO: 19938 - protein, 519 aa, Panicum virgatum
  misc_feature: Ceres CLONE 1807658
  misc_feature (35)..(504): Pfam Name: p450 Pfam Description: Cytochrome P450
  misc_feature: SWISSPROT Homolog: EC 1.14.13.21 Flavonoid 3'-monooxygenase
  misc_feature: Functional homolog of the protein sequence given in SEQ ID NO 50304
  misc_feature: Useful for making plants with altered carbohydrate content
MELPPWAAFLGVVLATVMLLKAVLGRRGRRAYNLPPGPKPWPIIGNLDLMGALPHRSIHELSRKYGPLMQLRFGSFPVVVGSSVDMAKFFLKTHDVMFTDRPKTAAGKYTTYNNRDITWSPYGAYWRQARKMCLTELFSAKRLQSYEYIRAAEVQALLRDLHAASGSGRAVMLKDYLSTVSLNVITRMVLGKKYLDKEVVAGGCSVTTPGEFKWMLDELFLLNGVLNIGDSIPWLDWMDLQGYIRRMKKISKMFDRFLEHVVEEHNQRRLREGKSFVAKDMVDVLLQIADDPTLEVELNKESVKAFTQDLIAGGTESSAVTVEWAISELLKKPEVIAKATEELDRVIGRSRWVTEKDIPQLPYVDAIVKETMRLHPVAPLLVPRLAREDATVDGYDIPAGTRVLVSVWSIGRDPALWDAPEEFMPERFLGSKLDVKGQDYELLPFGSGRRMCPGYSLGLKVIQVSLANLLHGFTWSLPNGMTKEELSMEEIFGLSTPRKFPLEAVVEPKLPAHLYATEA

SEQ ID NO: 19939 - DNA, 3119 bp, Panicum virgatum
  misc_feature: Ceres CLONE 1807662
  misc_feature: Encodes the peptide sequence at SEQ ID NO. 19940
accgggcgcccgtcgcggccgcaacaggccagcccagcagcagcagcagccaggcagccatggtggagaggccgcagcggaggaagccgctggtgctcgcctccacgcaggcgctcctcgactcgctcgcgggggaccgcccgccgccgccgccgcaggagccggtgcgcctccgggccggcgtcctccgcttcccgtcggggggcggcgccgagttcggggagctcgcaaccttcgtcgccctccccgcgccagcgctccgaaggctcgcggtcgtcaccggcacgcctgtgcttgtcaagaatgctgacaataatgtcgggagaattgttaaagcaatattacttgatcacccatctcttgacgagtctgggacagaacagactgatcatgcggcatctgcctctcctcatggtcgtgctatgggtatcttaccttttcgttcgtttcctgctactggttttgcatctgtggatgaagatatcgcttatgtcagcccacttttggcattccacttgggattgcatgtttcttgtctgaagcttcttatccaaaaaggacaggagcctttcaagttttgttctcgatctgaagagcttcattctgcttccaatgctgggagtgatctttcccttcacttagaccttcttccatgcgctcaagttcctaaatatgcttcacatttacgggtttctgttgtgaggattcctgaatgtggtgtgcttgcttctttaaagataaattcatcctttggagaaagtgactaccaagacatggtggatcaagctttgaacgagtactttaagtttgataggttcctagcaagaggggatgtcttttgcatacggaacaattggaattgtggcatgagctcctgtctagcatgcaataggcaggatgataatttgcgtcctcgtaatatgatctactttaaggtgacaagcatggaaccatcagatgaacctattcttcgtgttaattgcaatgagacagcccttgtgcttgggggagctgcttctgctgcaatccccccttactccttctttgctgcttctggtgacccacttcctttgcatggtgaaatagtggagcatttagcctctatcattgccccagcattatgcccttcagatatattaccaaaaatcaagttttccacttttatatacggcccttcaggatgcggaaagcgcacagtggtgaggcatgttgctagccatcttggtctgcacgtggttgagtgtagctgtcatgatctcatgacttcgtcagaaagtggtgcacctgctgcacttacagctgccttcaaagaatctcagaagtattccccttgtataatgcttcttcgacactttgatgcaattgggaatgcatcctccaatgagggcccagaatctgagcaatctgggattgcgtcaaacattgaatctgttatcaagcagtacactggacaaagttgggctgctacggactcgatgccaggaagagatgtaaatgggagctcataccctgtggagcctgaatatgtaagctctcttcagattatactagttgcaactgcagacagttctgaaggaatgcaacaatcaattaggcgatgtttctgccatgagattgacatgaagactatgaatgaaaagcagagaaagaaactgatatctgagacacttcaaggcattgcaacagttgcagatgagagtattgatgacaagttcgtaaaagacttagcagcacaaacgtcaggattcatgccgagagacatacttgcactggttgcagattctggtgtgtcttttgcacataaaattgcagcagagaaagatagcaaaggaatcagtgatcatgaggagatccttccagaaagctcttctgccactcaaaatgaggaaatacatttctgcaaagaagatattctgtgttccttggaacgagctaagaaaaggaatcgtgctgcactgggcacacccaaagttcccaatgtcaaatgggaggatgttggtgggctagaggaagtgaaaaaggttattctagatactattcagttgccactgatgtacaaacaccttttttcttctaaattgcggaagcgatcaggtgtcctgctttatggacctccaggaacagggaagaccttattggcgaaagcagtagctactgaatgctcgttgaactttcttagcgtgaaaggtccagaactgataaacatgtatgttggagaatcagagaagaatgttagggacatttttgagaaggctagatctgcacgcccatgtgtcattttctttgatgagcttgattccctagctccagcacgaggatcctcggcagattctggtggtgttatggacagagttgtttcccagttacttgtggagatagatgggttgagcgataacagccaggaccttttcattattggggctaccaataggcccgaccttcttgattctgctcttcttcgccctggacggtttgataagcttctctatgttggtgtaaatactgatgcatcatacagggaaaggatccttaaagcacagacgcgcaaatataagctccacagtaatgtttctctcttgtcagttgctcagcgttgtcctccaaactttaccggtgccgatatttatgcactgtgtgcggatgcatggtttcatgcagcaaagagatccgttaaaacatttgaaattgatccttcaagaaataacgatgtcagcgctgaagaggtcattgttgagattgatgattttatgacggtattaggagatatatcaccatcactatcactggaggagcttcagaactacgaacagttgaggcagaagattgaagggccttctagatgatgatgttagcagtaatattttatttcccattgatgattttgtcccaccagagacacccaaggttcagagtcttaggccttgttcggctggctggctggctggctggatggctggctgatttggcgtgagagaaaaatactgttggttggctggctggctgatttggcgtgagaggaaaatactgttgtggttggctgaatctctcagccgaacaaggcgttaaactgctaacatttcctgaacttccatctcttaattacaatattttctttttac

SEQ ID NO: 19940 - protein, 927 aa, Panicum virgatum
  misc_feature: Ceres CLONE 1807662
  misc_feature (679)..(868): Pfam Name: AAA Pfam Description: ATPase family associated with various cellular activities (AAA)
  misc_feature (366)..(581): Pfam Name: AAA Pfam Description: ATPase family associated with various cellular activities (AAA)
  misc_feature: SWISSPROT Homolog: EC 3.6.4.3 Microtubule-severing ATPase
MVERPQRRKPLVLASTQALLDSLAGDRPPPPPQEPVRLRAGVLRFPSGGGAEFGELATFVALPAPALRRLAVVTGTPVLVKNADNNVGRIVKAILLDHPSLDESGTEQTDHAASASPHGRAMGILPFRSFPATGFASVDEDIAYVSPLLAFHLGLHVSCLKLLIQKGQEPFKFCSRSEELHSASNAGSDLSLHLDLLPCAQVPKYASHLRVSVVRIPECGVLASLKINSSFGESDYQDMVDQALNEYFKFDRFLARGDVFCIRNNWNCGMSSCLACNRQDDNLRPRNMIYFKVTSMEPSDEPILRVNCNETALVLGGAASAAIPPYSFFAASGDPLPLHGEIVEHLASIIAPALCPSDILPKIKFSTFIYGPSGCGKRTVVRHVASHLGLHVVECSCHDLMTSSESGAPAALTAAFKESQKYSPCIMLLRHFDAIGNASSNEGPESEQSGIASNIESVIKQYTGQSWAATDSMPGRDVNGSSYPVEPEYVSSLQIILVATADSSEGMQQSIRRCFCHEIDMKTMNEKQRKKLISETLQGIATVADESIDDKFVKDLAAQTSGFMPRDILALVADSGVSFAHKIAAEKDSKGISDHEEILPESSSATQNEEIHFCKEDILCSLERAKKRNRAALGTPKVPNVKWEDVGGLEEVKKVILDTIQLPLMYKHLFSSKLRKRSGVLLYGPPGTGKTLLAKAVATECSLNFLSVKGPELINMYVGESEKNVRDIFEKARSARPCVIFFDELDSLAPARGSSADSGGVMDRVVSQLLVEIDGLSDNSQDLFIIGATNRPDLLDSALLRPGRFDKLLYVGVNTDASYRERILKAQTRKYKLHSNVSLLSVAQRCPPNFTGADIYALCADAWFHAAKRSVKTFEIDPSRNNDVSAEEVIVEIDDFMTVLGDISPSLSLEELQNYEQLRQKIEGPSR

SEQ ID NO: 19941 - DNA, 2717 bp, Panicum virgatum
  misc_feature: Ceres CLONE 1807678
  misc_feature: Encodes the peptide sequence at SEQ ID NO. 19942
ggagcagccgggaagtgaacagcaccgtacccaaagaggcaaaaagaacggcgtgaggtggccgagcctttttgcgcgcggtggttagagagatctagtagagtatatagctgcggtgcgcgacgtcgacggcggggcagtttcccggccggatcggaagatggcgccccatggcagcgccgcccggggcagcatggagatcgtcccctacagcggcgagctggacctggagctgccgcccgcggtggtcgacgtcaagcgccaggactcgctctaccgcgacgccaccatgccagcccacgccggccaccacggacaggagagctgggttcggacgctacggctggcattccagtgcgtggggatcctgtacgccgacctcggcacctcgccgctgtacgtgtacgccaacaccttcaagaagggcgtcggccacccggacgacgtcctcggcgtcctctccatcatcatctacagcttcatcctcttcaccatgatcaagatcgtcttcatcgccctctacgccaacgatgacggcgacggtggcacgtttgcactctactcgttgatctcccggtacgccaaggtgtgcctcatcccgaaccagcaggccgaagacgagctcgtgtcgaggtacaggcaccgcgccaagccgtcggcgacgctgaggagagctcagtggatgaagaacctgctggagacgagcaaggcggccaagatctccctcttcttcctcacgatccttgcgacagcgctggccatcagtgacagcatgctaactcctccgatatccgtgcttgcagctgtcaacggtctgagggtgagagcacctcatctaacaacagatcaaacggtatggataacggtggggattctggtggttctctttgcggtccagcgctttggcaccgacaaaattggttacgcatttgcgccggtggtttttgtgtggctgctccttatggcagctattgggatctataacatggtcaagtacgacattggcgtcttgaaggctttcaacgcaaaatatatcgtcgactatttccgaaggaacaaaaagaaaggatggatctcattgggtgaaattctcctttgcttcacaggcacagaagctctttttgctgatatgggatacttcagcatcagatcgatccagctgagcttcacttttggcttattaccttcggtgttgctcacatatattggacaagcagcatacctgaggaaacacatagacatgtctgtggctgacatacctaatgttttcttcaattcaatcccaagatctttattttggccaacctttgtcctagctctcattacatcagtcattggaagccaagctatgatctcgtgtgccgttgcaaccatgtctcatttacaagcactcaactgttttccaagggtcaagatactacatacatcaaggcgttattcaggccacctgtacatccctgaagtgaacatcttcctttgtattgctgcttgtgttataaccataagcttccggacaactggtttcattgcaaaagcacatgaaatttgtgtggtccttgtgatggtgatcacaaccctattgatgacaatagtgatgctccttgtgtggaaggtaaacatttggtggattgccatcttcttcattgtctacatatcaacagagtccatctacacagctgcagttttatataagttcaccaagggaccttatctgccactggctatgtcagctattctcatgttaatcatgattgtctggcactacgtgcatgtcaaacggtacaaatatgagcttgagcatactgtgtcacgcgatgaggtgaaagatctacttgaacgtcgggacctaaagagggtcccaggactagggcttttctacactgagttggttcaaggcataccacccatattcccacatctaatcgagaagattcctaccattcactcagtgattgtcttcatcacggtgaagcgtttgccaattccccatgttgatgtctcggagcgcttcctctttcgacaagtggagcccaaagagttaatggtgttccgttgtgtggcaagatatgggtaccgcgacaagctcgagatggccaacgattttgttaaagtcctagttgagtacctccaatactatgttagggacttaaacctctatggagttggtgatgagccattgaagattatcttccatagcgctcgtgttgacagctttacttgggagaggaagccctcaggacatgccatctatgctgaggagatgcttacaccagcccaatctttttcggagctcacaatgcatccggtctccatgagtagtagattggcacatttccaggcagggaaaatgaacctagaggagatgttgaagattgaggaagatcaaaagatcatccagcgcgaggtggataatggtgttgtttatatagttggggagagtgaagtagtagccaagcctcactctaacttgttaaagaagattattgtgaactacatctacaattttctaaggaaaaattcaagaaatggagagaagatgctatccattccaagaggccaactactcaaggttgggataacctacgagatctaaggtctcacataagttcatatattaacaagaatgatgtattttccttagatgcatgttgatatgtgatagtgatgagagcttacggacgcaatgtctaatagataaatatatatttcaagagctc

SEQ ID NO: 19942 - protein, 810 aa, Panicum virgatum
  misc_feature: Ceres CLONE 1807678
  misc_feature (61)..(810): Pfam Name: K_trans Pfam Description: K+ potassium transporter
MAPHGSAARGSMEIVPYSGELDLELPPAVVDVKRQDSLYRDATMPAHAGHHGQESWVRTLRLAFQCVGILYADLGTSPLYVYANTFKKGVGHPDDVLGVLSIIIYSFILFTMIKIVFIALYANDDGDGGTFALYSLISRYAKVCLIPNQQAEDELVSRYRHRAKPSATLRRAQWMKNLLETSKAAKISLFFLTILATALAISDSMLTPPISVLAAVNGLRVRAPHLTTDQTVWITVGILVVLFAVQRFGTDKIGYAFAPVVFVWLLLMAAIGIYNMVKYDIGVLKAFNAKYIVDYFRRNKKKGWISLGEILLCFTGTEALFADMGYFSIRSIQLSFTFGLLPSVLLTYIGQAAYLRKHIDMSVADIPNVFFNSIPRSLFWPTFVLALITSVIGSQAMISCAVATMSHLQALNCFPRVKILHTSRRYSGHLYIPEVNIFLCIAACVITISFRTTGFIAKAHEICVVLVMVITTLLMTIVMLLVWKVNIWWIAIFFIVYISTESIYTAAVLYKFTKGPYLPLAMSAILMLIMIVWHYVHVKRYKYELEHTVSRDEVKDLLERRDLKRVPGLGLFYTELVQGIPPIFPHLIEKIPTIHSVIVFITVKRLPIPHVDVSERFLFRQVEPKELMVFRCVARYGYRDKLEMANDFVKVLVEYLQYYVRDLNLYGVGDEPLKIIFHSARVDSFTWERKPSGHAIYAEEMLTPAQSFSELTMHPVSMSSRLAHFQAGKMNLEEMLKIEEDQKIIQREVDNGVVYIVGESEVVAKPHSNLLKKIIVNYIYNFLRKNSRNGEKMLSIPRGQLLKVGITYEI

SEQ ID NO: 19943 - DNA, 1567 bp, Panicum virgatum
  misc_feature: Ceres CLONE 1809252
  misc_feature: Encodes the peptide sequence at SEQ ID NO. 19944
atcaaaacccaccgagtcctgtccaaacccccgtcgcaagaaggtctcctcctccactccgaccgccgggggccgctccactgcaatgctccgcgatccacggccatggccttcctcaagaccctaaaccctctcatacgcaggagcaccaccccgatctcgaaccccaggccgctcctctccctccacaccttcctcgcctcgtcctcccccaccaccatcacccccgcagccgcccccttcgccggagcggcgcaggcccacgtccccgtccggtcgggcggcccgctgttcctctcgtcgcccccatggatgctctcgcagtccgcgacgccgctcacggccgcggctgccgccctccgcgacaagctccgcagggcccaggccctcgccggcggccgcgcgcaggccgtcacggacgccgtgcggtgggaccgcaggcggatctccggggctgaggcgggggccgcgccgtcggcggggattgtgggaggtggaggcgagaggtttctgaatgcgcccaatttggtgtcgattgggcgcatggtgtcagggccggtcattggatggatgattgtgaacgaatggtatcttcctgcctttgccacattggctgtctctggtgcaagtgattggttggatggctttttagcaaggaagatgggcatcaattctgtcttcgggtcatatttggaccctctggctgataaggttttgattggctgtgttgctgtagctatggttcaaaacgatctcttacatcctggtcttgccggcctggttgtcatgagagacttgctccttgtgggtggtgctttctacaaacgggcttctagtctgggatggaagtggaacagttagtcggaatatgttaacttagatgcgattcatcgtgaaaaggttgaacctctgttcatcagcaaggtgaacacagtattccaattaatgttggttgcagctgcacttcttcagccagaatttggcacagatgagactcagaattacattacactccttagttggcttgtagctactacaacaatcacttccacgataggctatggggtgaaatactaccggatcaaaccaaggagccaatgattgttgccacatgcacttgtttcatggatgaatttgccgctaatgaggaggacatgcatccagtaacacactgacatgtatcaggcacgcacggagtggctatgcgaacttcccaatttacaactgcaagattggataaagtgaaacattttgggcaaagattggatcaagaagtgaagaactgccacatgaatgaatcagcgcattacttgtacattagaccttaggcctctctcaagtagctgttaagtttcttgcttactactttcccctagtttcagcctagagcgcacatcaaagccagtagaacctttgcttttctttggcccgatagacacatcagttctgttgccggtgtacatatatgcacttcaaaatatttgtactggccatggcggaatgaggttgataggcgctgtcctgtttccagatgtttgcaaatttggttaaaacatttacgatgcag

SEQ ID NO: 19944 - protein, 251 aa, Panicum virgatum
  misc_feature: Ceres CLONE 1809252
  misc_feature: SWISSPROT Homolog: EC 2.7.8.5 CDP-diacylglycerol--glycerol-3-phosphate 3-phosphatidyltransferase
MAFLKTLNPLIRRSTTPISNPRPLLSLHTFLASSSPTTITPAAAPFAGAAQAHVPVRSGGPLFLSSPPWMLSQSATPLTAAAAALRDKLRRAQALAGGRAQAVTDAVRWDRRRISGAEAGAAPSAGIVGGGGERFLNAPNLVSIGRMVSGPVIGWMIVNEWYLPAFATLAVSGASDWLDGFLARKMGINSVFGSYLDPLADKVLIGCVAVAMVQNDLLHPGLAGLVVMRDLLLVGGAFYKRASSLGWKWNS

SEQ ID NO: 19945 - DNA, 2012 bp, Panicum virgatum
  misc_feature: Ceres CLONE 1809256
  misc_feature: Encodes the peptide sequence at SEQ ID NO. 19946
acgcaaaggcggacgggcacgggggcgtattcgttcccctccgggtctgcacccctctccttctcttctcctctggattccactaacccgcaccccgccccatctcttggccgcgggcggatcgccgttctcggcactcgcccgccccccttcctggcggctttgcccgcctctctactccctgcagcctgccgacgcggcgagcgctcgctcaaggccacgggggctacctggatcgtctgctctcctccgggcccatccgagatccgcgctccgtttcccgatttatggtgaggcccatagagctactgtttttcaaacccagattcagcgcctgttgatggatgagagatgaaaaacttcatcaagtattaaatttgaagaagaagaagaagaagaacagatgggctccattctaagtgcgactactgctaagtctatggatcggcatgagtcatctgggacagatcctaataagagggtgaaggtatctacttatgtgtatgggacgaacctgaggatcattccaacgcttcccgatgagctctcattccaaattctagcaaggttaccacggattcattacctcaacttgaagatggtttgcagagcttggaaggcagcaatcaccagccatgaactttcccagctgaggagagagctttgtgtaaatgaagaatggttgtatgtactgaccaaagtcgaggcaaataagctcgattggtatgcccttgatccattgtttcagaaatggcagaggttgccacccatgccttctttcgtcaatgaggaagaatccagtaggactggatattctgggttccggatgtagaatgttgtgggctcgagcattaggattgctgattttgtgaggggctggctctggcgcaggaatggtttggaccagatgcccttttgtggttgctcagtgggtgttgctgatggttacttgtatgttgttgggggcttttccaaagctgttgccctgaactgtgtatggagatatgacccttttctcaacttgtgggaggaagtaagcccaatgatgactgggcgggctttctgcaaggcaacatacttgaatggcaagttgtatgtagttggtggagtcagtaggggtcggaatggcttgcttcctctacgttcagctgaggtgtttgatccgaaaactggactttggagcgagctaccagaaatgccttttgcgaaagcacaggtactccccacagctttcttggctgatgtgctgaagcctattgccacaggaatggcaccatacaagggtaaactgtatgttcctcagagcttgtactcatggccattctttttcgacattggaggcgagatctatgacccggtactgaattcttggtcaacgatgccggatggtctcggcgacggatggccagcaaggcaggcaggcacaaagctcggtgttgttatcgatgacaaactttataccttggagccttccagctctttggatagtggccgaataaaaagatacaactctgaagaagacacatgggtaactatcgccccacaggttccagttaacgatttcactgatgcagaggctccatatttacttgctggcctccatggaaggctccatgttataaccaaggcggcgaacaatactcttcaggttatgcatgctgtggtgcagaataacacaggcagcggggcatctgaagaaaacgtgttatggaacacagtggcttccaggaactttgggacggctgagcttgtcagctgccaggttcttgatgtttagaacgaggttgatgttcacacctgtagatcatatgtttggccaaggtttcatactatgggttatcgttttagccaacaaacatatagtttttttttttctcgttgttgtgtgcatgtgtggtgcgtggagaaggcctttaatttgacatgggagtcatggagagagatcgattacatgtattcagacttgtgtaagttgactcaactgctgaaaagatgtgtatatataggcatac

SEQ ID NO: 19946 - protein, 142 aa, Panicum virgatum
  misc_feature: Ceres CLONE 1809256
  misc_feature (39)..(86): Pfam Name: F-box Pfam Description: F-box domain
MGSILSATTAKSMDRHESSGTDPNKRVKVSTYVYGTNLRIIPTLPDELSFQILARLPRIHYLNLKMVCRAWKAAITSHELSQLRRELCVNEEWLYVLTKVEANKLDWYALDPLFQKWQRLPPMPSFVNEEESSRTGYSGFRM

SEQ ID NO: 19947 - DNA, 501 bp, Panicum virgatum
  misc_feature: Ceres CLONE 1809259-R
  misc_feature: Encodes the peptide sequence at SEQ ID NO. 19948
ttacccccagcaagatccatccaaggggaacaacaacggaatggtatccagagctcgtcctaccggtgcctggcagcatccatcaactggcaggcggacgtgcagaggtgcatagagtgggaagctcacagccgccgcgccactgggctgacgcttgccttcctcagtgcagcggctaaggagctcagctgccccctcccttgctgacaagacaaggccattccctgggactgacgtcggcagccagtgcaggcagtcgctgcagggtcagcgagtaggatgctaatctctccatcagggatgacttgctggcttgttcatgatgcgatttatactgatactaggtgttgtttccaaagcatatacggggctttgctcccaaggtgccatttgctttcaatctgatgttagatgttcaagcatatgcaactgcttgtgttgtacgtaacttgtactatgcatgtaatgtaagcctgtaacgtcgttcaatctggttaccgg

SEQ ID NO: 19948 - protein, 68 aa, Panicum virgatum
  misc_feature: Ceres CLONE 1809259-R
  misc_feature: Functional homolog of the protein sequence given in SEQ ID NO 50888
  misc_feature: Useful for making plants with modulated flowering time
  misc_feature: Functional homolog of the protein sequence given in SEQ ID NO 50889
  misc_feature: Useful for making plants with modulated biomass
LPPARSIQGEQQRNGIQSSSYRCLAASINWQADVQRCIEWEAHSRRATGLTLAFLSAAAKELSCPLPC

SEQ ID NO: 19949 - DNA, 709 bp, Panicum virgatum
  misc_feature: Ceres CLONE 1809259
atcgcgaaaaaatctttttcccgcctcacccgccgctcgccgcgaaatccacccgcggacgccgcccgctcgccgtggagagcctcggattagagtgcgccccgtcgagagatttcgaagcaactatgtttgggattggttgatatgatacttgttcacgttgggggatgcagacccccccctctgtgggggttgattgaagaagttaacagtactcttagacgaacttgtgtcctactgatactgaaagtttcttggtttcgaggcaagtagcattactaagagtaggaccttggtggcatagatggatgaactgactgaaaacttcaacgcggtgttgattacaggctcttgagctaccaaagtaccaagtatgtcagcttcaaatgagaagtggatcgatgggctccagttcacatcactgttctggcctccaccccaggatgtgcaacagaagcaagcacaaattttggcctatgttgagtactttggccagtttacagctgacagcgagcaattccctgaagatgtagcacagctcattcaaagttgctacccatggaaagaaaaacgcttggtagatgaagtgttggcaacttttgttcttcatcatcccgagcatggtcatgcagttgtacatccagttctttcacgtatcatagatgggacactgtgctatgatagacatggtcctccattcagctccttc

SEQ ID NO: 19950 - DNA, 711 bp, Panicum virgatum
  misc_feature: Ceres CLONE 1809262
  misc_feature: Encodes the peptide sequence at SEQ ID NO. 19951
gtgcgctgcggccgggtcggatctgagaccattcctcccaacttattaccatcccatccaatcccccggcttcctcctcctctccccccgccggatcggatcggatccgccgaccaccccgcaccgccgccgccgcaacatcagcatcagcagatcagagaagatggccgcagttgacaccttcctcttcacctcggagtctgtgaacgagggacaccctgacaagctctgtgatcaggtctcagatgccgtgctcgatgcttgccttgctgaggaccctgacagcaaggttgcttgcgagacctgcaccaagactaacatggtcatggtctttggtgagatcaccaccaaggccaatgtcgactacgagaagattgttagggagacttgccgcaacattggtttcgtgtcagcagatgtcgggcttgatgctgaccactgcaaggtgctcgtgaacattgagcagcaatcccctgatattgctcagggtgtgcatggtcacttcacaaagcgccctgaggagattggagctggtgaccagggacacatgtttgggtatgcgactgatgaaacccctgagctgatgcccctcagccatgtccttgccaccaagcttggtgctcgtctcactgaggtgcgcaagaacgggacctgcccctggctcaggcctgatggaaagacccaggtgactgttgagtaccgcaatgaggg

SEQ ID NO: 19951 - protein, 182 aa, Panicum virgatum
  misc_feature: Ceres CLONE 1809262
  misc_feature (5)..(104): Pfam Name: S-AdoMet_synt_N Pfam Description: S-adenosylmethionine synthetase, N-terminal domain
  misc_feature (119)..(182): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAVDTFLFTSESVNEGHPDKLCDQVSDAVLDACLAEDPDSKVACETCTKTNMVMVFGEITTKANVDYEKIVRETCRNIGFVSADVGLDADHCKVLVNIEQQSPDIAQGVHGHFTKRPEEIGAGDQGHMFGYATDETPELMPLSHVLATKLGARLTEVRKNGTCPWLRPDGKTQVTVEYRNE

SEQ ID NO: 19952 - DNA, 155 bp, Panicum virgatum
  misc_feature: Ceres CLONE 1809266
  misc_feature: Encodes the peptide sequence at SEQ ID NO. 19953
ctgtacagcgccttgtcgttcatggtgattacaatgttatggttatgactttaccggtccctaccctcgataatcttttcaatatttgtctcaagacgctgtccctgtaaactgggttgacctctgctgataagataatctacctactcagattt

SEQ ID NO: 19953 - protein, 35 aa, Panicum virgatum
  misc_feature: Ceres CLONE 1809266
  misc_feature: SWISSPROT Homolog: EC 2.7.11.1 Non-specific serine/threonine protein kinase
  misc_feature: The sequence is a functional homolog of SEQ ID NO 32 in US patent 7179962
VQRLVVHGDYNVMVMTLPVPTLDNLFNICLKTLSL

SEQ ID NO: 19954 - DNA, 1241 bp, Panicum virgatum
  misc_feature: Ceres CLONE 1809267
  misc_feature: Encodes the peptide sequence at SEQ ID NO. 19955
gtctgctccccgcgcgcaccgcggcacccgctgctacacattccattcccttcccccacccattcccatcccagatctccaccgacgcagcacagagatcgagagcggagctcgcggcaaacccgaaccgacgcaatggcgacgctcaccgtccccgcctccgtcccgcccgtcgccgaggactgcgagcagctccacaaggcattcgaaggctggggcaccaacgagaagctcatcatctccgtcctggcacaccgcgacgccgcgcaccgccgcgcgatccgccgcgcctacgccgagaagtacggcaaggagctgctccgcgccctcggcgatgagatccacggcaagttcgagagggcggtgatcctgtggacgctggaccccgcggagagggatgcggtgctggcgagcgaggaggctaagaagtggcaccccggcggccgcgcgctggtggagatcgcgtgcgcgcgcacgcccgcgcagctcttcgcggccaggcaggcgtaccacgaccgcttcaagcgctcgctcgaggaggacgtcgccacacacgtcaccggcgacttccgcaagcttttggtgcctcttgtaagtgcataccgctatgatggcccagaggtgaacacttcgctggctcattctgaagccaaaatacttcatgagaatattcacaagaaggcttacagtgatgaggaggtcatcaggattctcaccacacggagcaaagctcagctacttgcaacattcaatagctacagggatcagttcgatcatccaatcaacaaggatctaaaagttgatcccaaggatgagttccttgcaaccctgcgagcgatcattcgttgcttcacttgccctgacagatactttgagaaagtccttcgattggctcttggaggcatgggcacagatgaggatgatctcaccagggtcataactactcgcgccgaggtcgacctgaagctgattaaggaggcctaccagaagaggaacagcgtgccgctggagcgtgcagttgctaaagatacaaccagagactacgaggatattctcctcgcactgttaggagcagagtgaggaggcgtgtctcagcaccatctcatgtgttcctccttgtctaatgggaagatgaaactgcataaaagttctgaacgcatggttgtgtttctgaacaataataagttcgtgacctagcctgcatatatagcagtgctcgttaaataaaagatgttttcttg

SEQ ID NO: 19955 - protein, 314 aa, Panicum virgatum
  misc_feature: Ceres CLONE 1809267
  misc_feature (245)..(310): Pfam Name: Annexin Pfam Description: Annexin
  misc_feature (15)..(80): Pfam Name: Annexin Pfam Description: Annexin
  misc_feature (87)..(152): Pfam Name: Annexin Pfam Description: Annexin
  misc_feature (170)..(235): Pfam Name: Annexin Pfam Description: Annexin
MATLTVPASVPPVAEDCEQLHKAFEGWGTNEKLIISVLAHRDAAHRRAIRRAYAEKYGKELLRALGDEIHGKFERAVILWTLDPAERDAVLASEEAKKWHPGGRALVEIACARTPAQLFAARQAYHDRFKRSLEEDVATHVTGDFRKLLVPLVSAYRYDGPEVNTSLAHSEAKILHENIHKKAYSDEEVIRILTTRSKAQLLATFNSYRDQFDHPINKDLKVDPKDEFLATLRAIIRCFTCPDRYFEKVLRLALGGMGTDEDDLTRVITTRAEVDLKLIKEAYQKRNSVPLERAVAKDTTRDYEDILLALLGAE

SEQ ID NO: 19956 - DNA, 1639 bp, Panicum virgatum
  misc_feature: Ceres CLONE 1809268
  misc_feature: Encodes the peptide sequence at SEQ ID NO. 19957
ccacaaccggtccttctccgcggaagccggcgagccgccgcctgccccatcctccccgccacgctcctccgcaccgccattccccatcacttccctcgggtgaggtaaagaagcgatctttctaccagctcccgccccctccggcaacgtaggcgccgctcgcatttcgtgcgcggttactcggctagatctgcgcgcatttggcgttctcaggtgtagatctcgcttctacctcatttccttcggtgaggtacgtcggtggcggcttggttgagatggaggatgtggtcgatgacgtcatcgacgcaacgggtccggcggctgccgtcgaggatggggccagtgggaagtctgcattgcctagcttagggggccatggtgaggaagagcatggggagaaaggcaatgaggataactcaggggagagcgaggtgatcaacccgcccgaagaggctggcggggaagccacctcgccccccgagggcaggaagcctcgcctttccaaggggaaccaaagtcatggacctaaggctgtgaagtctaagagcccaaggagtggagatgaagctcagtcaaggagaagaaccctcaattcttctcttcctaaggcatccgttgctcgggtatcaaatggtgatgccggtgtcgttagtaataaagctgtcaagaatgagtctcactcatcttccaaggatgcagcattgttggatgactccaaggagaaaaggaaaactcaaaagtcatcaggccagcactcttccatcaaaagagatgaagaagattccaactgtgagagtacacagcctcgaaaagttggcagcactccttcatacggcttcaccttcaagtgtgatgagagatctgaaaaaaggcgagagttctattcgaagcttgaggagaagattcatgcaagagagttagaaataagcaatttgcaagctaaatcaaaggaaactgaagaggcagaactcaaaatgctgcgaaaaagtttgaatttcaaggcaacaccaatgccaagcttctataaggaaccagctcctgccaaggttgaattgaaaaagatccccccaaccagagctaaatcaccaaagcttggtcgttctaaaaacaagtccacaccagagactgaagaaaatactacgtccgaccaacctgcacgtctgagccttgaggaaaaggtttctcaaaatggtgtgaaaaaatcaaacccatcaaattcagcaaagaagccccagagaaagtcactccccagattgccatcacaggaaacaggtatgctcgatgacacatcaagctcatcacctgcaaggcagctaaagaacacaaagccaattgcaggtagtgctcaagcgacacagtcagctacagggcagctacaaggaactgagatgaagccagactccattcagggtccgatccaagctggagctaatcctgatgaacagattgcagtctagcgaaactcgcggtgaccaaaccaactgatttgatatggatggtgtgccccggctttgtataatattgtgcttgtctactagagtaacttgtgacctgtattatgctatgtgatatactcctgtttcgttttcctggagttgagcctgtacgctgcttatctaggtagcttttgttcatagcc

SEQ ID NO: 19957 - protein, 393 aa, Panicum virgatum
  misc_feature: Ceres CLONE 1809268
  misc_feature (190)..(246): Pfam Name: TPX2 Pfam Description: Targeting protein for Xklp2 (TPX2)
MEDVVDDVIDATGPAAAVEDGASGKSALPSLGGHGEEEHGEKGNEDNSGESEVINPPEEAGGEATSPPEGRKPRLSKGNQSHGPKAVKSKSPRSGDEAQSRRRTLNSSLPKASVARVSNGDAGVVSNKAVKNESHSSSKDAALLDDSKEKRKTQKSSGQHSSIKRDEEDSNCESTQPRKVGSTPSYGFTFKCDERSEKRREFYSKLEEKIHARELEISNLQAKSKETEEAELKMLRKSLNFKATPMPSFYKEPAPAKVELKKIPPTRAKSPKLGRSKNKSTPETEENTTSDQPARLSLEEKVSQNGVKKSNPSNSAKKPQRKSLPRLPSQETGMLDDTSSSSPARQLKNTKPIAGSAQATQSATGQLQGTEMKPDSIQGPIQAGANPDEQIAV

SEQ ID NO: 19958 - DNA, 1604 bp, Panicum virgatum
  misc_feature: Ceres CLONE 1809296
  misc_feature: Encodes the peptide sequence at SEQ ID NO. 19959
agcacggcctgaattgtttgtttatcaccggcgtgatccggaaagccagccgtaccgtcgccggaggagaagatcactcccgcccgatatcactccgcccgccggtcgatgtttgcggtgcagtagagagatatctttggaagcacatggccgtaggccgttgcgtcagctctgcttcggcaccgctttttgttcaaggtgtcaccgtcggcatcgaaactgggatccatggcggcggcggagggggcgaggaagaaggtcatcatcgacaccgaccccggaatcggtccgtaatacaacaccccgccttatcttcttccaacctcaacctctcgtgtgccgcggtcggctgacggaccagtgcgagtgtccttgggcggcggagcagatgacgcgatggccatcttcgtggcgctgcgctcgccggagctcgaggtgctcggcctcaccaccaccttcggcaacgtccacaccgccctcgcgacgcgcaacgcgctccacctgctggaggctgttggccggaccgacatccccgtcgcggagggatcccatgtaacggtcaagaaagccagcaagctcaggatcgcgagctttgtccacggttcagacggtctaggaaaccaggacttccctgcaccgactacgaaaccgatagatcagacagctgctgccttccttgttgagcagtcaaatctgtaccccggacaagttaccgtcgtcgctcttggtccgctgaccaaccttgctctggccatcgagcttgacccttccttccccaagaagatagggcagattatcattctcggtggtgcatattcggtcaatggaaatgtcaaccctgcagctgaggcaaatatatttggggatcctgacgcggcagatattgtgttcacttgcggtgctgatattttggccataggactaaacgtaacgcaccaagtagttcttacagacgctgaccgggagaagcttgaacaatgtgatagcaaatatgctcactacttatgcaagataatgggcgtctattatgattaccacaaagatgcttacttcataaaaggtttgtatgtatcagtatcatgcagggagggctgaaatgcttcagtcaaattacttgtagaagggacagatcgtaacctggaaaaccttgtggctttacttcacactgaaattcttgcaggagtgtatcttcatgatccgacaacgcttatagctgcagtaaatccgtcgttgatgacttacacagaaggtgtcgtgagggtacagacggttggaataacaaagggtcttacagttttcgacaataccaagaaaaggtacggggagatcacagcctggacgggcatgccgaccgtgaaggttgcggacaccgttgatgcccccgccgtggtggagctgatgatgcagacgcttatgacagatgattaaccatcgaccgctgattagcacgacccaggaagagtcctgattgaagctgatgctgcactatgcacccatgcttctcgaaagaaagctctttgtacttgtaacttggatgatgcgcctctattttgttgagacttctatacagtctataagaaagaaagaaaagcgttggaatgtgc

SEQ ID NO: 19959 - protein, 232 aa, Panicum virgatum
  misc_feature: Ceres CLONE 1809296
  misc_feature (1)..(232): Pfam Name: IU_nuc_hydro Pfam Description: Inosine-uridine preferring nucleoside hydrolase
  misc_feature: SWISSPROT Homolog: EC 3.2.2.8 Ribosylpyrimidine nucleosidase
MAIFVALRSPELEVLGLTTTFGNVHTALATRNALHLLEAVGRTDIPVAEGSHVTVKKASKLRIASFVHGSDGLGNQDFPAPTTKPIDQTAAAFLVEQSNLYPGQVTVVALGPLTNLALAIELDPSFPKKIGQIIILGGAYSVNGNVNPAAEANIFGDPDAADIVFTCGADILAIGLNVTHQVVLTDADREKLEQCDSKYAHYLCKIMGVYYDYHKDAYFIKGLYVSVSCREG

SEQ ID NO: 19960 - DNA, 1557 bp, Panicum virgatum
  misc_feature: Ceres CLONE 1809309
  misc_feature: Encodes the peptide sequence at SEQ ID NO. 19961
aagagcacggaggagccagccagccactcgccattgttgttcctcctcccatctgccgcctcctccgtccaccctgtccacagcttatccaggaaggcacagccaagaaccccagcgtcactcaccagcaacgcaagcttgcgaggcgattaaaggggcagacgacctgctcttccgagagactgctctcgctcactcgcgcggcagctcctcccaaggctcgcgcacaatgtttagcggttgcggtctctttggccgcgcacgccggggccgcggcggcgacctccggaagcgcggggagatgggtggggcgagctcgcgagtggcgccggccgagccggtgggcgcggaggaggcggaggagcagggcggcggcgcggcgcggcagctggcgtgggccgaggtggaggccgccacgagcgggttctcgtcccgggtggtcggccgcggcgggttcagcacggtgtacctcgcctcgctcccggcctcgcgcctcggcgccgtcaaggtccactgcagcagcgagcgcctgcaccgcgccttccgccgggagctcggcgtgctcctctcgctccgccaccagcacatcgtccgcctcctcgggtactgcgacgagcgggacgagggcgtgctggtgttcgagtacgcgcccaacggcgacctccacgagaggctccacggcggcggggctctgccctgggcgcgccgcgtcgccgtcgcgtcgcaggtggccgcggcgctggagtacctccacgagggccgcgacccagcggtcatccacggggacatcaaggcctccaacgtgctcctcgacgccaacctggacgccaagctctgcgacttcggcttcgcgcacgccggcgtctccgccacggcgggcggcggccgcccctcggcgcgcaccgtcatgggctccccgggctacctcgacccccacctcctccgctccggcgtggccaccaagaagagcgacgtgtacagcttcggcgtgctgctcctcgagctcctgacggggaaggaggccgtctgccgcgagaccggacaccggctcaccgccgcggtgggccccatgctcagagacggtgaagtgtcggacgtgctggaccagaggctcggggccgagtacgacgccgcggaggccaccgccgtggcggagctcgccatgcagtgcgtgagcgacgacccggcgctccggccgtccatggccgacgtggtgcgcatgctccaggagaagacctctgccgttggatcgaaatcggaccgcaagatgatgtcctaagttggattcatgtcgtaggatgtaaatactccttgtgggtgctagaattcttcttaggatagttattaggagaaaaatttgcctagtgaggtgaggtagaaaattttaaaattcaagcttgtagatcactagatctgatagaaaattttgtcatgccatggcgtgtttgttgaaccggcgacatcgtggtacttgttcattcatcaatttgccttgttgtcttgttgatatcccgcagtaagtgggtgcaagcaataggtaatttcttattgtcctcg

SEQ ID NO: 19961 - protein, 349 aa, Panicum virgatum
  misc_feature: Ceres CLONE 1809309
  misc_feature (65)..(332): Pfam Name: Pkinase Pfam Description: Protein kinase domain
  misc_feature: SWISSPROT Homolog: EC 2.7.11.1 Non-specific serine/threonine protein kinase
MFSGCGLFGRARRGRGGDLRKRGEMGGASSRVAPAEPVGAEEAEEQGGGAARQLAWAEVEAATSGFSSRVVGRGGFSTVYLASLPASRLGAVKVHCSSERLHRAFRRELGVLLSLRHQHIVRLLGYCDERDEGVLVFEYAPNGDLHERLHGGGALPWARRVAVASQVAAALEYLHEGRDPAVIHGDIKASNVLLDANLDAKLCDFGFAHAGVSATAGGGRPSARTVMGSPGYLDPHLLRSGVATKKSDVYSFGVLLLELLTGKEAVCRETGHRLTAAVGPMLRDGEVSDVLDQRLGAEYDAAEATAVAELAMQCVSDDPALRPSMADVVRMLQEKTSAVGSKSDRKMMS

SEQ ID NO: 19962 - DNA, 1760 bp, Panicum virgatum
  misc_feature: Ceres CLONE 1809311
  misc_feature: Encodes the peptide sequence at SEQ ID NO. 19963
actggctatgcttcttctcccagcttcttccttcctcgtcactgccatccatccatgcacaccttcacacacatacgcatactggcatactgccatggagtagagtagattgtatttaaccttgggttggttgcccttgccctgctgaagatgggagctggagagcaacgagacaagcgcggcggtgcgcgcgcgtcgcgacagctctagaagagaggagagaccgcagcagaagcagccacgctcctaacccccctctctcccctgatcctaatacaaaattcagggcgtcagcaggtgcccccaaaagagatccgctctgatagatggatcccccacgctgcatcgtcgtcagcccaatcattgcctcatttgttcccttcctcctcctcgtcttctcctcctccgtcgtcatcctggcctcggctggaggcggcggcaacggcacggcggcgccgttccggtcggccgaggagctgctccggttccagaggatcaaggcccggctcgccaggaccagggacgcctccgtcaagaccatccagagccccgatggcgatgtcatcgactgcgtgccgacgcacctgcagcccgcgttcgagcatcccaagctcaggggccacaagccagagagagagccagccgagaggccgcggagctgcggtggtcgcgccggcgctgatggtcgagacgacgaggaggcattgccgcaggcgtggcggcgctccggcgagtcgtgcccggaggggacgataccggtgcggcggaccacggaggccgacgtgctccgggccagctccgtcgcccggttcgggatgaaggcccggggcgccggcggcggcggcttcgcgcggcgcgactccaccggcagcggccacgagcacgcggtggggtacgtgtcggggggccagttctacggcgccaaggcgagcctgaacgtgtggccggcgcaggtggcgtcgccggcagagttcagcctctcgcagatctgggtcatctccggcgccttcggcaacgacctcaacaccatcgaggctggctggcaggtaagcccccagctgtacggtgacaacaacccaaggttcttcacatactggacagacgacgcgtaccgggagaccggctgctacaacctgcactgctcggggttcgtgcagacgagcagccgcgtggccatcggcgccgccatctcgccggcctcgtcctacggcggccggcagttcgacatcgccgtgctcatctggaaggacccgcggcggggccactggtggctgcagctcggctccggcggcgcgctcgtcggctactggccgtcctcgctgttcacgcacctgggctcccgcgccgacatggtgcagttcggcggcgaggtcgtgaacgcgcggccggccggcgcgccgcacacgcccacgcagatgggctccggccgcttccccggggaagggtacgcgcgcgccgcctacttccgcaacctgcaggtcgtcgactgggacaacagcctcgtgcccgccgcggggctccgcctcctcgccgaccggccggggtgctacgacatcgccggcggcagcggcggcgcctggggcacctacttctactacggcgggccgggcaggaacgcacggtgcccgtaggttgcaggacggagtagctaggaacggtaccggatgggtgtttctttctttacgtacgtgctgatcactgatcaagaacaagacaaatatatgtggcaaaattaaagctttgattcttttttccccttc

SEQ ID NO: 19963 - protein, 434 aa, Panicum virgatum
  misc_feature: Ceres CLONE 1809311
  misc_feature: Functional homolog of the protein sequence given in SEQ ID NO 50345
  misc_feature: Useful for biocontainment applications
MDPPRCIVVSPIIASFVPFLLLVFSSSVVILASAGGGGNGTAAPFRSAEELLRFQRIKARLARTRDASVKTIQSPDGDVIDCVPTHLQPAFEHPKLRGHKPEREPAERPRSCGGRAGADGRDDEEALPQAWRRSGESCPEGTIPVRRTTEADVLRASSVARFGMKARGAGGGGFARRDSTGSGHEHAVGYVSGGQFYGAKASLNVWPAQVASPAEFSLSQIWVISGAFGNDLNTIEAGWQVSPQLYGDNNPRFFTYWTDDAYRETGCYNLHCSGFVQTSSRVAIGAAISPASSYGGRQFDIAVLIWKDPRRGHWWLQLGSGGALVGYWPSSLFTHLGSRADMVQFGGEVVNARPAGAPHTPTQMGSGRFPGEGYARAAYFRNLQVVDWDNSLVPAAGLRLLADRPGCYDIAGGSGGAWGTYFYYGGPGRNARCP

SEQ ID NO: 19964 - DNA, 1506 bp, Panicum virgatum
  misc_feature: Ceres CLONE 1809323
  misc_feature: Encodes the peptide sequence at SEQ ID NO. 19965
gtgtctggcctttcccagtccaaacccctcccatcccgagcggcggctgcggcggcgcaagaggctgccacggccagacctacggcggcggtggcgggcctcgccggccatcctacgcgatcgaggttcgttctcggcgcagcttgtttgaggggaaatcggcatggaagagatggatcgcccagaaggttccgttcccgagcgcggagaagagcagccggaggcgcccctgccgctgccgcccgccttcctcgagttcctcagcgagaacggcctggacccagcggtgtactccacggcggccaccatcccgcgctacataaggctaaagccaggcatggagtcccagatagcggagatcgaaggcgagttgaagtgcggtctcgagaaggtttcatggctgccaggattctacgcgatcccgcccgaagttcagattgccggcaccaaggcttatcagcaagggaagatctatggaatcgatgcagcttctggagctgctatattagcacttgacgttcaaccaggagaccatgttctcgatctctgtgctgccccaggtgcaaaactttgcatgcttgcagatatgcttggaagcacgggttctctgactggcattgatgttgcaaagcaccgtctttcagcctgtcgtacaatgttgcagaagtattctcttggtgaccgtactcgcctctttgttgctgatggaactttgttttccattttgcctgtgaactctaacctgcgaagaatggaaggatcaattgaccttgaagaaagtggaagtacattctcagaatggacttcaaggaggacatggaaggatcgacagaaggctaagaaagcaaatgcaactggttcacaacatctactggcaccttcagaacctgaactaatatactatggtaaacattcaggattggttggactgcgtaaatctgatgttctttgtccagcagttaatgatgaagcctgtacatctggctatgataaggtcctagtggatgcagagtgtactcatgatggatccataaaacacatccagaaatttgagttctggggatggaaaactttagatcgccgtgtactcgatgctgaaagaactgataacctgcttcagcttcagttaaatcttctctccaatggttttagattgttgaaaactggtggatcccttgtatatagtacttgcagtttgacagttgcacaaaatgagaacgtggttcagcaattcctttcaacacagccttcagctgatttacgaaaaattggtttggcgaatacttggccctgcagaagtggtggcatccccaagaccttgcgatttgatcctgtaacttcgcaaaccagtggtctttttgttgccaagttcagtaaactatcgacataaagcattttctggtttatcttcctgtaccatctatgtcctacttactccccttttcacttgaaacactggctttccttgccagcaacaaaaatgataaaatagtacaagttggtttt

SEQ ID NO: 19965 - protein, 408 aa, Panicum virgatum
  misc_feature: Ceres CLONE 1809323
  misc_feature (41)..(404): Pfam Name: Nol1_Nop2_Fmu Pfam Description: NOL1/NOP2/sun family
  misc_feature: SWISSPROT Homolog: EC 2.1.1.29 tRNA (cytosine-5-)-methyltransferase
MEEMDRPEGSVPERGEEQPEAPLPLPPAFLEFLSENGLDPAVYSTAATIPRYIRLKPGMESQIAEIEGELKCGLEKVSWLPGFYAIPPEVQIAGTKAYQQGKIYGIDAASGAAILALDVQPGDHVLDLCAAPGAKLCMLADMLGSTGSLTGIDVAKHRLSACRTMLQKYSLGDRTRLFVADGTLFSILPVNSNLRRMEGSIDLEESGSTFSEWTSRRTWKDRQKAKKANATGSQHLLAPSEPELIYYGKHSGLVGLRKSDVLCPAVNDEACTSGYDKVLVDAECTHDGSIKHIQKFEFWGWKTLDRRVLDAERTDNLLQLQLNLLSNGFRLLKTGGSLVYSTCSLTVAQNENVVQQFLSTQPSADLRKIGLANTWPCRSGGIPKTLRFDPVTSQTSGLFVAKFSKLST

SEQ ID NO: 19966 - DNA, 527 bp, Panicum virgatum
  misc_feature: Ceres CLONE 1809334
  misc_feature: Encodes the peptide sequence at SEQ ID NO. 19967
tcctctggagctgtggacttgtacccgcggccgagcccgcatggccctggccgcggtgtactgctgcctcctgcctacctgtgttggggggtgggcggctcactcaactactatcacttgcactccagccaccacctgtcccctcccactcccaggccctgaacaccaagcatggcggccgccgccttggtgcccaagccgcctccttctcttcctacgaacgcctttccctcctcctcatccccctcctgctctttccgcgagcatcccctaaaataaagaataagcatgccccgacctcttgtgtgcgaccctccaccgtcctccgtctggatgcccgatcccgaccagcagcctgagcccgccctccacaaccacaccgcgcccgagaccaggccccgccacatcgccctcttcttcgagccctcgcccttcccctacgtctccagctacaagaaccacttccagaacttcatcaagtacctccgggagatactctacgatgtgattgtgcacaccactcatga

SEQ ID NO: 19967 - protein, 79 aa, Panicum virgatum
  misc_feature: Ceres CLONE 1809334
  misc_feature: Functional homolog of the protein sequence given in SEQ ID NO 50890
  misc_feature: Useful for making plants with altered carbohydrate content
MPRPLVCDPPPSSVWMPDPDQQPEPALHNHTAPETRPRHIALFFEPSPFPYVSSYKNHFQNFIKYLREILYDVIVHTTH

SEQ ID NO: 19968 - DNA, 733 bp, Panicum virgatum
  misc_feature: Ceres CLONE 1809335
  misc_feature: Encodes the peptide sequence at SEQ ID NO. 19969
attaagcagcaagcaaagcgccactcgcaatcccgcaggcctcagatctctccgccccgtctccctcctcccaccccccaaaccctcgccccgccctcccctcgtcaacgccgcccgacgagagcgatggcggcctcgccggccgcggccgcggcgctcctcgccctcctcgccctcgcggcggccggcggcgtggcggccgacggctccgaccaccgctacaaggccggcgagcccgtcccgctctacgccaacaaggtcggccccttccacaaccccagtgagacgtatcggtacttcgacctgcctttctgctctcctgagaaagtgaaagataagagcgaggcccttggtgaggtcctcaatggggatcgcttggtcgatgcaccttacaagcttgatttccgtgtggacctcgaatccaagccggtttgctcaaagaagctcacaacggaggatgtggccaagttccggaatgcagtagctaaggactactacttccagatgtactatgatgatctcccactatggggtttcattggtaaagttgagaagggaggcaaggccgacccaagcgagtggaagtactacctatacaggcacatcatctttgatatcctctacaacaacgaccgggtcatcgagatcaatgtgcacactgatcagagtgcattggttgacctgacggaggataaggagaccaatgtagaattcctttactcggtcaagtgga

SEQ ID NO: 19969 - protein, 202 aa, Panicum virgatum
  misc_feature: Ceres CLONE 1809335
  misc_feature (53)..(202): Pfam Name: EMP70 Pfam Description: Endomembrane protein 70
MAASPAAAAALLALLALAAAGGVAADGSDHRYKAGEPVPLYANKVGPFHNPSETYRYFDLPFCSPEKVKDKSEALGEVLNGDRLVDAPYKLDFRVDLESKPVCSKKLTTEDVAKFRNAVAKDYYFQMYYDDLPLWGFIGKVEKGGKADPSEWKYYLYRHIIFDILYNNDRVIEINVHTDQSALVDLTEDKETNVEFLYSVKW

SEQ ID NO: 19970 - DNA, 1592 bp, Panicum virgatum
  misc_feature: Ceres CLONE 1809354
  misc_feature: Encodes the peptide sequence at SEQ ID NO. 19971
aaggaactctccacgcccccgcgctctcccaggacagttccgtcagccagtcccgcccgcccctcacctcccgctcgccggaggctcggccgcggccggcggcgatggggcacggcgccagctgcggccgccccagcgaggaggtggacttcttcggcgccgcgcagtccggcgacctcgcccgcctcgccgccgccctccgctcccgccccaccctgctcagccgcaccacgctcttcgaccgcctctccgcgctccacatcgccgccgcccacggccaccgccaggtggtctcgctggcattggatctttgcgtgcacccggatgtcgttaaccgccacaagcagacggcgctgatgctcgcggcgatgcacgggaagacggactgcgttcggcggctgctcgacgccggcgccaatatcgtgatgttcgattcgtcgcacgggcggacgtgcctgcactacgcggcgtactacggccacgcggactgcctccgggccatcctctcggcggccaagtccgcgccggtgtcggaatcctgggggttcgcgcgcttcgtgaacgtgcgggacgacgccggggcgacgccgctgcacctcgcggcgaggcagggctggcggcgctgcgtccacgtcctgctcgagaacggcgccatcgtgtcggcctccagcggcgccttcggattccccgggagcacgccgctgcatttggccgcgcgcggcggcaacctggactgcgtccggcagctcctctcctggggcgccgaccgcctccagcgagactccgtcgggagaatcccgtacgaggtcgccgtgaagcgagggcacgtcgcgtgcgcggcgctgctgaacccgtcgtccggggagcccctggtgtggccgtccgcgctcaagttcatcagcgagctcgagcccgacgccaagtccctgctcgaggcggctctgatggaggccaacagggagagggagcggaggatcctcaaggggaccaagaatgcattgccgtcgccgccgcattccgacgacggtgctcacgacgccgccatagctgaggctagcgacgcggaggtgtgcagcatctgcttcgagcaggcgtgcagcatcgaggtccgggagtgcgggcaccagatgtgcgcggcgtgcacgctggcgctgtgctgccacgccaagcccaacccggcgacgcagtcccagccgctgccgacctgccccttctgccgcggcgggatcgcgcggctggtggtggcgacgcgggcgcgggccggcgacgacgaggaggaggaggaggggagcaggctggagtcgcccaggcaccggcggtcgcgccggtcgacgaacctcagcggcgacgcgggcagcaccagcagcctcatgggcagcatcgcctcgtccatcggcaagatgggccgccggcgaacggacagcagcgagcaggtcgacgacaagccgtagcaaagcattctttgctgcctcccccggcgtccatccattcagaagaaaccagtgcatatacgatcatcatcgccgccgccatcgatcatggaacgagcaagccgcggtttttgtagattatttttggcaaatgagttattc

SEQ ID NO: 19971 - protein, 448 aa, Panicum virgatum
  misc_feature: Ceres CLONE 1809354
  misc_feature (195)..(227): Pfam Name: Ank Pfam Description: Ankyrin repeat
  misc_feature (79)..(111): Pfam Name: Ank Pfam Description: Ankyrin repeat
  misc_feature (158)..(190): Pfam Name: Ank Pfam Description: Ankyrin repeat
  misc_feature: SWISSPROT Homolog: EC 2.7.11.1 Non-specific serine/threonine protein kinase
MGHGASCGRPSEEVDFFGAAQSGDLARLAAALRSRPTLLSRTTLFDRLSALHIAAAHGHRQVVSLALDLCVHPDVVNRHKQTALMLAAMHGKTDCVRRLLDAGANIVMFDSSHGRTCLHYAAYYGHADCLRAILSAAKSAPVSESWGFARFVNVRDDAGATPLHLAARQGWRRCVHVLLENGAIVSASSGAFGFPGSTPLHLAARGGNLDCVRQLLSWGADRLQRDSVGRIPYEVAVKRGHVACAALLNPSSGEPLVWPSALKFISELEPDAKSLLEAALMEANRERERRILKGTKNALPSPPHSDDGAHDAAIAEASDAEVCSICFEQACSIEVRECGHQMCAACTLALCCHAKPNPATQSQPLPTCPFCRGGIARLVVATRARAGDDEEEEEGSRLESPRHRRSRRSTNLSGDAGSTSSLMGSIASSIGKMGRRRTDSSEQVDDKP

SEQ ID NO: 19972 - DNA, 694 bp, Panicum virgatum
  misc_feature: Ceres CLONE 1809356
  misc_feature: Encodes the peptide sequence at SEQ ID NO. 19973
cccgtttcatcctccatcttcccttcacggggagggtcagagccgccaccggtgctcccaggggtcgccgcccccaggattcgccgccgtctctaggaggccgccgcccaaggaatcgctgcggctgcccccagcagctgccgcctccaggagccgtgggccgccaccccaaggagccgctgcggcccccagcagcagccgaccccaggagccgacgctgcccccagcagctgcactccccccaggcccctacacgcgagatccagaggctcctggggagagtgcgtccaggacagagcgcagaggcaacagcagcatccccttcgtctagatctgagaagcgtagcatggcgaagctcaagccaaaggcgttgctggcacaaagcaaagtgaagaagggccctagccaaatcagtgtgattacgatcttcacctacttggtccttggtgtcgtagtcgtatcctctgtttattctgcttacaaatactgggtaggcaaaggaccagaagtgacagcagcaggcgtcgaggggaattaaaccccaaactatgtaactgattttgttgttgtatcatccagttggataattttggttgctgcagcccagttaatggaacatggatagattgtatcttgctacaggtttattgtaaaccgtggggacattatagcaagagcctcctctccactcct

SEQ ID NO: 19973 - protein, 63 aa, Panicum virgatum
  misc_feature: Ceres CLONE 1809356
  misc_feature: SWISSPROT Homolog: EC 5.2.1.8 Peptidylprolyl isomerase
MAKLKPKALLAQSKVKKGPSQISVITIFTYLVLGVVVVSSVYSAYKYWVGKGPEVTAAGVEGN

SEQ ID NO: 19974 - DNA, 683 bp, Panicum virgatum
  misc_feature: Ceres CLONE 1809372
  misc_feature: Encodes the peptide sequence at SEQ ID NO. 19975
atccaactcaaagttcacacttcaaacactcactgccatctgctaagcaaaacgaagcagaacatggctgccggctgggcagaggtgacagttaagtgcctcgtgcattacttcaagcaaccggcaaaagcgaaactcgccgtgattatagtagtgccatttctcctgctgtgttatggacttggcaacgtccatagctcgatagttcatgagaacagagaagatcttcgcgccctgcttgacttcaagcatggtatcaccagcgatccatatgatgccttgcgcaactggaatggagtgaactgcaccttaactcgaccatggcgtgtcacggtgctcaatctcaccaggcaaaacttggttggccaaatctccccgtctcttggaaacttaacctttcttaacatgcttgttctatcccacaaccttttgcatggaatcatacccgattcacttacaaactgttccaatttgaactatttattcctatcttacaacaaccttacgggtgcgattcccactagcataggctttctttcaaaattaatctccttgcagattcacagaaataatctcgttggtcttatcccgcctgcgataggaaacattagcactttaaaatcacttgaccttggagaaaatcaattgaacgggccaattcccgacaagctttggcagctacg

SEQ ID NO: 19975 - protein, 206 aa, Panicum virgatum
  misc_feature: Ceres CLONE 1809372
  misc_feature: SWISSPROT Homolog: EC 2.7.11.1 Non-specific serine/threonine protein kinase
MAAGWAEVTVKCLVHYFKQPAKAKLAVIIVVPFLLLCYGLGNVHSSIVHENREDLRALLDFKHGITSDPYDALRNWNGVNCTLTRPWRVTVLNLTRQNLVGQISPSLGNLTFLNMLVLSHNLLHGIIPDSLTNCSNLNYLFLSYNNLTGAIPTSIGFLSKLISLQIHRNNLVGLIPPAIGNISTLKSLDLGENQLNGPIPDKLWQL

SEQ ID NO: 19976 - DNA, 1709 bp, Panicum virgatum
  misc_feature: Ceres CLONE 1809421
  misc_feature: Encodes the peptide sequence at SEQ ID NO. 19977
acccacgcgtcctcctccgagggcgacggcgtgccaccacgccatgccgctgcgcgactgcaacgtgctgatcaggaccctggccaggcgcggcagcttcccgcacgtcatggcggtgtactacgacctccgcgcgcgcggcctcgtcgccgacagcttcacctacccgttcgtgctcagggcgatcggcgtgatgaagctgtccgtcgaggggcgcaaggcgcacgcggccgccgtgaagaccgggttccggtgggacgcgtacaccgcgagctcgctgatcgacatgtactcgatgctgggccacgcggaagtcgcgcggaaggtgttcgacgaaatgccgcagaggttcctggtgctgtggaatatgatgatcaggtgctacatcaggagcggccgcttcaaagcagcagttgcgttggctgaggagatggagagaagcggcgccgcacctgacaggatcaccttggtgactgccatgaccgcttgctccagggcaggagacctgagcttgggaaggaggatccacgcatacatggatgcagtctttggattcagcctcccagttgcaaatgcgcttctggacatgtatatgaagaacagttgcttggaagaggcagtgaagatgttcgagcagatgccggagaagaacatcatttcttggacgatcctcgtgtcgggatacgcccttggtggtcagctggacaaggcaagagcactcttctatcaatgcattaagaaggatctaattctgtggactgcaatgatcaacgcttgtgtgcaacatgggagctttgaggaggcattggcactgttccgagacatgcggttgcaacgggtggaaccggacaggttcactgttgtcactctcctgacatgctgtgccaatatcggggctcttgatcaaggtgaatggatccatcagtatgctgaggggaggaagatgaagatcgatgcagttctcggcacagcattgattgagatgtactcgaagtgtgggcatgttgacaaggcactgcatgtctttgagcgaatgcagggcaaggacgctgctgcctggactgccatcatctgtggcctggccgcacatggtcaggccagtagagctcttgaattgtttgaggagatgcagataagcaaagtgaagcctgatggtattactttcattggggtactgagtgcctgttgccatggtggcttggttgatgatggacgcaagcatttccaagccatgaaacaggtctatcagatagaaccgagaatcgaacactatagttgctttgtcaatcttctaggtcgtgccggtgcactagatgaagccgagaggttgatcaatgacatgcctgtaaacaaggacactatgccactgtttggtgcactcctcacagcttgcaaggctcatggcaatgttgagatgagcgaaaggctggccaaacgaattgccgagcaagattcccgaaaccctggtgttaatgtcctcatgtctaatgtgtatgcaacagctagtcgatgggaggaagcaataagagtaaggagcgagatggcgcaccccactgtcaagaagactgcagggtgcagctcgattgaggtaaaaggatgctgagatggaaccaatattgggatatatctaatgtttcagaatcagaatggttaagcattcaccacgttcaattaatcacaatgtgttgaccaacagcatgcttgatcat

SEQ ID NO: 19977 - protein, 519 aa, Panicum virgatum
  misc_feature: Ceres CLONE 1809421
  misc_feature (236)..(270): Pfam Name: PPR Pfam Description: PPR repeat
  misc_feature (337)..(371): Pfam Name: PPR Pfam Description: PPR repeat
  misc_feature (105)..(139): Pfam Name: PPR Pfam Description: PPR repeat
MPLRDCNVLIRTLARRGSFPHVMAVYYDLRARGLVADSFTYPFVLRAIGVMKLSVEGRKAHAAAVKTGFRWDAYTASSLIDMYSMLGHAEVARKVFDEMPQRFLVLWNMMIRCYIRSGRFKAAVALAEEMERSGAAPDRITLVTAMTACSRAGDLSLGRRIHAYMDAVFGFSLPVANALLDMYMKNSCLEEAVKMFEQMPEKNIISWTILVSGYALGGQLDKARALFYQCIKKDLILWTAMINACVQHGSFEEALALFRDMRLQRVEPDRFTVVTLLTCCANIGALDQGEWIHQYAEGRKMKIDAVLGTALIEMYSKCGHVDKALHVFERMQGKDAAAWTAIICGLAAHGQASRALELFEEMQISKVKPDGITFIGVLSACCHGGLVDDGRKHFQAMKQVYQIEPRIEHYSCFVNLLGRAGALDEAERLINDMPVNKDTMPLFGALLTACKAHGNVEMSERLAKRIAEQDSRNPGVNVLMSNVYATASRWEEAIRVRSEMAHPTVKKTAGCSSIEVKGC

SEQ ID NO: 19978 - DNA, 350 bp, Panicum virgatum
  misc_feature: Ceres CLONE 1809455
  misc_feature: Encodes the peptide sequence at SEQ ID NO. 19979
gtgcggcctcctgggacgcgctagcttagccccggtccaccccacgcgctgcctcacggggggcgaccccgtggccgtcaaggtgctcgaaaagcccgggctggccgctacgggcatggcggcgagcgtcctgcgcgaggtctctgccatacgcctcctccgccaccccaacatgatccgcctccacgaagtgctctgcacgcgctccaaggtgtacctcgtcatggagctgacccccggcgtggaccatgtgttacgtctcgtcactgtgaccgggtgctagctcctcgagaccgtcgcgcgcagcgtcttcctgcatctggtgtctgcactcctctacatccacgcgc

SEQ ID NO: 19979 - protein, 93 aa, Panicum virgatum
  misc_feature: Ceres CLONE 1809455
  misc_feature: SWISSPROT Homolog: EC 2.7.11.1 Non-specific serine/threonine protein kinase
CGLLGRASLAPVHPTRCLTGGDPVAVKVLEKPGLAATGMAASVLREVSAIRLLRHPNMIRLHEVLCTRSKVYLVMELTPGVDHVLRLVTVTGC

SEQ ID NO: 19980 - DNA, 669 bp, Panicum virgatum
  misc_feature: Ceres CLONE 1809471
  misc_feature: Encodes the peptide sequence at SEQ ID NO. 19981
aatcaattcctctgtccgactgtccccgttcagctccgtttcaacgcaagcccaccaggggagggagcgatccgaatccatccatccggcccggtccccttcgattcgatcaaccaagaggcaaacgaatcccccgctcggggtcgaggcggcggcggagggagagccgtgaatggcgctgccggtggcgaagctgggaaccttggcgctgcggaccctgtccaagcccatcgccagccgcctcaagagccaggccgccgtccattccaagttccgcaacttcatcatcgccatcgctcagatacaccatcgtatcaccacaaagattcaaaggcgcatttatgggcatacaacagatatggagatcagacctttaaatgagcagaaagcagtacaagctgctacagatctcattggagaagcctttatcttttcggtagccgttgctgctttaatttttgaggttcaaagaagtgcaaggtcagaggctaggaaggaggaagctcgtaaacaggaacttgaggaattgaaacaaagagaagagagtttagcaaaagaattggagaatcttaaattgaagctcaatgaaatcgagcagcttgctaaaggacgaggcctaacaggaatccttaacttcaaaggggtccatgtggcagaaggcggaaagac

SEQ ID NO: 19981 - protein, 165 aa, Panicum virgatum
  misc_feature: Ceres CLONE 1809471
  misc_feature (4)..(136): Pfam Name: OPA3 Pfam Description: Optic atrophy 3 protein (OPA3)
MALPVAKLGTLALRTLSKPIASRLKSQAAVHSKFRNFIIAIAQIHHRITTKIQRRIYGHTTDMEIRPLNEQKAVQAATDLIGEAFIFSVAVAALIFEVQRSARSEARKEEARKQELEELKQREESLAKELENLKLKLNEIEQLAKGRGLTGILNFKGVHVAEGGK

SEQ ID NO: 19982 - DNA, 708 bp, Panicum virgatum
  misc_feature: Ceres CLONE 1809474
  misc_feature: Encodes the peptide sequence at SEQ ID NO. 19983
ccatttttcccctcgccgacgtcagagcagatccgccgccaccggcgctcctccggccggctgagaggagcgctccggccacctggcttcgtcgatggcgtcgccggggccgtcccccgctccggccagccgatccgagcgccggcgtgcgcccggcgcctccaacgccggcgtgctgcccccgccacgccgctcatccggccggctgagaggcaggcccgcgcgctccggtcaccaggctccgtcgatgccgccgctcggccgctccgggccgcccgccgcctccgacgccgccggcgtgctgcccccggacgtgctgttcgacgtcctgctgcggctgcccgccaaggagctctgccgcctccgtgccgtctgccgctcctggcgctccctcgcctccgacccgctcttcatcagagagcacgcggcgcgccaccgggacccgctcttcctggccaatttccgggacgacaaggcgcacgtccatgtcgtcgatctgtccggcagggtggtgaagcggatacccaacggggacggccacgagctgctctctacgcgcctggacctggcctgcgtggtgacggtgaggaacagctgccgcgtgctcgatccggctaccggaagtgttcacgtcctgccgagcccccggcggctgttcatttgaatgaagaaaatttagctgttcatttcaatgaagaaaatttaatc

SEQ ID NO: 19983 - protein, 138 aa, Panicum virgatum
  misc_feature: Ceres CLONE 1809474
  misc_feature (14)..(61): Pfam Name: F-box Pfam Description: F-box domain
MPPLGRSGPPAASDAAGVLPPDVLFDVLLRLPAKELCRLRAVCRSWRSLASDPLFIREHAARHRDPLFLANFRDDKAHVHVVDLSGRVVKRIPNGDGHELLSTRLDLACVVTVRNSCRVLDPATGSVHVLPSPRRLFI

SEQ ID NO: 19984 - DNA, 2463 bp, Panicum virgatum
  misc_feature: Ceres CLONE 1809475
  misc_feature: Encodes the peptide sequence at SEQ ID NO. 19985
gtgtgtcgctcaagtagcagcattgccccccgccaccagtccaaatgcagtactagcagccaacaataaaagtcaggggaggctgagtggtggcaagacgggagagggagcccaaacgcaaggccgacgctgatctgattggtggggctgacagctagctaggaaagtatttcccaaagttgtggtctttcggctgcagcgctcttcaggtggtgtcattgtcaaacattgtgatggcgggtgctgatcctccatctgcatgtgacggcgcctacctgctgttccatggcgagaccttgctttcgaacggtgtccgcgccactctctacacggttgcgcttgcgtactgcttcatcgggctatccgcgatcactgcccggttcttcaaatccatggagcagatcatgaagcactccagggaggtggtcagtgtggacccacacaccaacatgcctgttgtgaagcaagagaaggtgtggaactacacgatagcggacatcgctctccttgcttttggcaccagcttccctcagatctctctggctacaatcgacgcgatccgtaatctgggtcaactgacagcgggaggtctaggtccgagcactctcgtgggttctgctgcatttgatatgttcccaatacatgctgtctgtgtggttatgccaagggcaggctctaagaaaaagatctcagacttgggcgtttggctcgttgagctgttctggtctttctgggcatacatttggctgtattttatcttagaggtgtggacacctggagtaatcaccctctgggaggccttgctgacaatcttgcagtatggattgcttctgctccacgtatatgcacaagataagcggtggccatatgtatcaatcccttttgccagaagttataggcctgaagattgggttccagaagaaaatgcttcagttgattatgacaactgtgatgaaattagtgacacactccctgtaagcgttgacaaggacattctggatatatatggctcctaccataatgcagagtattgtaaagttcctgaaaaggatatagagggatcatcaacaatgaatgatgctgtgatgaacacgcaagaggacacatcgtggctttttatatggtggcgacggtttctctgtgcttttaatgtaacttaattcaaacttgctctgcctgatattttttttctactgtttgcatttggttaaacattccttgtggaatacttatttcagttattggacaaatgtggctaagcttttaatacatgttttgctgtcagcataacaatcactgtataaaaactaagtatgctcaaagcttttattttgcacacaattgataacagtaatttatatgtgctgccaaggtaaatttgttgcccactaacgttcgagaaaaaaaaaattgtggcccactaccttattaagctgatatttatttatttattgtaccctgttttcccagataacttggacaaaatgcatcttatctcgagttcaataagacttacatctaaacaatagccattttgtcaatcttcaaaatgcaccaaatattaacttacacttaccgaacatttatttgatattttttgatttactaattgatttggtgaacctatgcagttagagagccctgagtcaaggaagatggattccatctacctgaggatcaccagaatatttttcaacttgttcattttaccttggaaactattatttgcttttgtacccccatatcacattgcgcatggctggatcgcttttatatgctccctggttttaataagtggtattgcttatggtgttactaaacttacagaccaaataagctgcgtcacaggaataagttcatatgttatagcatttacagcactagcaactggaacctcatggccagatctagttgctagcaagatagctgccgagcgtcaagtcactgcagactctgctatagccaacatcacttgcagtaattcggtgaacatatatgttggcattggcatcccgtggttgatcgacacagtgtacaacttctttgtctaccaggaaccactgtacatagacaatgctgctggtctgagcttctcccttctaatcttctttgcaacatcgttcggctgtatcgtggttttcgttctccgtcgcattgtacttggtgccgagcttgggggccctaggttatgggcttgggcgacatcggtgtactttatggccctctgggttgtttttgttgtattttcctctttgagagtttctggaataatataggctgaaaacataggcggttaatttttcttttttctttttcatatttgttactgtttgtcttcatatccacacagaaagtgtggaggtgaaattaggaattatagtatagatgtttgatttgtgtaatgattatttaagccagagatatgttgtatagttgcacaattgttgaatcttaattgttgtg

SEQ ID NO: 19985 - protein, 308 aa, Panicum virgatum
  misc_feature: Ceres CLONE 1809475
  misc_feature (41)..(203): Pfam Name: Na_Ca_ex Pfam Description: Sodium/calcium exchanger protein
MAGADPPSACDGAYLLFHGETLLSNGVRATLYTVALAYCFIGLSAITARFFKSMEQIMKHSREVVSVDPHTNMPVVKQEKVWNYTIADIALLAFGTSFPQISLATIDAIRNLGQLTAGGLGPSTLVGSAAFDMFPIHAVCVVMPRAGSKKKISDLGVWLVELFWSFWAYIWLYFILEVWTPGVITLWEALLTILQYGLLLLHVYAQDKRWPYVSIPFARSYRPEDWVPEENASVDYDNCDEISDTLPVSVDKDILDIYGSYHNAEYCKVPEKDIEGSSTMNDAVMNTQEDTSWLFIWWRRFLCAFNVT

SEQ ID NO: 19986 - DNA, 1886 bp, Panicum virgatum
  misc_feature: Ceres CLONE 1809484
  misc_feature: Encodes the peptide sequence at SEQ ID NO. 19987
atagctggggagtagttcactgccccctacctctcctctcctcccccctcctccccgtcgcgtcgcccatcctcctacgtctccctcctctccccgctgccgcttcctcccagcgggagcggaagcgcgcaagcaatcgccggccttttcttggcgtgcacagctcctgatcggagggcccccgcgggatctcgcttgctggcctggccccgcgggattggggcggggcggctggattcggagccgctgcgggtggtgccggcagtttgaagccggtccggtgtctggtgcctgatttgatctgcagcggcagcggaggcccggcatggcggcgccgggagggctcgagcagtggcagaaggacgggttcttccaggccgccgaggaggtgcaggagtcggcggacttgatggaatctatctatagaacttggatgcgagaacgcagtaatggttctagctcagaggaggcaaatgatttgcaaagggagctacagacagctttagggactgcaaaatggcagttggagcagtttgagagagctgtaagttcaagcaagaataagtattcactggaagagggtacagtggccagacgtcggcagtttgttgtagcaatcgaggatcagatttctcgtgtggagaaagaaataaacggttcttcaatggacagtggcaggcaagggctcaactgggtgaagctagatgatgaggagcgagatgacctagttgctttcctttcagtacctgcagagtttttttcaggaatgagcacagacaatagttaccatattccatctagaaaaaagaatgtgccaattggcatgaatgatgacaaagatgcagctctgatcattaaagacatttacgaagtaccacgcaggcaaatttctagtgctaagagtgatgtttgtggtctagttgaccagttacatggccaaagaacaaatttgagttctggtgatagtcattggaagattgacatctgtaatgagatggatgatgataaaaaatcatctccaaacggggttgaggcctcaaatcagacaactgctttatcaggcatccggagaagcacagaatctttaacaagaatgagatggttctggaatagcttgtggaaacccaagagtgctgaacatcgtccaataagatacgatatgccaaataatctcgacttcagggttctgtccttattaacacagagatttaatgggcttactgaaagaagcagaaattatttaacaagttggaaggagaattccagaatttcttcaaggacttgtgggcttcatatacaaggccaacagcaggccatgcagtttggccgttctattcggataaccctcttactggtgttgagtgtctttctgattgtaccctttctggtctcctctgcatgactaggcttaaatcgtttcactggtgatgcaacctttggctcaattaatcatgattctgctgttcagagaagcgttcaacattatactgcaaatcatgattggtgctatttcacaagcccatgcaaacgccacaaaccgaggttgtatggctgcttgaaaatgagcacaatggcaagggtcttgactgtgcaaggatgactcagtacattgtaaactcctcaccagcgcataaccatactgaagttaaccagatttagtgtcgattcatgctctgttctgatggtggctggtttctgccaaatatgggcatctcctcacctgtttcccccacgaaggaaattgtaaaaagatatagagctgatcggaaaagatacagaaaagatgtgtccaatggttgatttatatgatttgtgtaagaaaagttgtgtcaaatgaccgatttatatgatttgtgtaagtaatacgtgcttaggcacggtcgtgg

SEQ ID NO: 19987 - protein, 358 aa, Panicum virgatum
  misc_feature: Ceres CLONE 1809484
  misc_feature (13)..(106): Pfam Name: Syntaxin-6_N Pfam Description: Syntaxin 6, N-terminal
MAAPGGLEQWQKDGFFQAAEEVQESADLMESIYRTWMRERSNGSSSEEANDLQRELQTALGTAKWQLEQFERAVSSSKNKYSLEEGTVARRRQFVVAIEDQISRVEKEINGSSMDSGRQGLNWVKLDDEERDDLVAFLSVPAEFFSGMSTDNSYHIPSRKKNVPIGMNDDKDAALIIKDIYEVPRRQISSAKSDVCGLVDQLHGQRTNLSSGDSHWKIDICNEMDDDKKSSPNGVEASNQTTALSGIRRSTESLTRMRWFWNSLWKPKSAEHRPIRYDMPNNLDFRVLSLLTQRFNGLTERSRNYLTSWKENSRISSRTCGLHIQGQQQAMQFGRSIRITLLLVLSVFLIVPFLVSSA

SEQ ID NO: 19988 - DNA, 1400 bp, Panicum virgatum
  misc_feature: Ceres CLONE 1809489
  misc_feature: Encodes the peptide sequence at SEQ ID NO. 19989
aaatcatatcacttgcgtttattaatacagactgaacttcagttcagggggaaaaaaagtactcctatgtactagaattcggacaggagatcgacactgtctaggtgccacctcagtgttgcggcctacaccggtcagttacgtgttatgtccattgatttcctgaatttttagtgcacttggttgctcttctctctcacatcagtggatagtgagatagtccaagtcttcccctttgctgagctccatcaggagctagccaatatccatccatcgttggctcgtcccatcgagcatcaaccgagatgggcgccgggtcgtcggtggacttgccgcagctgctgtgctgcgcgtgcgtggagcagtcgacggtggccatggaggagacgtgcgggcgctacgacacggtgctggacccgggctgccacttcatgccctggtgcgtcggccggagggtcgccggctacctctccctccgcgtgcagcagctcgacgtccgctgcgagaccaagagcaaggacaacgtcttcgtcaccgtcgtggcgtccgtgcagtaccgcgccctggcggacagggccttcgacgccttctaccgcctcagcaacgcccgcgagcagatccagtcctacgtcttcgacgtgatccgggcgagcgtgccgaacatgaacctggaccaggtgttcgagcagaagaacgaggtggcgcgggcggtggaggaggagctcgccaaggcgatggccatgtacgggtacgagatcgtgcagacgctgatcgtggacatcgagcccgacgaggtggtgaagcgcgccatgaacgacatcaacgcggcggcgcggctgcgcgtggcggcggcggagcgcgccgaggccgacaagatccagcaggtgaagcgcgccgagggggaggccgagtccaagtacctggcgggcgtcggcgtcgcgcgccagcgccaggccatcgtcgagggcctccgccgcttcgtgcccgacgagaagtccgtcatggacatggtcctcgccacgcagtacttcgacaccatcagggacatcggcgccacgtcgcgcgctgccaccgtcttcatcccgcacggccccgccgcggtgcacgacgtcgccgcgcaggtccgcgacggcgtgcttcaggccgccgcgcacgcacccgcacccgccgccggagccaggtgactgtccaccgtggttttccagctgcctgtgcactcttgctccggtgtgttcgtacgtacatcggcacacacacgcatgtaaattttgtatgctttcatttcaaccgttggtttggtcttcctaccattaagtgcgctaaattttaacctgtacgagtgaagtgtatattctttgaggtgtgcatatgtatcatcacggatttcaatattcgttctc

SEQ ID NO: 19989 - protein, 292 aa, Panicum virgatum
  misc_feature: Ceres CLONE 1809489
  misc_feature (16)..(190): Pfam Name: Band_7 Pfam Description: SPFH domain / Band 7 family
MGAGSSVDLPQLLCCACVEQSTVAMEETCGRYDTVLDPGCHFMPWCVGRRVAGYLSLRVQQLDVRCETKSKDNVFVTVVASVQYRALADRAFDAFYRLSNAREQIQSYVFDVIRASVPNMNLDQVFEQKNEVARAVEEELAKAMAMYGYEIVQTLIVDIEPDEVVKRAMNDINAAARLRVAAAERAEADKIQQVKRAEGEAESKYLAGVGVARQRQAIVEGLRRFVPDEKSVMDMVLATQYFDTIRDIGATSRAATVFIPHGPAAVHDVAAQVRDGVLQAAAHAPAPAAGAR

SEQ ID NO: 19990 - DNA, 1305 bp, Panicum virgatum
  misc_feature: Ceres CLONE 1809490
  misc_feature: Encodes the peptide sequence at SEQ ID NO. 19991
aaaagacgagtctagagaaaaaagagggcgagagataaaccgcaaatccccgaaatcgcagcgcggaattaaagaaaagcggagcggcgcatacaaagcagctgctgcggccggcagcagcaccaccgcaagcagccgccaccgtcacgccaccgcgccgagagggaaaagccgagcggtggcaggcgaggaggggacggaccaaagggggaaatcgcctgcctgcctgccgcggtgggttggtggctgccgcctccgcatcctctgctcagttccccagcccacccccattcgcctcgcctgacctcgcatggattcccgctcgcttcccctccactccacgcgccgatccgccgccacctgccaggagagcgcgacgcgatccaattgaggcgcaggaggcgggggtgccctgcctgctgcctgcgtgctcccctccagtctccgtccggcctggtcgcgctgccgctggacgccaccgcgcggcgtcttggggcggccgccgccacgcgggcgacccggcgcgaagaagcggtggccgagccgggggagcgcgatgctgtgggtgacgcgcctgtccggcttcttctccgccgccatggtgatggtggtgctgtcgccgtcgctccagtccttcccgcccgccgaggccatccggtcctcgcagttcgacggcagcgtccgcttcccgggccagatcgcgggcggcgccagggggatcgccttccgccgcgccccgtcgttccgcaatgccgccgattgcggcggcggcggcggcgcgggcaacggcaccgcggtcaatgtctgcgacccctcgctcgtccacatcgcgattacgctcgatgaggagtacctcaggggatccgtcgcggcggtccactcggtggttcagcacgccaggtgccccgagagcgtcttcttccacttcctcgtctccgacccgggcctcggggacctcgtccgcgccgtgttcccgcagctccgcttcaaagtctactacttcgaccccgaccgcgtccgggggctcatctccacgtcggtgcggcaggcgctggagcagccgctcaactatgcgcgcaactacctcgccgacctcctcgagccctgcgtgcgccgcgtcatctacctcgactccgacctcgtcctcgtcgacgacgtcgccaagctctggcgcaccgacctcggcggccgcaccgtcggcgcgcccgagtactgccacgccaacttcaccaagtacttcacaggccggttctggtcagaccagcggttcgccgggacgttcgcggggcggcaggccgtgctact

SEQ ID NO: 19991 - protein, 249 aa, Panicum virgatum
  misc_feature: Ceres CLONE 1809490
  misc_feature (90)..(247): Pfam Name: Glyco_transf_8 Pfam Description: Glycosyl transferase family 8
  misc_feature: Functional homolog of the protein sequence given in SEQ ID NO 50891
  misc_feature: Useful for making plants with altered carbohydrate content
  misc_feature: Functional homolog of the protein sequence given in SEQ ID NO 50892
  misc_feature: Useful for making plants with altered cell wall content and/or composition
MLWVTRLSGFFSAAMVMVVLSPSLQSFPPAEAIRSSQFDGSVRFPGQIAGGARGIAFRRAPSFRNAADCGGGGGAGNGTAVNVCDPSLVHIAITLDEEYLRGSVAAVHSVVQHARCPESVFFHFLVSDPGLGDLVRAVFPQLRFKVYYFDPDRVRGLISTSVRQALEQPLNYARNYLADLLEPCVRRVIYLDSDLVLVDDVAKLWRTDLGGRTVGAPEYCHANFTKYFTGRFWSDQRFAGTFAGRQAVL

SEQ ID NO: 19992 - DNA, 418 bp, Panicum virgatum
  misc_feature: Ceres CLONE 1809490-R
  misc_feature: Encodes the peptide sequence at SEQ ID NO. 19993
tcgatggcccgtgcggcgcggagctggatcacggcgtggcggcggtcggctacggcaccagcaaggggcaggactacatcatcgtcaagaactcgtggggcccgcactggggcgaaaaggggtacatccgcatgaagaggggcaccggcaagccggagggcctctgcggcatcaacaagatggcgtcctacccaaccaaggaccagtagtcactactactgtgtgcatgaccatcaaaaatcgatcatagcctctctctttctttttaccttctcatcatgttttatttcttctttcccttttgtgttgatcgtttttaatttctcgattgatttgatcgaggagcaaaaggcactcatgcaccacgacctgcttggttgaaatgatggatggaataaactttaccttaatttgtttt

SEQ ID NO: 19993 - protein, 68 aa, Panicum virgatum
  misc_feature: Ceres CLONE 1809490-R
  misc_feature: SWISSPROT Homolog: EC 3.4.22.6 Chymopapain
DGPCGAELDHGVAAVGYGTSKGQDYIIVKNSWGPHWGEKGYIRMKRGTGKPEGLCGINKMASYPTKDQ

SEQ ID NO: 19994 - DNA, 2124 bp, Panicum virgatum
  misc_feature: Ceres CLONE 1809505
  misc_feature: Encodes the peptide sequence at SEQ ID NO. 19995
agcctccccggccaccactcgctgctgccgccgccgcccttggccggcagccagttaggcgatatccgtcctcctacctggttcagttcctctggcgaaacgagccgtgtagacgggttcacgggagcaagagcgcggagacgagaggagggatgcagctgctgcagccgaagcagatgcactgggtgagggccgactcctccgacttcgggggcgaccgccccgccccccgcagcgggcacacggcggtgagcatcggcaagtccaaggtgatcgtcttcggcggattcgccgacaaacgcttcctctctgacgtctccgtctacgacatcgagaataagctatggtactcacctgagtgcaccgttaatggatcggatgggcaggcaggcccgagcccaagggcgtttcatgtagctgttgtgattgactgcaacatgttcatatttggtggccgttctgggggcaagcgtttaggtgatttctggatgctagacaccgacctatggcagtggtcagagatgactggctttggtgatttgccgtcacctcgggagtttgctgctgcttcagccataggaaatagaaaaattgttatgtatggtggttgggatggcaaaaaatggctttcagatgtatacatcatggacacaatgtcactggagtgaacagaattagcagttactggatccgtgccgcctccaagatgtgggcattctgcaactatgattgagaagagactgcttatatttggaggcagaggtggagcagggccgataatgggtgatttatgggctttaaaaggaattacggaagaagacaatgagacaccaggttggacacaattgaagcttccagggcaatctccctcaccacgatgcggccattcaataacatctggtggaccttatctattgctatttggaggacatggaactggcggttggctaagtagatatgacgtgtactacaatgaatgcattattttagacagggtctctgtccagtggaagcgcctaccaacaagcaatgaaccacctcctcctcgggcataccactccatgacttcaatagggtctcgatttcttttatttggtggctttgatggaaagaatacatttggtgatctgtggtggcttgttcctgaagatgatcctattgccaaacgagattcagctcctaacatcgattcaaacagcaaacctaccactatcactggtgatgcccagcaatccaacttaaagaagtcgcaagctctggggtctccaataacggaattggccaaacgactgggaattccactttctgaggatgtttcaacaagttttgttgacgaaatcaatgataaagaacttttggtgttgtcctcaaggcttgctggtcaatcgcttccggccagtgaccaggtggcatcaattcaggtacttcgtgatcattggaaaagttctccagcaagctcactacaactgcacgaactaggacctttgctgagggactatcaacgtctcatcctccggcgctattcgggaaatccattgacagcatttcctgaaaccgaagctctacgtttcttccatttgaaaagtgcttcacagttgcgcatggatgacattcccatcttgttgagcgagtatggaaggcttctttcgacatgagatggcatcttccaagttgtgccattttctttggtttcaattgagcatttgtaacttccgaagaggcaagggaaccgaatgatgactatgttggtatgataccaaaccttcttgtccaaagatagttgaagaacactcgcagaagtacagaactgtgcatcatggacatgtttaggatgtttcacttcaaaactgaagcaactaactactgggatcaaaaagtcagacaggaagatttttttccaataaggagacgggaagttctcaaatcctttttgatccctgcctttgcttccttatgtcatgttcttttcattttagatttttaggtaattgtatgttcctgtccaggctggctgtacaaatgcacacaactatcagtgtaatatcacgcatacatgatacatggttccgtggccatgcgtggcacgacttgctcgtggagccatttcttgccgtcagttcttgt

SEQ ID NO: 19995 - protein, 171 aa, Panicum virgatum
  misc_feature: Ceres CLONE 1809505
  misc_feature (26)..(72): Pfam Name: Kelch_1 Pfam Description: Kelch motif
  misc_feature (83)..(128): Pfam Name: Kelch_1 Pfam Description: Kelch motif
  misc_feature: SWISSPROT Homolog: EC 3.1.3.16 Phosphoprotein phosphatase
MQLLQPKQMHWVRADSSDFGGDRPAPRSGHTAVSIGKSKVIVFGGFADKRFLSDVSVYDIENKLWYSPECTVNGSDGQAGPSPRAFHVAVVIDCNMFIFGGRSGGKRLGDFWMLDTDLWQWSEMTGFGDLPSPREFAAASAIGNRKIVMYGGWDGKKWLSDVYIMDTMSLE

SEQ ID NO: 19996 - DNA, 672 bp, Panicum virgatum
  misc_feature: Ceres CLONE 1809557
  misc_feature: Encodes the peptide sequence at SEQ ID NO. 19997
agcactaaccagtgtaagcctactaagccaccatgtattaaggctgctcttcccagctccttcctgaggttgagtgggagagggagaaacacacacacacacaagggagagagagagagagagagagagagagagagagagagcttcattattactcttcagcctagcccaaacttcggattatcagatatgatgaatcagatgaagcataggtccttcttgtgctccatcatctcccttatcttaaccttttcatattttgcagctagtgatgaccagtttgtctaccatggctttgccggagttaacctcaccttagatggcaacgccttggtcacaccagacggcctccttgagctcaccaatgacgcagtcaatctaggccatgcattttaccctactccattaaacttccaccaacagctcaacggtactgtgcaatctttctccatctcctttgtgtttgcaatcctctctgtccatgatgacattagtgccgatggcatggccttttttgttgccccaactaagaacctctcaaacacatgggcacagtacataggcctcctcaacagtgggaatgacggcaactcaaccaaccacatgtttgctgtcgagcttgatacaatccaaaacaatgagtttaaggacatcgacaataaccatgtgggc

SEQ ID NO: 19997 - protein, 160 aa, Panicum virgatum
  misc_feature: Ceres CLONE 1809557
  misc_feature (27)..(160): Pfam Name: Lectin_legB Pfam Description: Legume lectin domain
MMNQMKHRSFLCSIISLILTFSYFAASDDQFVYHGFAGVNLTLDGNALVTPDGLLELTNDAVNLGHAFYPTPLNFHQQLNGTVQSFSISFVFAILSVHDDISADGMAFFVAPTKNLSNTWAQYIGLLNSGNDGNSTNHMFAVELDTIQNNEFKDIDNNHV

SEQ ID NO: 19998 - DNA, 699 bp, Panicum virgatum
  misc_feature: Ceres CLONE 1809576
  misc_feature: Encodes the peptide sequence at SEQ ID NO. 19999
atctacccattataccgatcctaaggaaaaatggaagcttcagccctgctatggttcctctacgtctcactcgcctcctgcctcctctataagctcttcctttcaaccaagatcatttccggtccggcgcggcggccgccgggcccggcgcctctgcccctcctcggcaacatcctccacctccacggggagccccaccacgccctcgccaggcttgccgagacgcacggccccgttatgtccctgaggctcggcgccgccgacgccgtcgtggcctcctccgccgcggcggcgcgcgacgtgctgcggaggtacgaccacgtcctggcggcgcggtcggtgacggacgccgggcgcgcgctggggaaccacgagcactccgtcatctggctccccggcaccagcccgctgtggaagcggctccacgccgtgggcaccacccacctcttctcggcgcgcgggctggacgcgacgcgcgccgcgcgggaggggaaggcgagggagctggtcgcctgcctgggacgccacgccggcgaggccgtggacgtggggcgcgtcgtgttctcgtgcgtgctcaacgtcgtgtccaacgcgctcttctccgaggacgtagccgacctgagctcggaccgcgcgcaggagctggagatgctggtcagggacacggtggaggaggccctgcagcccaacctctcggac

SEQ ID NO: 19999 - protein, 153 aa, Panicum virgatum
  misc_feature: Ceres CLONE 1809576
  misc_feature: SWISSPROT Homolog: EC 1.14.13.71 N-methylcoclaurine 3'-monooxygenase
MSLRLGAADAVVASSAAAARDVLRRYDHVLAARSVTDAGRALGNHEHSVIWLPGTSPLWKRLHAVGTTHLFSARGLDATRAAREGKARELVACLGRHAGEAVDVGRVVFSCVLNVVSNALFSEDVADLSSDRAQELEMLVRDTVEEALQPNLS

SEQ ID NO: 20000 - DNA, 1512 bp, Panicum virgatum
  misc_feature: Ceres CLONE 1809577
  misc_feature: Encodes the peptide sequence at SEQ ID NO. 20001
ggcagctagcatagcagctgcagaaatcatggcccctacttcccctcctgccagcctactgctgctccagcgcctgttcccgttaacgctgctgctgctgctgttcattggcggcgctccagcgaccgcgcgcgccgccgccgacatgccgatgccggtgaacgaggaggtgctggggctggtggtcttcaagagcgcgctctccgacccgtccggcgcgctggccacgtggaccgagcagcagcagcagcagcagcagcacaaggagctggagagcatcgtcaccagcagcagctcgaccaataacaataagtcatcgtcgtcgccgtcgtccggcaataagctcgccgccggcaaggtggtgacgttcgggccaggaagcagccttcggtccgaggacctggtcgccggcgccgacgcgctgctgagcagggcgacggagatcgggcgcggcgcgttcgggacggtgtaccgcgcgtcggtcgggcaagggcgggtggtggcgatcaggaagctagcggcggcgagcatcgtcaagtcccgcgacgacttcgaccgagaggtgcgcgtgctgggcaaggcgaagcaccccaacctgctgccgctgaggggctactactggacgccgcagctgcagctgctcatcaccgactacgcggcgcacggcagcctggaggcgcggctccacggcggcgggcgtgcgccgccgctgacgtgggaggagcggttccgggtggtggccggcacggcccgcgggctggcgcacctgcaccaggcgttccggccgccgctgatccactacaacgtgaagccgagcaacatcttcctggacgagcggtgcaacccggtggtgggcgacttcgggctggcgcggctgctgctcaagcccaacaagcaggcggcggagcaccagttccaggggtacgtggcgccggagctggcgtgccagagcctgcgggtcaacgagaagtgcgacatctacgggctgggcgtgctcatcctggagctggtgacggggcggcgggcggtggagtacggggaggacgacgtggtggtgctgcaggaccaggtgcgggtgctgctggagcacggcaacgcgctcgagtgcgccgaccccgggatggccggcgacttcccggaggacgagctgctgccgctgctcaagctcggcatggtgtgcacgtcgcagatcccctccaaccgcccgtccatggcggaggtggtccagatcctgcaggtcatcaaggcccccgtccccgcccgtgggggtggggcgcccgccttctgaatttctcatggcgtggatttctctgatcgattctcagtttctgacaccgtaccgtacgtcgtcgtctccatcgtcccttcattcttcctcactttttcgattggcaacggcatctgggtcggtcgccggcagtggcacggcagactacaacaagcactactcatgtgcatcatcctagattggtagctagctccatcagtagtattctctcctttgtcacgctc

SEQ ID NO: 20001 - protein, 380 aa, Panicum virgatum
  misc_feature: Ceres CLONE 1809577
  misc_feature (94)..(363): Pfam Name: Pkinase Pfam Description: Protein kinase domain
  misc_feature: SWISSPROT Homolog: EC 2.7.11.1 Non-specific serine/threonine protein kinase
MPMPVNEEVLGLVVFKSALSDPSGALATWTEQQQQQQQHKELESIVTSSSSTNNNKSSSSPSSGNKLAAGKVVTFGPGSSLRSEDLVAGADALLSRATEIGRGAFGTVYRASVGQGRVVAIRKLAAASIVKSRDDFDREVRVLGKAKHPNLLPLRGYYWTPQLQLLITDYAAHGSLEARLHGGGRAPPLTWEERFRVVAGTARGLAHLHQAFRPPLIHYNVKPSNIFLDERCNPVVGDFGLARLLLKPNKQAAEHQFQGYVAPELACQSLRVNEKCDIYGLGVLILELVTGRRAVEYGEDDVVVLQDQVRVLLEHGNALECADPGMAGDFPEDELLPLLKLGMVCTSQIPSNRPSMAEVVQILQVIKAPVPARGGGAPAF

SEQ ID NO: 20002 - DNA, 1494 bp, Panicum virgatum
  misc_feature: Ceres CLONE 1809586
  misc_feature: Encodes the peptide sequence at SEQ ID NO. 20003
aaccctggactgcaagtacggagcccagctagtcccacgcggccgtcgtccgccgcgccgccgccggccgccgcgatggcgcgccgccttttctgcgccaccagagcgctccttcttcccgtcccagctcccgcgccggcgccggctccggatccgatatcttctgcggcggctgcggaggcggcggcttcgctcctgccactgctcccctgcaagcggcgcaagaagctcctgaagaagctcaacagcccgcgggttgcgcccatcgagccggaggccgcgcgccgtgttccggcactcgacgccgtactcgaccgcgatacggccttccgcttcctccaccgcgcgcgctcgttcctggcttccctcccgcctccccaccggatccccctttccgaggccggcaagctgcaccgcgagctcggcttcccccgtggccgcaaagtggcgcgctccgctgcgcgccacccgctgctgttccacctccccgtcgtggactctgtcccccacctcgcgctcacgccgttcatgcgttcactcctcgaggaagagtgccgcatccacaacgccctcctcccgtcgcgggggcgcgcagtccggaagctcctcatgctcaccgcccaccgccgcgtgccgctcgcgaagctccaccactgccgtgcggtgctcggcctccccgatgacttccgagaccgtgtccgcgactttccggatgacttccgcatcgtcgtcaaccccgcggacggccgccatgtcctcgagctggtgcgctgggaccccgcgctcgccgtcagcgcgctggagcgcgactttgttgtggacgagcgccgcgtccggcgcacgttccgcttcgccgtcccgcaccgccggttgatgccgctcgacgcggaggacgctgatcgcctcgacgcggtgaccacgttcccgctggtctcgccgtacaccaacggcgcgctgctcaagccatggacacccgaggcagagaagtaccgcgtcggggtggtgcacgagttcctgagcctgacggtggagaagcgcgcgatgatccaccacatagtagagttcaaggaggagttcgggctcactcggcacatgtacgagtcactgaagaatcagaaccgcgcgttctacctcgccggcacggagatgaactgggccctgttcctcagggacgcctacgaccaaaatggcgtgctcaaggagaaggaccccctcgtgctgttcaatgagaaactgcagcgttatgcctgcatgaccaaaatgaattctggagaggccatgactgatgcttcgggcaatctggcttgactgaatagaattagatttcagtttggtggcttgtgccttgttcatctcctactcgaccattgaactcgaagtacatgtcaggtatacagttctcgctagaattacatgttttacttcaatgcctatagatttttcactgtctttgattgggaaaattcatttttaccctgcctggtttcatgtttt

SEQ ID NO: 20003 - protein, 410 aa, Panicum virgatum
  misc_feature: Ceres CLONE 1809586
  misc_feature (71)..(390): Pfam Name: Peptidase_C12 Pfam Description: Ubiquitin carboxyl-terminal hydrolase, family 1
MARRLFCATRALLLPVPAPAPAPAPDPISSAAAAEAAASLLPLLPCKRRKKLLKKLNSPRVAPIEPEAARRVPALDAVLDRDTAFRFLHRARSFLASLPPPHRIPLSEAGKLHRELGFPRGRKVARSAARHPLLFHLPVVDSVPHLALTPFMRSLLEEECRIHNALLPSRGRAVRKLLMLTAHRRVPLAKLHHCRAVLGLPDDFRDRVRDFPDDFRIVVNPADGRHVLELVRWDPALAVSALERDFVVDERRVRRTFRFAVPHRRLMPLDAEDADRLDAVTTFPLVSPYTNGALLKPWTPEAEKYRVGVVHEFLSLTVEKRAMIHHIVEFKEEFGLTRHMYESLKNQNRAFYLAGTEMNWALFLRDAYDQNGVLKEKDPLVLFNEKLQRYACMTKMNSGEAMTDASGNLA

SEQ ID NO: 20004 - DNA, 709 bp, Panicum virgatum
  misc_feature: Ceres CLONE 1809602
  misc_feature: Encodes the peptide sequence at SEQ ID NO. 20005
accggttcgaacgctcgcgaaaatcacaaatcaagatgtgggggaaggggaagaagcgcttcggcggcggaggcgggggcgagccggcggccaagcgccaggccgccggggacgaggggccctctgaatccgccgaagacggcaccgtcgtggccgagatatcgaagaacaggaaggtgtccgtgaggagctggaagggcaaggtctacgtcgacatgcgcgagttctacgtcaaggacggcaagaccctcccttcccgcaaaggtaccgccagcgccttctccccccgcattgctattctgttattcctgtcgactggactgtttcctagcagcgcctcgcatgtccgagtagagcgctccaaggccatgcgtcttgcacgatttgttgtcttagatggatttgctctaggtctcgacaaaggacgatggtgggtttattgtagaaatcaataaaatgggatgaatggctttgttaactacctccccgcggtaaaggaccattttagttttaatggattgatgcaatttttatttgaaccgcatgtgaatctttaacatatgcagttctaatatttgcctagttagtgtacaatgatggtcttgtgagaggcattcaaagtacatcaaaccaggtatatttatcatgttaagcaggatgagtttcagcactagggtacagccatttgttagatgaatcggtcgctcag

SEQ ID NO: 20005 - protein, 139 aa, Panicum virgatum
  misc_feature: Ceres CLONE 1809602
  misc_feature (12)..(82): Pfam Name: PC4 Pfam Description: Transcriptional Coactivator p15 (PC4)
MWGKGKKRFGGGGGGEPAAKRQAAGDEGPSESAEDGTVVAEISKNRKVSVRSWKGKVYVDMREFYVKDGKTLPSRKGTASAFSPRIAILLFLSTGLFPSSASHVRVERSKAMRLARFVVLDGFALGLDKGRWWVYCRNQ

SEQ ID NO: 20006 - DNA, 2001 bp, Panicum virgatum
  misc_feature: Ceres CLONE 1809608
  misc_feature: Encodes the peptide sequence at SEQ ID NO. 20007
ttcttgggttcgtcccctctgatctctccctcaccctcccaccatctctagggttttagcaccccatttccccatcgccatttccgattggatcgctccctcctcgcccgccgccaggcagatcccgccgcgagccacctaccctccggcgccgccaccttcgtctcagaggtctccgcccaaagctcgcacaagtcccctcctttcgcccatttgttgcaaagatcggaattttttttcttcatcatccatttcttgcgtttcattccttccgttcccggaaatttcaccgcttccttgagatctcactttcgtcgatctgatcttgccgcgtctcgcgagaagcatagcagttttgtgcgagagttcggggagaagatccccagagttgagattcttgcgcccatttgctcgctccaatacctttcagaagcatctgatctcgaatagtgaaagaaagtagccacctttgtgtcgtttcttgcaactagacttggcccctgcgtattggtggtggcttggcgctgagggggagctctgcggcgctgcccattcctatgaatggacgggaaggagtccacagtggcgtccggccccaacttctcgttctacgcgcagcaccggggcatcggggctccgggagtccccagccactcgccggggctccacggcccgccgcccggcggataccggcagcatcttgatgcagtctctgcggggtacgcattccagaccccgcacatcggtggcccccacattgggcaggggtaccaccatgttgaggcctcacctcctgtggcacagcacagtgccggtggcggcgctagctccggtggtgctatggacattggcatgggtgtggccgtgagtgctgatgctaagggggatcaggggagtgtggctggccaggatgagcaggtgaagaagaagcgtgggagaccaaggaaatataagcctgatggggcggtgactcttgggttatcaccctcttcatcatcaacgcctcactcatcgaactcggggatgggaaccatggtcagcacaccaggttcaggatttggatcagggggttcaggctctggtgctccatcagagaaacgtggcaggggacggcctcctggctctgggaagatgcaacagttggcttcgcttggaaagtggtttcttggctctgttggaacaggttttactcctcatgtgattattattcaaccaggagaggatgttgctgctaggataatggcgttttcacaacaaggcccaagggcagtgtgcatcatttcagctactggagctgtttctacggcaacccttcaccaggattcagactctggtggtgtggttacatatgagggtcgatttgagatcctatgcctttctgggtcatacttggtgctagatgatggtggcacacggacccgaagcggagggctttgcatagctttgtgtggtcccgaccacagggttatcggcggcagtgtaggtggagtcctgacagcagctggaacagttcaggtgatcgtggggagcttcatgtatggcggttcgaagaaaaacaaaggtaaagccgaggcagacatggagcaggaggaggcgaatgctggtgaggaagaggcggcccccgcaatggtgctgcagcaggagcacaacatgcctcctcacgtgatgagcggatggcctccgggcatgatgagggagatggactcgcgagcctcaaacatcgatatcaactcgatccgcgagtagggggagtaggccaggctctctgacattattgaaagtaagaaaagaaaccatcctcagcagtggctgagctagaggacacaggcacagcatgcatgcatgcgctaacctccccgtaggtgcgagaagagttgttgtggttgctgtgttaagtaggaaccctgcgtgtgtcgtatcgtatcatgtcatataattaagagtttatggtgttgtacttggatgctgttgtatgagataatgagatatgcttttgctacc

SEQ ID NO: 20007 - protein, 394 aa, Panicum virgatum
  misc_feature: Ceres CLONE 1809608
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
MDGKESTVASGPNFSFYAQHRGIGAPGVPSHSPGLHGPPPGGYRQHLDAVSAGYAFQTPHIGGPHIGQGYHHVEASPPVAQHSAGGGASSGGAMDIGMGVAVSADAKGDQGSVAGQDEQVKKKRGRPRKYKPDGAVTLGLSPSSSSTPHSSNSGMGTMVSTPGSGFGSGGSGSGAPSEKRGRGRPPGSGKMQQLASLGKWFLGSVGTGFTPHVIIIQPGEDVAARIMAFSQQGPRAVCIISATGAVSTATLHQDSDSGGVVTYEGRFEILCLSGSYLVLDDGGTRTRSGGLCIALCGPDHRVIGGSVGGVLTAAGTVQVIVGSFMYGGSKKNKGKAEADMEQEEANAGEEEAAPAMVLQQEHNMPPHVMSGWPPGMMREMDSRASNIDINSIRE

SEQ ID NO: 20008 - DNA, 2005 bp, Panicum virgatum
  misc_feature: Ceres CLONE 1809634
  misc_feature: Encodes the peptide sequence at SEQ ID NO. 20009
gcgctgctctgcctctgctcactcccccaccgacactcccctctcctccgccgtcatggaccgcgacccgtccgtctccgacgaggacgacgacctcgagacgctcgtccctcagaaccacaccaagccgccctccccctcctcccgctcccgctcccgctcgccgccctcctccttcggcgtcgtcgcgctcctcccggcgctcccctctgccgccgcctccctcggccgcgccctctggtcccgccgctacctcgtgctcttcgtctccctcccgctgctcgccctcgtcctcttcctctccctcggtggcgcctcctccctccgcctgcccgcctccatccgcctcccctccgccgcccccgccgccgaccccgccgcgtcccgcatgcgcgaggctgagctgcacgcgctctacctcctccgctcccagcgctccggcctcctcagcctcttcaaccgcaccgccgcccccactaacggctccgcctccgcctccatctcgctctccgatctccaggccgtgctcgagacccagatcaagatcaaccgcgagatccaggcggcgctcctctccgcccaccgctccggggcaggcaatgcgacggtggacgggctggatctcgatctccctgccgccgggtgcaggagaagggaattgccggccgaccggcggacgattgagtggaaccccaagaaggacaggttcctgttggccatctgcatctccgggcaaatgtccaaccacttgatttgcttggagaagcacatgttcgtggcggcactccttggccggaccttggtggtgcccagccagaaggtggattaccagtacgaacgggtgctcgatatcgaccacattaatgattgcattgggaggaaggttgtgatcacctatgaggagtttgtggagaagaggaagaaagtgagcattgatcagttcatatgctacattgcgtcgcctccatgtttccttgatgaggaccatattaagaagttgaagggattggggatttctctgggcaagattgaggcagcttggccggaggatgcgaagctcaaggagccaaagaagagatacgtgggggatattacaccaaagttctcgatggatgctgaggtccttgccattggtgacatgttctatgctgatattgaggatgagtgggtgaatcagcctggtggtccgttggctcacaagtgcaagactttgatccagccaagcaggctcataatgcttactgctcagcgctttgtccagactttcttggggggaaactatattgctttgcattttcgaagacatggattccttaagttctgtaatgtgaagaaagagagctgcttcttcccgatccctcaggcagcagagtgcattctgcgaatcgttgagaaggctaatgccccagtgatatatttatcaaccgacgctgctgatagcgagacaaatcttctccaatccttggttgtattcaacgacaggcaagtcccccttgtgaaaaggccagagcaccacagttctgagaagtgggatgccttgctatacagaaatcacatgggcggagataatcaggtcgaggcgatgctcgacaagacgatctgcacactgtcaaacgtgttcatcggatcatcaggctccaccttcacggagaacatcttccggctacgtagaggctggggttcagcgtcccactgtgacgagtacctctgccagggcgagctgcccaactacatcgcggagcaagactgagaaagcaaacgccctaggaaaaagatcggtagccgcaaaaggtttttccccccaaacgtcgtgttgatatgctgtgtaaattggcgtgtacatctagtgtgtgagagaggcgttgtgtgtatcggtgcctccattcatttcttgggtgattcttacacggttaggtcttctgatattgagggtggcagttttactgaagaccaaatcatcagagttttatagcagtttttttttccctgatgggagcaggatggt

SEQ ID NO: 20009 - protein, 564 aa, Panicum virgatum
  misc_feature: Ceres CLONE 1809634
  misc_feature: SWISSPROT Homolog: EC 2.4.1.221 Peptide-O-fucosyltransferase
MDRDPSVSDEDDDLETLVPQNHTKPPSPSSRSRSRSPPSSFGVVALLPALPSAAASLGRALWSRRYLVLFVSLPLLALVLFLSLGGASSLRLPASIRLPSAAPAADPAASRMREAELHALYLLRSQRSGLLSLFNRTAAPTNGSASASISLSDLQAVLETQIKINREIQAALLSAHRSGAGNATVDGLDLDLPAAGCRRRELPADRRTIEWNPKKDRFLLAICISGQMSNHLICLEKHMFVAALLGRTLVVPSQKVDYQYERVLDIDHINDCIGRKVVITYEEFVEKRKKVSIDQFICYIASPPCFLDEDHIKKLKGLGISLGKIEAAWPEDAKLKEPKKRYVGDITPKFSMDAEVLAIGDMFYADIEDEWVNQPGGPLAHKCKTLIQPSRLIMLTAQRFVQTFLGGNYIALHFRRHGFLKFCNVKKESCFFPIPQAAECILRIVEKANAPVIYLSTDAADSETNLLQSLVVFNDRQVPLVKRPEHHSSEKWDALLYRNHMGGDNQVEAMLDKTICTLSNVFIGSSGSTFTENIFRLRRGWGSASHCDEYLCQGELPNYIAEQD

SEQ ID NO: 20010 - DNA, 2201 bp, Panicum virgatum
  misc_feature: Ceres CLONE 1809635
  misc_feature: Encodes the peptide sequence at SEQ ID NO. 20011
atctgccgcggcggtcacgtcacggcgcctggatccggcgagcgcctggcctgaagccccagatccgagcgaagccgagctttccgtggtgacctctcggctctagctcggggttggcagctgccatttcccccctccccttcttgttcgagatttcaaggctggtctgtccatctttggtggcatttgaggttgttcgtggttttcttcgattcagtttgcatctgcatggtccagatttagctgcatttcccggattgtgctcctccgtgacaaaaatctaagcttgttgcctcggaagtgtcttgctatcgcattatagtagagttagatctttttggttagtaaccctggttcttcctccatcatgtgctaatcttggtatattggcggcgagctctactgttgccatggtgttggtgtgaaaaaaaagggttttgtccaagatgtggaaacaatttctcagcaagctgccccggaagtcctcggcctcagcggactcaggtcagtgcagcaatggcaccgggatacagcgcacaaccagctgtggaagcatcccgcctggccgcccggcttccgccattaggcgcatgtcatctgccgtcttcccctcaagtgttgtggctggcattgagccgttggtttccttcaaggacgtcccaaactcggagaagcagaacctgtttgtgagcaagttgagcctgtgctgtgtcgtctttgatttctcagacccgaacaagagttcggtggagaaggatatcaaaaggcaggcattgctggatcttatagagttcgttgaatctagcagtgcacgcttctccgaggcagcgattgctgcctgtgctaagatgtgtgccatcaacctgttccgggcattccctccaaattacaggtccggttcatctggtggtggtgagggtgatgaggatgagccaatgttcgatcctgcatggtgtcatctgcagcttgtgtacgagctactaatgaaatttattggatcctcatccttggatgcgaaggtagggaagaagcactttgatcactcattcattgtgaagctccttaatcttctcgattctgaggatccaagagaaagggattgtttgaagactatcctgcacagggtatatgggaagtttatggtacaccgtcctttcatccgcaaagcagtgagcaatatattctaccagtttgtctttgagactgatcggcataatgggattgctgagctgctggaggtctttggcagtgtcattagtggctttgcattgcctttgaaggaagaacacaagatctttctttggagagttttgattcctttacacaaaccgaaatcagttggtttgtatctccagcagctgacctactgtgtgacacaatttctagaaaaggacccgaagcttgcaagctcagtaataattggtttgttaagatattggccgataacaaattgtcagaaggaagtgatgtttctgagtgagatcgaagagatattggagtctaccagccaggcagaatttcaaaaatgtatggttccattgtttcggcggattgctcattgcatcaccagttctcacttccaggttgctgaaagagcactctttgtatggaacaatgatcacattatcagcttgatcgcgcaaaaccgccaagtaatattgccactcgttgttccagcacttgaacagaatattcagaatcactggaaccaagcagtcctgaatctgacaatgaatgtaaagaagatgttttctgagatggacgaggatctcttctcgtcatgcctggataaatataaggaggacgaagaaaagcgagcatcgttagaattgaagcggaagctgacctgggagaagcatgagtcagctgcagctttacagccagtgaccggccatgcagccgtcctagtaggacaccagctgtcagtaaatatgatcgccaccctgatctagcttatgcattatgcatgctggagaatcaacggtgctcttcacccttttggcgaagtgcagcaagtgtagcgtttgctattttgctcttgtttatttttccatttgtcagtatgagtaatcactgttgtaagttgtaactatttcatatgtttatgctctctaggcaagcatacctgtaatgtaagactgctgagtgctggcactctttacatgtatccttgcctgcctatggatgagcaagtgccctac

SEQ ID NO: 20011 - protein, 501 aa, Panicum virgatum
  misc_feature: Ceres CLONE 1809635
  misc_feature (64)..(476): Pfam Name: B56 Pfam Description: Protein phosphatase 2A regulatory B subunit (B56 family)
MWKQFLSKLPRKSSASADSGQCSNGTGIQRTTSCGSIPPGRPASAIRRMSSAVFPSSVVAGIEPLVSFKDVPNSEKQNLFVSKLSLCCVVFDFSDPNKSSVEKDIKRQALLDLIEFVESSSARFSEAAIAACAKMCAINLFRAFPPNYRSGSSGGGEGDEDEPMFDPAWCHLQLVYELLMKFIGSSSLDAKVGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLIPLHKPKSVGLYLQQLTYCVTQFLEKDPKLASSVIIGLLRYWPITNCQKEVMFLSEIEEILESTSQAEFQKCMVPLFRRIAHCITSSHFQVAERALFVWNNDHIISLIAQNRQVILPLVVPALEQNIQNHWNQAVLNLTMNVKKMFSEMDEDLFSSCLDKYKEDEEKRASLELKRKLTWEKHESAAALQPVTGHAAVLVGHQLSVNMIATLI

SEQ ID NO: 20012 - DNA, 1265 bp, Panicum virgatum
  misc_feature: Ceres CLONE 1809645
  misc_feature: Encodes the peptide sequence at SEQ ID NO. 20013
attaacgcgcccaccaccgaaaattaaagccgcccacccccccggaaatcagagacgcgagcggcgaatcccctagcccctggccccgaatcctacccgagttcgctcgcaaatccgatccgccggccgcctcgctgctccgtcgccgccggcggttcgcggcgcggtagggaacctaatctacctttgggttgggagatccggggtgacccccttcatcccgggcgctccgggggctcgaatcttgcggcgggcgggcaatgtgagcggcctccgtcggagggggacgatctgcggcgcggctcgtgggtgaatcttgcggctgcggggttgcgcggcccgcggggatggagcacgtggtcggaggcaagtttaagctggggaagaagattgggagcggatctttcggggagctctacctcggcgtcaacatacagagcggcgaggaggtggctatcaagttggaatctgtcaaatcaaggcatcctcagcttcattatgagtcaaagctatacatgcttctccaagggggaactgggattcctcatttgaagtggtttggagtggagggggagtacaatgtcatggtcattgatcttcttggtccaagtctggaggacttattcaacttctgcagcagaagattctctcttaaaacagtacttatgctagctgatcagatgatagccagggtagagtacatgcacacgagggggtttcttcatcgtgatatcaagccagacaacttccttatgggcttaggccgtaaagcaagccaggtttatgtcattgactatggccttgcgaagaagtatcgggacctccaaactcataaacacataccatacagggagaacaaaaatctcacaggaacagcacgatatgctagtgtaaacacccatcttggagtagaacaaagcaggagagatgacctagagtcccttggttacgtgctgatgtatttcttgagaggaagccttccttggcaaggcttgaaagctggcacaaaaaaacagaagtatgacaaaattagtgagaagaaaatgctaacttcaattgaggccctctgtaaatcttatccatcagaattcattacatacttccattattgccgatctttgcgatttgaagataagccagactatagctatttgaagaaaatcttccgggatttattcatccgtgaagggtaccagcatgattatgtctttgattggactgtagcagggcaagctgcggacaataacagattacgactgagtggg

SEQ ID NO: 20013 - protein, 305 aa, Panicum virgatum
  misc_feature: Ceres CLONE 1809645
  misc_feature (9)..(287): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 32 in US patent 7179962
MEHVVGGKFKLGKKIGSGSFGELYLGVNIQSGEEVAIKLESVKSRHPQLHYESKLYMLLQGGTGIPHLKWFGVEGEYNVMVIDLLGPSLEDLFNFCSRRFSLKTVLMLADQMIARVEYMHTRGFLHRDIKPDNFLMGLGRKASQVYVIDYGLAKKYRDLQTHKHIPYRENKNLTGTARYASVNTHLGVEQSRRDDLESLGYVLMYFLRGSLPWQGLKAGTKKQKYDKISEKKMLTSIEALCKSYPSEFITYFHYCRSLRFEDKPDYSYLKKIFRDLFIREGYQHDYVFDWTVAGQAADNNRLRLS

SEQ ID NO: 20014 - DNA, 764 bp, Panicum virgatum
  misc_feature: Ceres CLONE 1809645-R
ggatgttccagatagattccccggtccagttgatgcatttggtagaagaaccggctctggttctggccattatggtgaacaaacaaagcacagatctctattggatacacttttagcacccaagacgactgttgattcagatagaagaaggccttcatcgtcacggaatgggagcacgtcaaggaaggcccttctgtcaagcagcagaggctctggagatcccagtgacccgattcgcagtagccacctagtcccaaccagcagctgcagcagccgcccatcaactaatcaaaggcttcatcagtcaacaggacttgagggcaggacttcatcattgtcgaaacccggaagggtcgtccatgatgatcccactatgaggaactttgaacgccttactatcagtgcagacaggaggaaatgaaatttttactagagcaaaagatccgagctgctctcactttgctgtagcgctgagaattcatttggttccaagtgatgcttactgatgagcaagttaaatgattctgtgctatacatgatgctgtgatctgcacataactgtacttgtcaaatcttggcacagatgatttgggttcttctaattcagtgaactgttcttacaaatggccacaggagcacacagcacaccattagcgggacccgggattggctgcagtgtttagccatgcgggtcaaaatgatgttaatgatgactgatatttgtaaaatgtcaatggaataaaacatttcagtacacttgcatt

SEQ ID NO: 20015 - DNA, 2009 bp, Panicum virgatum
  misc_feature: Ceres CLONE 1809658
  misc_feature: Encodes the peptide sequence at SEQ ID NO. 20016
tttcttcttctcccgaccacctcgcccaggccaccccccgccgccaacccctccacccccaaaccaccaccacccgcggccggcggcgacctcgccgccgcgccgctccacccacctgccacccccgccgcgccgccctgcccttcgctaaacccctgccggcctgccgcccccggcctccctctacacccggagaactccggcgaaccacagcaacctcaaaacaacaaggccgccggcctcccgccgccgcccactgccggtggcgacctctccgcctcccgccccgcccacctcccgcccgggccgcttcacccaccctccacttcgcctagcgaacgagcgctgttcgctggaatcggtagcggcgtgcgcgcgttctataagaaattcgcgcggcgcggctgacgctggggcgtgcgccgcagcaggcgagtaagtgaggcggcgttgtcgggctgccgggccaccggggctgcgcgcctcgaagtggccgagtggctccgcccttgcgttggcagggccaccagccgccaccaccagtgggcagtggcggattcggcaccgccgcaccgtcgatttgccgagcagggcagcaagctgcgggcgattgggattttgggttgggtggcttaatatggatattatgctgccttttaaagttggagacacagtggagtcaaggtccttctctcttggtttcaggggtgcatggttccgcagcaagatatgccttttttgtataaggcaaggtcatctggagtgtcttttggagtatctcgactttacagatgaaaagaagacatggactcgactatacaaagtccccccaggtagccgtaagcggaaatcaagtgagagtaggatgatcatggtcagacctacctttccacggtggtatctggagcatgaaaaaccttaccagctcccagaggctaatgtcgtagcgattgtcagcactccatggaaagtaggcgacctgattgagtggtggtatactgattgttactggactgggaaaattattgaattacttggtgatgacaaagttaagatagctttgcatgaagagccacttggtgaaggtggatactatgatgctgattgtaaggatctgaggccagcccttgattggtcccttgaaaaaggttggagtgtgcctctttcacaggaaaatggaaagtcctggtataccgcccagttgattatagagagcacagattcaggaagcagcagctcagatgaggacattgagcaatcttgtgatggtgaagaggtacgaaaatgcttgaatgagccatctgatatgcctgcagaagccatgggatctggcgcaaaactttcagaagtcagtgatgaaattttcatcaacgaccaaggaggtggtaaagaggaatcaccggaatgtttgaatagagcttccaatacgcatcaggaggttaccagttcaaaagaggaacttccacccaaccaaaagggacattgctgcataacaagtgaaacaaacagtcttattgccaagcgatgtgaatcttcggaagccctttcggatgatcaatcaagtccaatcagcgtcgagcgatggaaaacttcatcgggagatatttctgtcgaggggtctcctgatcctgttgatgatgccattgatgacgccataataaaagtggaggaactagcaaacaaaatcaaaagacttgaaagtctattactatctgtgggatctcctccatcaaaagtggtgaagccatcatggaagttcctggaggatgcatcagcaaaacacaagtgaactcatgtttattctggcctaaagtttgactgaccctactcagagattttccgcctggctttttgtgaaccgtctccaacagattttccgcctggctttctgtgaaccgtctccaacaagagactgcaaagcggctccttgatttattgccggtatttgcatttttttattgtaatcaaactcgtttatcaggaagtagaacaatggaagaatatttgtc

SEQ ID NO: 20016 - protein, 383 aa, Panicum virgatum
  misc_feature: Ceres CLONE 1809658
  misc_feature (7)..(88): Pfam Name: Agenet Pfam Description: Agenet domain
MDIMLPFKVGDTVESRSFSLGFRGAWFRSKICLFCIRQGHLECLLEYLDFTDEKKTWTRLYKVPPGSRKRKSSESRMIMVRPTFPRWYLEHEKPYQLPEANVVAIVSTPWKVGDLIEWWYTDCYWTGKIIELLGDDKVKIALHEEPLGEGGYYDADCKDLRPALDWSLEKGWSVPLSQENGKSWYTAQLIIESTDSGSSSSDEDIEQSCDGEEVRKCLNEPSDMPAEAMGSGAKLSEVSDEIFINDQGGGKEESPECLNRASNTHQEVTSSKEELPPNQKGHCCITSETNSLIAKRCESSEALSDDQSSPISVERWKTSSGDISVEGSPDPVDDAIDDAIIKVEELANKIKRLESLLLSVGSPPSKVVKPSWKFLEDASAKHK

SEQ ID NO: 20017 - DNA, 474 bp, Panicum virgatum
  misc_feature: Ceres CLONE 1809666
  misc_feature: Encodes the peptide sequence at SEQ ID NO. 20018
attttttctccggtgttgtctccagcggcggcatgttcgtgatctccaggccagccgaactgctctctctccccctcccctgatggtcccatgtcgaggaagaataccacggaccccacggaggatattgtcatccttggatccactgtgctccaacgaaagtttgtctttggagttgctctcctctttgcatccttcatctacaccttcattcttgttactgatttgtctgggatggaaactctggttcggatcactggtggcttgtacgtcaaggctgatcgtgatgaatcttcgccttatgctgctttgcttgtcgctcaacatgttgtttctcctttcaaggagcttggtatccctgcactggtcattacccttcctgacatcggaggcaacaaaacctacactcctgggtctggtgctctatctgctctctcggctcttgctcgttctgcggtgaaaattgggcgaatt

SEQ ID NO: 20018 - protein, 127 aa, Panicum virgatum
  misc_feature: Ceres CLONE 1809666
  misc_feature (28)..(127): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass
MSRKNTTDPTEDIVILGSTVLQRKFVFGVALLFASFIYTFILVTDLSGMETLVRITGGLYVKADRDESSPYAALLVAQHVVSPFKELGIPALVITLPDIGGNKTYTPGSGALSALSALARSAVKIGR

SEQ ID NO: 20019 - DNA, 2217 bp, Panicum virgatum
  misc_feature: Ceres CLONE 1809669
  misc_feature: Encodes the peptide sequence at SEQ ID NO. 20020
acccccccccacccccctcccgttccccaattcgaaatcgaatcgagtcggtcgggcgtgcgtgcgtgcgcgagcgattcgcctgcacaactccccccgctcctcctcctcaccccaccccgccgccgccagctcgccccctagggttccgccgcgatgtctctccggccgagcgagcgggagcagatgcggaagggcaactacaagcagtcggtggacgcggacgagagccgccgccgccgcgagagtcagatggtgggcatccgcaaggccaagcgcgaggagagcctccagaagaggcgccacgtcgggttccccgcctccgctgccggcgccgtgccggcgggacactcctcggcgctccagcagaagctcgatggattgccggcgttggtgcaggcggtgctctccaacgaccccaacgtgcagctggaggccaccacgcagttcaagaagctgctctccatcgagcgtagtcctccaattgaagaggttatcagcacaggagtggtgcctcggtttattgagttcctcacacgtgaggaccatccccaactccagtttgaggctgcttgggcactcaccaacattgcatctggcacatcagagaacaccaaggtggtggttgagagtggtgctgtgcccatctttgtcaagctcctcaactcccacagcgaggatgtccgcgagcaggctgtatgggctctagggaatgttgctggtgactccccaaaatgccgtgatctcgtgcttggccacggtgggttattccctttgctgcagcagcttaatgagcatgccaaactctcaatgctcaggaatgccacatggactctatccaacttctgccgtgggaagccacaaccaaacttcgatcaggtcaaaccagctctgtcagcactgcagcgtctcatccactctcaggatgaggaggtcctaactgatgcctgctgggctctctcatacctctctgatggaactaatgacaagatccaagctgtgatcgaatctggcgtgttcccacgccttgtagaacttctaatgcacccttcggcctcagtgctcattccagctctgcgcaccgtgggcaacattgtaactggggatgatttgcagactcagtgtgtcatcgatcaccaagcgcttccatgccttttgaacctcttgactaccaaccacaagaaaagcatcaagaaagaagcatgctggaccatctcaaacatcacagctggtaacaaggaacagattcaggctgtgatcaatgcgaacataattgcacctctggtgcatcttctgcaaactgctgaatttgacatcaagaaagaggctgcctgggcaatttcaaatgccacttctggtggcacacatgatcagattaagtaccttgttggccagggttgcatcaagccactctgtgatctgctcgtttgcccagaccccagaattgtcacagtttgcctggaaggtcttgagaacatcttgaaggttggggaagcagagaagaatcttggggcaggtgatgtgaatgtgtatgcacagatgattgatgatgctgagggcctggacaagattgagaaccttcagagccatgacaacactgagatatatgagaaggcagtcaagatgctcgaatcctactggttggaggaggaagatgatgccatgccctcaggcgaaaatcctcagaatggcttcaacttcgggaaccagccttctgttccatcgggtggattcaactttggctgaagatccccatttggaatggcgactgccattgtaccttggctggggctagtcggaggtgcggtttggggtagtcgtgttgtccaagtcatggtatggtcccattggtctggtctcagggagtcgtcgaagtcagtcccagtcaacagggtcagtccgcgggctgcatcaccagtggtgcagcttggtcagtggtcagtcttcaaggtcagccggttggatcatttgggctctggctcccaccaccacctgtggtggggagcatggagagtcgcaggtgttgtcgggagtcgggttttgcctcctatattgcatgaatgagttatattgttttacctgtttgaggtagaaagaaccttgaaagatagggaatgtgtcaagttttttctcaaagcgttcctgtgctgtataacttgttgcatgagtattggcacaacttataaaacatgaatgtcaactgggttttgggagtcc

SEQ ID NO: 20020 - protein, 529 aa, Panicum virgatum
  misc_feature: Ceres CLONE 1809669
  misc_feature (106)..(147): Pfam Name: Arm Pfam Description: Armadillo/beta-catenin-like repeat
  misc_feature (149)..(189): Pfam Name: Arm Pfam Description: Armadillo/beta-catenin-like repeat
  misc_feature (191)..(232): Pfam Name: Arm Pfam Description: Armadillo/beta-catenin-like repeat
  misc_feature (234)..(273): Pfam Name: Arm Pfam Description: Armadillo/beta-catenin-like repeat
  misc_feature (275)..(315): Pfam Name: Arm Pfam Description: Armadillo/beta-catenin-like repeat
  misc_feature (317)..(358): Pfam Name: Arm Pfam Description: Armadillo/beta-catenin-like repeat
  misc_feature (360)..(400): Pfam Name: Arm Pfam Description: Armadillo/beta-catenin-like repeat
  misc_feature (403)..(443): Pfam Name: Arm Pfam Description: Armadillo/beta-catenin-like repeat
  misc_feature (4)..(97): Pfam Name: IBB Pfam Description: Importin beta binding domain
MSLRPSEREQMRKGNYKQSVDADESRRRRESQMVGIRKAKREESLQKRRHVGFPASAAGAVPAGHSSALQQKLDGLPALVQAVLSNDPNVQLEATTQFKKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALSALQRLIHSQDEEVLTDACWALSYLSDGTNDKIQAVIESGVFPRLVELLMHPSASVLIPALRTVGNIVTGDDLQTQCVIDHQALPCLLNLLTTNHKKSIKKEACWTISNITAGNKEQIQAVINANIIAPLVHLLQTAEFDIKKEAAWAISNATSGGTHDQIKYLVGQGCIKPLCDLLVCPDPRIVTVCLEGLENILKVGEAEKNLGAGDVNVYAQMIDDAEGLDKIENLQSHDNTEIYEKAVKMLESYWLEEEDDAMPSGENPQNGFNFGNQPSVPSGGFNFG

SEQ ID NO: 20021 - DNA, 2454 bp, Panicum virgatum
  misc_feature: Ceres CLONE 1809672
  misc_feature: Encodes the peptide sequence at SEQ ID NO. 20022
acgggagcgagctttccctgcaagacacggaggcaaccagacagacactgcagagggtggaaaagcgaggcgaaaaggatgcagcagttgtctgctccgatatgctattgcttcctctccactaaacctccgcaactgccagcactagcgctgctgccgcgaccatcccctcgattcgcctccgcctccgcctacggccctggctccgcggcgcggcgcctcggacccccgccccctccgtccgcggcctctgccatgcgccggcgcggtcgccgcagggtcgcgccctctccggccgctgccaccgacggccgggaggccgctgcccctggttcgcaggaaaagagggctggtacagatctcaagacactagctacaagattttggaaagttgctgccccctactggtggtcggaggacaaaacccaagcaaggctgaggcttgctgctgtgtttgccctcacattgggaaccacagggattagtgttggatttaacttcttgggtcgtgacttctacaatgcccttgctgataaggatcaagaaaaatttacccagcaacttctctactacttgggtgcatttgctggaggaattccgttctttgtattgagagattatgcaaaagaaaccctttcattgagatggcgatcttggatgacaagttattacatgaagcgttacttcaacaacagaactttctataagattcagtctcaatcaataattgacaatccggaccaaaggataaacgatgatctcagcgcattcactggaacagcgcttgcattttctctcacattttttaatgctgctgtggacttggtatcatttagcaacatcctttacggaatctatccaccattattcgttgttcttgttgtgtactctcttgggggcactgctattagtgtcttccttggtaagaatttggtcaacctcaacttcatgcaagagaagaaagaagctgattttcggtatggacttgtccgtgttagagaaaatgctgaatcaattgctttttacggaggtgaggaaaacgaattgcaactgttgttggatcgtttcaggagggcttttgacaacctaagtgaattgttgatagcttctcggaatctggaatttttcacaaatggttatcggtatttaattcagattctgccagctgcagttgtagctccaatgtacttttcagggaaaatcgagtttggagtaatcaaccaatcagtgtctgctttcaatcatatccttagtgatttctctctcattgttttccaatttcagtcgattagtgcattctcagcagttatcgatcgtctaggtgaatttgatgatctattggatggaaatgcatcctctctatcatcccaaagcgatagcattgatgggatcaacattattttcaagagcagcaggtcttctgttagttttaatggatcactaacacaatctgatccatgcatggttctagagatccgcaatttgacattaataacgccgaggagtggaaatgttcttattactgacctcactttggaactaaaagacaaggaccacctactggtgatgggccctagtggaagtggcaaaacctcgctcttgcgtgctctggccggcctctggactagtggtaatggggacatcatataccatgtgagaggttctatgcagcttcaaaattcaaatgtaagttctgatgagccatacgatatgaagttagagggtgaagaagtactacaaaattccaagcaaagaagagacaatggcatattctttgtcccgcaaagaccatatatggtcctgggcacacttcgtcagcaattactctatcctacatggagtgaagatgttcatcattcaccaaataatgatgctgaaagtacagatcctcttccgtttctatctgaagtttccacatcagatggagtcggtgccaagccagagatgccctcaactgctgaactgatcagagtgcttgaggctgtcaagctgggctatatattgcctcgtttcaatggcttggactgtatgcatgattgggccagtgttctttctcttggggagcagcagcgtcttgcattcgctcggttattgcttgctaagcccactttggtcttactggatgagtcaacaagtgcactagatgaaacaaatgagactcatctatacagtcagatcgaagctgcaggcattacttacataagcatcggtcaccggaaaacacttctcaagttccacaacaaggccctgtacattacgaagtgcgagtcgacacatagtgatctacacaactgggagctaaagaccacaacccagatttcagttgaagattcatctccattctcttcatagcatcttcagcttttggcccctgtttgccctttcctcagttttcgtcccacgcttggccccaatcagaagtatggggggggggggggggggggggcccccccc

SEQ ID NO: 20022 - protein, 698 aa, Panicum virgatum
  misc_feature: Ceres CLONE 1809672
  misc_feature (32)..(312): Pfam Name: ABC_membrane_2 Pfam Description: ABC transporter transmembrane region 2
  misc_feature (432)..(670): Pfam Name: ABC_tran Pfam Description: ABC transporter
  misc_feature (400)..(465): SWISSPROT Homolog: EC 3.6.3.31 Polyamine-transporting ATPase
  misc_feature (581)..(679): SWISSPROT Homolog: EC 3.6.3.42 Beta-glucan-transporting ATPase
  misc_feature: Functional homolog of the protein sequence given in SEQ ID NO 50893
  misc_feature: Useful for making plants with modulated biomass
  misc_feature: Useful for making plants with modulated flowering time
MRRRGRRRVAPSPAAATDGREAAAPGSQEKRAGTDLKTLATRFWKVAAPYWWSEDKTQARLRLAAVFALTLGTTGISVGFNFLGRDFYNALADKDQEKFTQQLLYYLGAFAGGIPFFVLRDYAKETLSLRWRSWMTSYYMKRYFNNRTFYKIQSQSIIDNPDQRINDDLSAFTGTALAFSLTFFNAAVDLVSFSNILYGIYPPLFVVLVVYSLGGTAISVFLGKNLVNLNFMQEKKEADFRYGLVRVRENAESIAFYGGEENELQLLLDRFRRAFDNLSELLIASRNLEFFTNGYRYLIQILPAAVVAPMYFSGKIEFGVINQSVSAFNHILSDFSLIVFQFQSISAFSAVIDRLGEFDDLLDGNASSLSSQSDSIDGINIIFKSSRSSVSFNGSLTQSDPCMVLEIRNLTLITPRSGNVLITDLTLELKDKDHLLVMGPSGSGKTSLLRALAGLWTSGNGDIIYHVRGSMQLQNSNVSSDEPYDMKLEGEEVLQNSKQRRDNGIFFVPQRPYMVLGTLRQQLLYPTWSEDVHHSPNNDAESTDPLPFLSEVSTSDGVGAKPEMPSTAELIRVLEAVKLGYILPRFNGLDCMHDWASVLSLGEQQRLAFARLLLAKPTLVLLDESTSALDETNETHLYSQIEAAGITYISIGHRKTLLKFHNKALYITKCESTHSDLHNWELKTTTQISVEDSSPFSS

SEQ ID NO: 20023 - DNA, 304 bp, Panicum virgatum
  misc_feature: Ceres CLONE 1809672-R
cgtcaccattcagatggatcgtcaaaattactgccatgctacgatcctacgactgccgacccgggccgcagggcaggatagctatcttcccttgtgcactcagacattagaggtcattcgtacataatacggatgcaagtagtacttatgatcttggtgtgaccacttctttgatctgtatctgaacctcctcatagtttagaagttgcaatggagtcgttgcgctggatttttactcaatttccttgtttcaagcatgtagtaggaacttcaagattggagtgacaatgtacttttggaatcc

SEQ ID NO: 20024 - DNA, 700 bp, Panicum virgatum
  misc_feature: Ceres CLONE 1809676
  misc_feature: Encodes the peptide sequence at SEQ ID NO. 20025
aaaagctccatcacttccagctcccagctcccagctccagcccagccccaagctcccctctcatctcctctcctccccccccaatgccgccccgcccgtagccgcgccccgagcccccgagcccccgcgcccgccgcaatgcccggcccccgcgcgcccctggcggcgctggcggccctgctcgcggtcgccgccctcgccgccgcggagcccccgcccagcgagcggtccgcgctgctggcgttcctcaccgcgaccccgcacgagcgccgcctcggctggaacacctccaccccgacgtgcggctgggtcggggtcacctgcgacagctccgggtccgccgtcgtcgagctgcgcctcccgggcgtcggcatcgtcggcgccatcccgccgggcacgctcggccggctcaccaacctccgcgtgctctcgctccgctccaaccgcgtcctgggctccatccccgacgacgtgctgcagctgcccaacctcaaggcgctcttcctgcagcagaaccggctgtcgggcgccatcccgccggggatcgccaggctcggcgggctcgaccgcctcgtgctctcgcacaacaacctctccggctccatccccttcgcgctcaacaacctcaccgcgctgcgggtgctaaagctcgacggcaacaacctctccgggagcattcccagcatcagcatcccggcgc

SEQ ID NO: 20025 - protein, 187 aa, Panicum virgatum
  misc_feature: Ceres CLONE 1809676
  misc_feature (26)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MPGPRAPLAALAALLAVAALAAAEPPPSERSALLAFLTATPHERRLGWNTSTPTCGWVGVTCDSSGSAVVELRLPGVGIVGAIPPGTLGRLTNLRVLSLRSNRVLGSIPDDVLQLPNLKALFLQQNRLSGAIPPGIARLGGLDRLVLSHNNLSGSIPFALNNLTALRVLKLDGNNLSGSIPSISIPA

SEQ ID NO: 20026 - DNA, 2321 bp, Panicum virgatum
  misc_feature: Ceres CLONE 1809677
  misc_feature: Encodes the peptide sequence at SEQ ID NO. 20027
gtctcctcactcccctccacatcactcaccgcccgccagccgcgaagccgtcactctggtgaccgcgtcgcaggcgcagcgcacgccaccgagtcacccacccaccgacccatggccatgggcggcgcgttccccttccagtggcccgcggacccggggctcgacgccgccgccgccctgcccccgctgcccaccgcggtgcccgacgccggggtggcgtcgtactacgcgggcgcggccggcatgcacgcagcgcaggtggagctgcccgatctcgccgcggcgctggcggcgatgcggcgggaggaggaggaggccgcgggcatccgcctcgtgcacctcctcatgagctgcgccggcgccgtcgaggccggggaccacgcgggagcctccgcgcacctgaccgacgcgcacgccgcgctcgccgccgtctcgccggcctccggcatcggccgcgtcgccgtccacttcacagccgcgctgtcccggcggctgttccccccaacgccgtcgcctccgccgccgctcgccgccgcggacgccgaccacggcttcctctaccaccacttctacgaggcggggccctacctcaagttcgcgcacttcacggccaaccaggccatcctggaggccgtccagggctgcaggcacgtccacatcatcgacttcaacctcatgcaggggctccagtggcccgcgctgatccaggccctcgcgctccgccccggcgggccgccgttcctccgcctcaccggcattggcccgccctccccgccggggcgcgacgacctccgcgacgtcggcgtccgcctcgccgacctggcgcgctccgtgcgcgtccacttctccttccgcggcgtggccgccaaccgcctggacgaggtccgcccctggatgctgcaggtgtcgcagggcgaggccatcgccgtgaactcggtgctccagctccaccgcctggtcggcgacccgcccgcggccgacggccgggcgcccatcgacgcggtcctcgactgcgtggcctccctgcggcccagggtgttcacggtggtggagcaggaggccgaccacaacaagccggggttcctggaccggttcacggaggcgctcttctactactcggcggtgttcgactccctggacgcggcgagcggcggcgcgggcgacgcggcggcggaggcgtacctggagcgcgagatctgcgacatcgtgtgcggcgagggcgcggagcggcgggagcggcacgagccgctgcggcggtggcgggagcggctggggcgcgcggggctgggcggcgtgccgctgggggcgaacgcgctgcggcaggcgaggatgctggtggggctcttctccggggagggccactgcgtggaggaggccgaggggtgcctgacgctggggtggcacgggcggccgctcttctcggcgtccgcgtggcgggcggaggagggcaatcagagcgacagcaacgcggccggcagcagcggcagcgaggagagcaatatcagctgcagctgctaggactggagcagctactgtaaattggtaagagtagcggggtttactgtaaaatcgcggcggcggcgcggtcccggggggaatgaaatcgatcgtaaatggcaggcagactgaagactcaatctgaaatgacatgaaattctgttagcaatgccgtcatggttgaataaacggcgccgagactgaaagcgtccctggaaaatgccattgcaatagtagaaaagaaactacactggcgtggcattgacgtattgtgctggttggactggatggatggaatcaaggcacacccgtggcacttctcactcagccgctgatagatagctgctgacaacagcaaccgcttctgatcctcatctacagactactggcgctttcaacaaccaaccaccccctgacgatggaggctgttgggctgatctgatgaatagtattcggctggtagaatgaacagtattatgtgagaagaaataagccgaaacaagtcgagacaagccgagaaccgatctgccgaacaggctcgatgtctctgtaaaatggaaatctaaaaccactagccgcggatgcgcctctggcgcagcggtaactcccactgatgggagcgtactggcgggagttcgagcccccgtccgcacctgggtatcgaggctgtgtgcgtgtgtgctgggtgtgtgtgcgtgtgtggtggtgtgcgttctcggtatggcgcgttccgagactattcggacagcctcgtctgcgttgagttcgatcagtgtaggcgtccagaaatcttacatgactccccagagctcttggatgctttc

SEQ ID NO: 20027 - protein, 468 aa, Panicum virgatum
  misc_feature: Ceres CLONE 1809677
  misc_feature (48)..(354): Pfam Name: GRAS Pfam Description: GRAS family transcription factor
  misc_feature: Functional homolog of the protein sequence given in SEQ ID NO 50894
  misc_feature: Useful for making plants with modulated biomass
  misc_feature: The sequence is a functional homolog of SEQ ID NO 218 in the 10/412,699 US patent application
  misc_feature: The sequence is a functional homolog of SEQ ID NO 2290 in the 10/374,780 US patent application
  misc_feature: The sequence is a functional homolog of SEQ ID NO 439 in the 11/479,226 US patent application
  misc_feature: The sequence is a functional homolog of SEQ ID NO 784 in the 10/225,066 US patent application
  misc_feature: The sequence is a functional homolog of SEQ ID NO 216 in the 10/412,699 US patent application
  misc_feature: The sequence is a functional homolog of SEQ ID NO 435 in the 11/479,226 US patent application
MAMGGAFPFQWPADPGLDAAAALPPLPTAVPDAGVASYYAGAAGMHAAQVELPDLAAALAAMRREEEEAAGIRLVHLLMSCAGAVEAGDHAGASAHLTDAHAALAAVSPASGIGRVAVHFTAALSRRLFPPTPSPPPPLAAADADHGFLYHHFYEAGPYLKFAHFTANQAILEAVQGCRHVHIIDFNLMQGLQWPALIQALALRPGGPPFLRLTGIGPPSPPGRDDLRDVGVRLADLARSVRVHFSFRGVAANRLDEVRPWMLQVSQGEAIAVNSVLQLHRLVGDPPAADGRAPIDAVLDCVASLRPRVFTVVEQEADHNKPGFLDRFTEALFYYSAVFDSLDAASGGAGDAAAEAYLEREICDIVCGEGAERRERHEPLRRWRERLGRAGLGGVPLGANALRQARMLVGLFSGEGHCVEEAEGCLTLGWHGRPLFSASAWRAEEGNQSDSNAAGSSGSEESNISCSC

SEQ ID NO: 20028 - DNA, 640 bp, Panicum virgatum
  misc_feature: Ceres CLONE 1809690
  misc_feature: Encodes the peptide sequence at SEQ ID NO. 20029
ttcaccaacagctcgcgccccgcaacgccaccgcgccaccgagcacgcacgcgacagaggcggcggcgggagccattccactccgcggcgagggcgacgggagaggaggaggaggccagggcggcttgtgacgacgacgccggagcggcggcagggcggcatggggaggtccccgtgctgcgagcaggcgcacacgaacaagggcgcgtggaccaaggaggaggaccagcgcctcatcgcctacatcacggcccacggcgagggctgctggaggtcgctccccaaggccgcaggtgagtgccatgccaatcctagcagtcgacgcgtgcggacgagacgcggcgctcacggcgacggcggcggtgcagggctgctgcggtgcgggaagagctgccggctgcggcggatcaactacctgcgcccggacctcaagcgcggcaccttctccgaggaggaggacgagctcatcatcaagttccacgagctcttcggcaacaagtaagctgctcgatgcctcgatcttgccgagatcgcgcgcgtacgtgatcggagcactcgccgggggatcggccgaccagccggagttcgttctgaccgcgcgcgcgcgcgggccttcttcttcttctttctctcgtgccgg

SEQ ID NO: 20029 - protein, 113 aa, Panicum virgatum
  misc_feature: Ceres CLONE 1809690
  misc_feature: Functional homolog of the protein sequence given in SEQ ID NO 50733
  misc_feature: Useful for making plants with altered cell wall content and/or composition
MGRSPCCEQAHTNKGAWTKEEDQRLIAYITAHGEGCWRSLPKAAGECHANPSSRRVRTRRGAHGDGGGAGLLRCGKSCRLRRINYLRPDLKRGTFSEEEDELIIKFHELFGNK

SEQ ID NO: 20030 - DNA, 1870 bp, Panicum virgatum
  misc_feature: Ceres CLONE 1809702
  misc_feature: Encodes the peptide sequence at SEQ ID NO. 20031
gcgaaacgactccagactcctccctccaccattccgcaccctcccctcattcccactattccggcgaggcggctcccctccctctgcggtggatccttcgtcagctgcggtggcggctacccgtgccccgttgcccgcgcctcggtcgatctgccggtcgttggagggccttgcaatccgccgtggcctcgcgctggtggaactcgcacctgctgacgcgaggcaacggcgaccccgatttgagcgccggccggaaacgcgcggctcccgtcacctccgggggcctccccgggtccgtgagcccttttctcatcgcttgctgagggccaaggtctctcctggtagtttgagtgatttcaaatggcttctgcaaggaaagtgagaaatgcgaataaacgctttgccaaaatcaatgacgattggaagactgaagatacagcaagtgtacctaaaagtaaagtgcgaaagaaaaagttatcagacatgcttgggtctcagtggagtagagaggagctcgagcgcttctatggtgcctacagaaaatatggaaaagattggagaaagattgctggtgctatccgtgataggacatcggacatggtagaggctctttataacatgaataaggcctatttgtctctaccggagggaacggcaactgcagcagggttaattgcgatgatgactgaccactacaatattttggatggaagtaacagtgatcatgaaagcaatgatttgccaaaaacttctagaaagccacagaaacgtggtcatgcaaagtttcaatctgtgtctaagacatcagatatacgttaccctgatcaattgcaatctcaacctgcttcatcgagctatggatgcctttctttgttgaagaaaaaacgttctgaagacctgtttgtagggaacaggccacgtgctgttggaaaaaggactccaagagtacctgttgccagcatgtaccatcgagatgataggggtgcaccaaatagacaagcaaaaccagattctaacaatggtgatgatgaaggagctcatgtagctgcgcttgctctggcagaggtatatcaaagtggaggctcacctcaggtttctcaaacacctgggaggtctggcgatcgtatgttcctgtcccccattaaaagtaatgacagaaaaaatgctgattcagagatgggtagctcaaagttgcatggattccagttggatgctgattaccctgaagctagcttaggaagtagggaagctgagactggtgactatactaaaggttcatcctatttgatgactaacaaaggatctccatccgtcaagcctcagaagaaagtaaagaggtcccaaaagaggaggaaaaaagctgcacgcaaaacaggtgatcagtatgagtatgacagagaggcttgcagtggtactgaagaagggcatagtgggagaaaggcaaaagaggaaccagaactggagacattgggaagaaaaactgcatggccatctagcacatcaaataaaagaagccgtcaactgttttttgatgatgaaagttcagctctagatgcattacatactttagctgatttatctgtgaacatcctacagccatcttcagttgttgaatctgaatcgtcagcacagattaaggatgaaaacaaagacaatgattctgatggaaagcctagtatgcctgccgccgtatcagtgtatgagcagaaagataactccaaaagtatagcaaaaaaactcaaaaggcagtcagaaattgcaagcactgatatggttactaggaaaaaagccaaacattctaaagatcctcatcatgatgggagcacttctgaagtaaagcaccaaggttgtacatgtggtgttaaaacag

SEQ ID NO: 20031 - protein, 503 aa, Panicum virgatum
  misc_feature: Ceres CLONE 1809702
  misc_feature (44)..(89): Pfam Name: Myb_DNA-binding Pfam Description: Myb-like DNA-binding domain
MASARKVRNANKRFAKINDDWKTEDTASVPKSKVRKKKLSDMLGSQWSREELERFYGAYRKYGKDWRKIAGAIRDRTSDMVEALYNMNKAYLSLPEGTATAAGLIAMMTDHYNILDGSNSDHESNDLPKTSRKPQKRGHAKFQSVSKTSDIRYPDQLQSQPASSSYGCLSLLKKKRSEDLFVGNRPRAVGKRTPRVPVASMYHRDDRGAPNRQAKPDSNNGDDEGAHVAALALAEVYQSGGSPQVSQTPGRSGDRMFLSPIKSNDRKNADSEMGSSKLHGFQLDADYPEASLGSREAETGDYTKGSSYLMTNKGSPSVKPQKKVKRSQKRRKKAARKTGDQYEYDREACSGTEEGHSGRKAKEEPELETLGRKTAWPSSTSNKRSRQLFFDDESSALDALHTLADLSVNILQPSSVVESESSAQIKDENKDNDSDGKPSMPAAVSVYEQKDNSKSIAKKLKRQSEIASTDMVTRKKAKHSKDPHHDGSTSEVKHQGCTCGVKT

SEQ ID NO: 20032 - DNA, 666 bp, Panicum virgatum
  misc_feature: Ceres CLONE 1809708
  misc_feature: Encodes the peptide sequence at SEQ ID NO. 20033
agcatgcctgtagcaagcagtctcgagatcgatcgaggtcgcacgcggtggccggccggtcgccggagataataatgggctacgacgtcgggaggaggctcgcgctcgcggcggcggtggcggcggtggcgttctgggcggcggagacgcggggcgcggccgcgtggggcggcgcggcgcggccggcggcgccgtgcatgtacatcttcggggactcgctggtggacaacggcaacaacaacgacatcctgagcctggctcgcgccaactaccggccctacggcatcgacttccgcgaggggccccccggccgcttcaccaacggccgcaccatggtcgacttcctctccgacatgctcggtctccgcccgccgctcgtcccgccctacgccgccgcgcgccccgccgacctcccccgcggcgccaacttcgcctccggcgcctccggcatcctccccgacacagggaacaacctgggcgggcactacccgttgtcggagcaggtggagcacttccgcgaggcggtgggcgccatggggaacgcgtcggcgttccggggcaacgccacgcggctggaggagcacctggggcggtgcatcttctacgtcggcatgggcagcaacgactacctcaacaactacttcatggccgactactacgacaccg

SEQ ID NO: 20033 - protein, 197 aa, Panicum virgatum
  misc_feature: Ceres CLONE 1809708
  misc_feature (42)..(195): Pfam Name: Lipase_GDSL Pfam Description: GDSL-like Lipase/Acylhydrolase
  misc_feature: SWISSPROT Homolog: EC 3.2.1.51 Alpha-L-fucosidase
  misc_feature: Functional homolog of the protein sequence given in SEQ ID NO 50895
  misc_feature: Useful for making plants with modulated phosphate use efficiency
MGYDVGRRLALAAAVAAVAFWAAETRGAAAWGGAARPAAPCMYIFGDSLVDNGNNNDILSLARANYRPYGIDFREGPPGRFTNGRTMVDFLSDMLGLRPPLVPPYAAARPADLPRGANFASGASGILPDTGNNLGGHYPLSEQVEHFREAVGAMGNASAFRGNATRLEEHLGRCIFYVGMGSNDYLNNYFMADYYDT

SEQ ID NO: 20034 - DNA, 1766 bp, Panicum virgatum
  misc_feature: Ceres CLONE 1809711
  misc_feature: Encodes the peptide sequence at SEQ ID NO. 20035
ccttagttcttgtatcatcgtgtccttttcctcctaccaccacacaccattcccttctcctttcttctccatcctcttcctcttggtttctccattccaagcttactacaaggcatttatttgcttctagtctactagtccccaagcaacaactattttttccggttctggtgcagcagcggattaagctcgcagccattagcagctaattaaccagcagatttcctctcgctaacaaccctctctttttttgagcttgagcttggtgatcggccggctcgagtcgagtgtacatacacacatacgcacgcttctgctacctgctagtaggagcctaggaggctaggacagtacagttgatcgatcgaccgaatcgataggtttagaagaaggaagatgatgcgcggggccagggagcagaggatggccttctcgccgatgaaggaggccgcggcggtgcccaaggaggaggtgtgggaggtccggccggggggcatgctggtgcagaagcggagccccgacgcggacccgccccccggcggcgcgcccgtgcccaccatccgcgtcaaggtcaagttcaacggcgtctaccacgagatctacatcaacgcccaggcctccttcggcgagctgaagaagctgctgtcggagaagacgggcctgcacccggacgaccagaaggtggtgtacaaggacaaggagcgcgactccaaggcgttcctcgacatggccggcgtcaaggaccgctccaagatgatcatgctcgaggaccccgccgcaaaggccaagcgcctcctcgaggagcgccggaccagcaaggccgagcgcgccgccaaggccgtcgcgcgcgtcgcgctcgacgtcgacaagctcgccaccaaggtgtcggcgctggagacgatcgtgagcaagggcggcaaggtggtggacgccgacgtggtggcgctgacggaggcgctgatgaacgagctggtgaagctggactccatcgccgccgacggcgaggtgaaggcgcagcggcgggcgcaggagaagcgggtgcagaagcacgtggagacgctggacgccatccgcgccaagaacgataaggcgagcggcaaggcgcggccgccgcacctcccaccgcgcccgcccccggtggcgcagcgccggcagttccagccgccggcgcccaccacggcgacggccccggcgccgcagacgcagacggcgagctgggagacgttcgacctcctgtcgtcggtgccgtcgacgtcggcggcacccgtgacgaccatggcccctgcgaccaccaccacgccgtccccgcggttcgagtgggagctcttctagaacggaggcgctcccacctgctgctggttccccacccgccacatgtgtgcctgtccattggctcggccggtacctttctttgttgtccatccacctcggccatggtgcaagtcaatcgccattgtttctttctttcttctctttattcgttctttctttctttgtttctctctgtcctttattgagtgtatattgatctgatctccacaaaaagaaaagaaagaaaaaggcaagaactgcagcgatgagctagtgaggtgaagaaactagaagcaagcaagcaagcacatccatggtgtttgttggtgtctgtctgtccgtctgcaaaataagtggtggccttgcgatcggtggacggaggatttttcccatgcccatatgtgtatagtagtagcagtacaatgtacagtgtacatgaatgaaaacagtgtccc

SEQ ID NO: 20035 - protein, 311 aa, Panicum virgatum
  misc_feature: Ceres CLONE 1809711
  misc_feature (145)..(226): Pfam Name: BAG Pfam Description: BAG domain
MMRGAREQRMAFSPMKEAAAVPKEEVWEVRPGGMLVQKRSPDADPPPGGAPVPTIRVKVKFNGVYHEIYINAQASFGELKKLLSEKTGLHPDDQKVVYKDKERDSKAFLDMAGVKDRSKMIMLEDPAAKAKRLLEERRTSKAERAAKAVARVALDVDKLATKVSALETIVSKGGKVVDADVVALTEALMNELVKLDSIAADGEVKAQRRAQEKRVQKHVETLDAIRAKNDKASGKARPPHLPPRPPPVAQRRQFQPPAPTTATAPAPQTQTASWETFDLLSSVPSTSAAPVTTMAPATTTTPSPRFEWELF

SEQ ID NO: 20036 - DNA, 2411 bp, Panicum virgatum
  misc_feature: Ceres CLONE 1809737
  misc_feature: Encodes the peptide sequence at SEQ ID NO. 20037
agtcagcaataatggcgtgtttggttcatgctcgtcgcgccgtaactgcggcatgcggcagcagatgtttggtcggtgtctgcagatcgagccgctgcttagttcattctcctccccggtgcggcacggtgtggtgacaggctgacagcagcatccgtagttgttcaacaacgcaacgcgtcatggcgaagcacctcatcctcgccgcgttcctcgccgccgtggccctgctcgcgtccggcgccgccggtcaggactaccctcggctagcgtgcgactacacggccggtaacttcacgcccggcagcaggtacctcgccaacatcggcatcgtcggcgccgccctgcccaagaacgcctccgcgtcgccggacctcttcgccgccgccgcggtcggcgccgccccggacaaggtctgggcgctcgcgctctgccgcggcgacgcgaacgccacctactgcctcggctgcctcgtccaggcgtcccgcgacctgcccaacgcgtgcgcctacaacagggacgccgccatctactacgaccagtgcatgctcggctactccgccgccggcttccccgcagccgccgtcgacgactccgccggcaccacctacgagtcccccagctacgaggacattgcgctggaggagagcccgcggttcaaccgcttccgggccctgctcatgagcgccaccgccgactacgctgcgtacaactccacgcggcggcgctacgcggccggcgaggccgacatggacctgccggacttccccaagctgtacagctgggcgcagtgcacgccgacgccggacctcacgccggcgcggtgctggcggtgcctggccggggcagtatcgcggctgtccctgctgtacaccaacagtagcgtgggcatggttcttggggtcagatgcagcatccggtatcagacggacccttttatggacggtccggtgatggtccggcaagcggcagcacactcaccgaattctgccgcaccaagctctggagcgctagcacccgcacccgcacccgcaccaccggcggcggtgccggccggcggagcagggagaaagtacagtgttcctggattggttcttattgctgtgctgccggttctagcagccatgaacctcatcactctcctgtgtttctggaggaggagtccaacaaaaacaaagcaatcgggtccggattataacaacgaagcagagggcatgaagattgtagacacgatgctaatagacatatctaccttgcgagctgcaactggggattttgcagaaggcaacaagcttggtgagggtgaatttggtgcggtgtataagggtgttctcccggacggtgacgaaatagcagtgaagaggatgtccaagagcttatcacagggagtagacgagctggcgaatgagctcgctgtggttgccaagcttaagcacaagaatctcgtcagccttgttggcgtctgcttagagcaacaggagaggctgctcgtcttcgagttcgttcctaacaggagcctcgacctcgtcattttcgacaccgagaaacgcaagcgcctggactggggaaagaggtacaatattatcgacggcatcgctcgtggcctccaatacctccacgaagactcccagctcaaagttgtccaccgtgatctcaaggcgagcaacatcttgctagacagcaacatgagccccaagatatcagactttggcctggcgagaattttcagtcgagagcaaacccatgctgtcacaaaccatctcgtcggcacatacggatacatggcgccggagtaccgaatgcgcgggcactactctgtcaagtcagacgtgttcagcttcggcgtcctggtcatcgagatcgtgacgggaagaagcaacaactgctgctccgactcacagcggtctgaagatctcttgacttggatgtgggagcactggatggccgggacagcgctggagatggtagacccggccctgaatggctgcttctcggaagacgaggtacggagatgcatccacattgggctgctctgcgtgcaggagaacccgggcgaccggccggtgatggcgtcggtggtgatgacgcttggcagcgatacggcatccctccaggcgcccgccaagcccgcgtccttcgccagctacgggggtgccaaacccggcgccgcgtcagtgtaagaacggccgtctgatgtaagataagaaatagtaaggaggaatgagcacgatgtaatgtaaggagtgtgctgccttaagtttgtacgtacgaggaagcaccccatggagagtttttacggtgccttttgatactacctagccagtagtaccattggttaaatccactcttcattagagcagttttgtaatcaacttatttttgtcaaaattatctatgttgatattaatgat

SEQ ID NO: 20037 - protein, 665 aa, Panicum virgatum
  misc_feature: Ceres CLONE 1809737
  misc_feature (365)..(634): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50654
  misc_feature: Useful for making plants with altered carbohydrate content
MAKHLILAAFLAAVALLASGAAGQDYPRLACDYTAGNFTPGSRYLANIGIVGAALPKNASASPDLFAAAAVGAAPDKVWALALCRGDANATYCLGCLVQASRDLPNACAYNRDAAIYYDQCMLGYSAAGFPAAAVDDSAGTTYESPSYEDIALEESPRFNRFRALLMSATADYAAYNSTRRRYAAGEADMDLPDFPKLYSWAQCTPTPDLTPARCWRCLAGAVSRLSLLYTNSSVGMVLGVRCSIRYQTDPFMDGPVMVRQAAAHSPNSAAPSSGALAPAPAPAPPAAVPAGGAGRKYSVPGLVLIAVLPVLAAMNLITLLCFWRRSPTKTKQSGPDYNNEAEGMKIVDTMLIDISTLRAATGDFAEGNKLGEGEFGAVYKGVLPDGDEIAVKRMSKSLSQGVDELANELAVVAKLKHKNLVSLVGVCLEQQERLLVFEFVPNRSLDLVIFDTEKRKRLDWGKRYNIIDGIARGLQYLHEDSQLKVVHRDLKASNILLDSNMSPKISDFGLARIFSREQTHAVTNHLVGTYGYMAPEYRMRGHYSVKSDVFSFGVLVIEIVTGRSNNCCSDSQRSEDLLTWMWEHWMAGTALEMVDPALNGCFSEDEVRRCIHIGLLCVQENPGDRPVMASVVMTLGSDTASLQAPAKPASFASYGGAKPGAASV

SEQ ID NO: 20038 - DNA, 627 bp, Panicum virgatum
  misc_feature: Ceres CLONE 1809740
  misc_feature: Encodes the peptide sequence at SEQ ID NO. 20039
ataccctctccgctggtgcggtgcggagctaggacgacgtcgccttccgctcagctcgcctcgctcgagcggcgagcccggaagaacgcgaagcagaggaagcgagccggcggaggcggcggagatgtcggcggggctggtgaccgacgaggcgaccatgggccggctctaccggatccggcggacggtgatgcacatgctgcgcgaccgcgggtacctggtgggtgagcgcgacctcgccaccagccgccgcgacttcctccgcgagttcggcgagtccttccgccgcgaggacctcctcatcaactggtacgagaagaacgacccctccgaccagggctctcagcaggtcatgtccggtcagcgcccgatccaatcgcgccgcgccggtcaactgcctcccctgcttcctgccgctcttgatcggatcagactgtacggacgcctatggcttggcgctcgatccactctccctttgcgtttgatgcccctttctctggatgggtgcgtctctccttgagtccgtagctctgctcttgcacgatcggtcagatcgaggtccgaatcgcgatcgatggtgtggatactgcggcatgctatatgcttcccgtgaagaacagagagaca

SEQ ID NO: 20039 - protein, 131 aa, Panicum virgatum
  misc_feature: Ceres CLONE 1809740
  misc_feature (6)..(78): Pfam Name: RNA_pol_Rpb5_N Pfam Description: RNA polymerase Rpb5, N-terminal domain
MSAGLVTDEATMGRLYRIRRTVMHMLRDRGYLVGERDLATSRRDFLREFGESFRREDLLINWYEKNDPSDQGSQQVMSGQRPIQSRRAGQLPPLLPAALDRIRLYGRLWLGARSTLPLRLMPLSLDGCVSP

SEQ ID NO: 20040 - DNA, 668 bp, Panicum virgatum
  misc_feature: Ceres CLONE 1809780
  misc_feature: Encodes the peptide sequence at SEQ ID NO. 20041
gccgagttctctcttccagaaacggacagagagagaaagtgagctccagcgaagcagccagcagcccgccacgccttcctccttcctctcgcggattcagagctccagacctcctccgtgtccgtgggtgcgaagcggcgcaacggcggcggcggcgacagcgaaagcgtgatcgccttcccgggagcgggaagctcgagttgagcggcggcgcaacggccgccgatgggaccaatggagccgcgctaccgtcccgccggcgcccctgaggatacaactaagagaaggacctctaaaagcaaaagcttcaaagatgtcgaaaattttgaagttcttgtcattgaaaagaactgtggttgcaagttcaaatctttgaagatcatgatcatagctatcatttctgcaacagttcttacccttataaccccaaccttgtatgagcaccaattgcagtcagcctcccggtttgtggacgtcggttggatgtgggacaaaacaagttctgacccgcgatatgcttcatctgttgatgttcagtgggatgatgtacatagagcactcagaaatctaaaaagtggtaatcaagatctcaaagttggactcttgaattttaacagcaccgagtatggctcctggacacagttgttgccggacagccatgtttccat

SEQ ID NO: 20041 - protein, 147 aa, Panicum virgatum
  misc_feature: Ceres CLONE 1809780
  misc_feature: Functional homolog of the protein sequence given in SEQ ID NO 50565
  misc_feature: Useful for making plants with altered carbohydrate content
MGPMEPRYRPAGAPEDTTKRRTSKSKSFKDVENFEVLVIEKNCGCKFKSLKIMIIAIISATVLTLITPTLYEHQLQSASRFVDVGWMWDKTSSDPRYASSVDVQWDDVHRALRNLKSGNQDLKVGLLNFNSTEYGSWTQLLPDSHVS

SEQ ID NO: 20042 - DNA, 2074 bp, Panicum virgatum
  misc_feature: Ceres CLONE 1809783
  misc_feature: Encodes the peptide sequence at SEQ ID NO. 20043
atctatctcctccctttgtttctttcttcccttctctcgggctctctctctctcctcccttgctcttccttccctccctggcggcggcgacggctgggcgagcggcggcgccaggtcttcgtccagccctttgccggcgacgagcatcctccaggattatcaaacacagccttcggagtccaactatgttactgaccttagatcacatgcatattctgaggatcgtttgccgctgggaagagaatgtcagaggcagaagtcacaccttcctacttcaagctgttcttgggaaaactcttctgcattagaagcagcagcaccaccaccaagtagcccagatgcattagggcatgcattcgggaaaatgagaaccaaaaccaacaccctcagtgcaagaccacattatcgtgcttcatatcctgccactgctcttcacatgacaaagcatctaggagaagttgaactcgattatggtttagatcattctgatcgttgttgcagaagatcagaccgatttactgccttgtcaagccgcagtggtcaatctgtagaaaattgcagtgagctgggcgattatgccagtgccccccactatgtagatgggatcaatcctatttcacgtcaatggtgctttgatgatggaggcccttcggtaccaagagggctgcagtatggcgatgagatcccttctttgtctagtaagaagcataatgggctaccttcactctcaagccaatggcactacgatcttcaaaccccattgttctcaagaagacaggagtatggtgatgagatcccgtcactgtctccaaattggcgttaccgatataagattcctctgcactctggtcattggtgccatgatgctgaggcacctgcaccatcaaggtaccggcaaggtgcttctcattggaatggtcactcaagacaaaattttgccaggattaataccaatgagcaatccaaagttaccacaagcaaacatgcttttatgaaacataggatggtcaacagagttgtaaacagtagtatccaccacatgaccaatatgaaagataataggtgcagaaatcctgaggatataaaggaccaagttcgtgggccaagagcaagtaaattgaataatacttcagcttcatccagtgtgaaagatatctcaagtccatttgtctgtagggatcaaattaatagatccgacttttcagttcagtataaacaggccaagtttttcatgataaaatcatatagtgaagacgatattcataaaggtatcaaatacaacgtttgggcaagtacagcaaacgggaatgataaacttgatgctgcttaccatgaagctcaaattttaatgaaagagaatggggagaactgtcctgtgttcctattcttctcggttaacaccagcggacagtttgtagggttggctgaaatgttaggccctgttgatttcaagaagaccatggatttctggaaaggagataaatggaatggctttttccctataatatggcatattataaaggacattccaaatcgtctgttcaaacatataattcttgaacacaatgattacagaccagttacttttagtagggacactcaggagattgggttggcacaaggtatgcaaatgttgaaaattttcaaggatcaccttcagggaacatcaattctggatgattttgatttttatgaagaaaaagataatgcatgccgtgcccaaaagggcgaaaacccagagtcaacacatcaagctagattttctgaagacttggagccgatgggaaatttggaggcacgcatggagagctggagtttgtacgagaattgggactagtgcacagatcactgtacaactgaaataaagagcattatttatgagtcagtaaagtagctgaaggcactgacgctcctttggagaacaattccaaccaaaaattgtctatacgtgtcatctgaaactgctttattgttatacagtgtttatgtagtagcataggtgtattggtaaacagagacgtgaagagattttagcaccggagatttcctgaaaccagggtacttcgatatttcc

SEQ ID NO: 20043 - protein, 611 aa, Panicum virgatum
  misc_feature: Ceres CLONE 1809783
  misc_feature (461)..(551): Pfam Name: YTH Pfam Description: YT521-B-like family
SISSLCFFLPFSRALSLSSLALPSLPGGGDGWASGGARSSSSPLPATSILQDYQTQPSESNYVTDLRSHAYSEDRLPLGRECQRQKSHLPTSSCSWENSSALEAAAPPPSSPDALGHAFGKMRTKTNTLSARPHYRASYPATALHMTKHLGEVELDYGLDHSDRCCRRSDRFTALSSRSGQSVENCSELGDYASAPHYVDGINPISRQWCFDDGGPSVPRGLQYGDEIPSLSSKKHNGLPSLSSQWHYDLQTPLFSRRQEYGDEIPSLSPNWRYRYKIPLHSGHWCHDAEAPAPSRYRQGASHWNGHSRQNFARINTNEQSKVTTSKHAFMKHRMVNRVVNSSIHHMTNMKDNRCRNPEDIKDQVRGPRASKLNNTSASSSVKDISSPFVCRDQINRSDFSVQYKQAKFFMIKSYSEDDIHKGIKYNVWASTANGNDKLDAAYHEAQILMKENGENCPVFLFFSVNTSGQFVGLAEMLGPVDFKKTMDFWKGDKWNGFFPIIWHIIKDIPNRLFKHIILEHNDYRPVTFSRDTQEIGLAQGMQMLKIFKDHLQGTSILDDFDFYEEKDNACRAQKGENPESTHQARFSEDLEPMGNLEARMESWSLYENWD

SEQ ID NO: 20044 - DNA, 1580 bp, Panicum virgatum
  misc_feature: Ceres CLONE 1809796
  misc_feature: Encodes the peptide sequence at SEQ ID NO. 20045
gtactgtacaatacagcatcgcgtacccaactcccaaccaaatccccaatcccgaactcaccacccgttccgtccccttcccgacctcgccgaggagcctccccaccccaaaccctagcttctcgctcccccaccccccagcatggaggacgaagacgccggccccggcggcgggggcgaggcctcccctccgcaccacgccgcggcgtcgggcgaccgggcgcgggacatggcggcgtccccgacgagctcgcggtccgtgacgcagacggtgaacgggtcgcaccggttcgtgatccagggttactcgctcgccaagggcatgggcgtggggaagcacatcgccagcgagaccttcacggtgggcgggtaccagtgggcgatctacttctaccccgacgggaagaaccccgaggacaactccgcctacgtctccgtcttcatcgccctcgcgtccgagggcaccgacgtgcgcgcgctcttcgaactcacgctcctcgaccagagcggcaagggcaagcacaaggtgcactcccacttcgaccgctccctcgagtctgggccatacaccctcaagtaccgcggatccatgtggggctataaaaggttctttcggcgcactgctcttgagacatcagattttcttaaagatgattgcttgaagataaactgtactgtgggtgttgtagtatcaactatggattattctagaccacacgcgatagaggttccagagtctgacataggttatcattttggaacgcttttggacactcaggaaggtgtagatgttatttttagagtagcaggagaggagtttcatgcccacaagttggtattggctgcccgatcttccttttttaggtcagagtttttcgatcatgaatcagatgaagaaaagaatgaagctgatgggagtaatgaaatcaaagagattgtcattgatgacatggatcctaaagtgttcaaggctgtgcttcattttatctacagggacaatcttgttaatgatgacgagttatccgcatcaagctctgactgctctatatttgatactttagctggaaagttaatggctgcagcagacaaatatgagttgccaaggctaagattgttgtgtgagtcttacttgtgcaagcagatttctgtaaactctgtggcaactactctagcattggctgaccagcaccatgctatggagcttaaatctgtttgcctcaaatttgctgctgaaaatctttcagctgtgatccggactgaggggttcgattgcctcaaagacaactgcccatcgctgcagtcagagatactgcgaacggttgccggatgcgaggagcaatgcaccagcggtgggaaaagccacagtgtatgggcgcagctctcggacggtggcaacaccagcggccgcagggtgaggccgagggtctgagctgaggcatcaccggctcgccgccgtgaaaccgtgatcaactgacctgtgtaatcaaagctgctgtagtgtaaatgtggacagggtaccgaacagccatgtgatttgtgacaacgcttgaaataatataattagcattttgcttgttgcc

SEQ ID NO: 20045 - protein, 428 aa, Panicum virgatum
  misc_feature: Ceres CLONE 1809796
  misc_feature (205)..(334): Pfam Name: BTB Pfam Description: BTB/POZ domain
  misc_feature: Functional homolog of the protein sequence given in SEQ ID NO 50896
  misc_feature: Useful for making plants with modulated biomass
MEDEDAGPGGGGEASPPHHAAASGDRARDMAASPTSSRSVTQTVNGSHRFVIQGYSLAKGMGVGKHIASETFTVGGYQWAIYFYPDGKNPEDNSAYVSVFIALASEGTDVRALFELTLLDQSGKGKHKVHSHFDRSLESGPYTLKYRGSMWGYKRFFRRTALETSDFLKDDCLKINCTVGVVVSTMDYSRPHAIEVPESDIGYHFGTLLDTQEGVDVIFRVAGEEFHAHKLVLAARSSFFRSEFFDHESDEEKNEADGSNEIKEIVIDDMDPKVFKAVLHFIYRDNLVNDDELSASSSDCSIFDTLAGKLMAAADKYELPRLRLLCESYLCKQISVNSVATTLALADQHHAMELKSVCLKFAAENLSAVIRTEGFDCLKDNCPSLQSEILRTVAGCEEQCTSGGKSHSVWAQLSDGGNTSGRRVRPRV

SEQ ID NO: 20046 - DNA, 670 bp, Panicum virgatum
  misc_feature: Ceres CLONE 1809816
  misc_feature: Encodes the peptide sequence at SEQ ID NO. 20047
gggggctccaacccgattcccatccgcttcctcccgcaagcgaattcctctgcccggaggcgcgacaagacaccggctttccgatcccagccatggaggcgacgaagcagctgaggcggctgcgcacgctgggccgcggcgcgtcgggcgccgtggtgtggctggcctccgacgaggcctcgggcgagctgctggcggtcaagtcggcgtgcgccgcgggggccgcggcgcagctccgccgcgagggccgcgtcctggagggcctctcctcgccgcacgtcgtgccctgcctgggcgcccgcgccgcggccggcggcgagtaccagctcctcctcgagttcgcccccggcgggtcgctcgccgacgaggccgccaggagcgccgggggccgcctcgcggagcgcgacatccgggcctacgccggggacgtggcgcgcgggctggcctacctccacggccgctcgctcgtgcacggggacgtcaaggcccggaacgtggtcatcggcgccgacggccgcgcccggctcaccgacttcggctgcgccaggtccgcggagtcggcgggacccctcggcggcaccccggccttcatggcgcccgaggtggcgcgcggggaggagcagggccccgccgccgacgtctgggcgctcgggtgcacgatcgtcgagct

SEQ ID NO: 20047 - protein, 192 aa, Panicum virgatum
  misc_feature: Ceres CLONE 1809816
  misc_feature (7)..(192): Pfam Name: Pkinase Pfam Description: Protein kinase domain
  misc_feature: SWISSPROT Homolog: EC 2.7.11.25 Mitogen-activated protein kinase kinase kinase
MEATKQLRRLRTLGRGASGAVVWLASDEASGELLAVKSACAAGAAAQLRREGRVLEGLSSPHVVPCLGARAAAGGEYQLLLEFAPGGSLADEAARSAGGRLAERDIRAYAGDVARGLAYLHGRSLVHGDVKARNVVIGADGRARLTDFGCARSAESAGPLGGTPAFMAPEVARGEEQGPAADVWALGCTIVE

SEQ ID NO: 20048 - DNA, 691 bp, Panicum virgatum
  misc_feature: Ceres CLONE 1809821
  misc_feature: Encodes the peptide sequence at SEQ ID NO. 20049
aacacacggcggcgcggaggagaggaggggagggcgcagtcgcacgacaccaccaccaccgtctctctctctctcctcgtccggcgcggcctctcctcctgttccttcgttcctctctctctaccaatcaaatcaattactctctcttctctgtccatcgattctcctcctgcaggctctccggccaccgccgtcgatcgaataatgcatcagcagacgacgacgccgacgcagctgcaaacaactacgccgccgtacccgcaaaataaaattatgaggcatcagcagcagcagcggcggcaggaggaggaggcggccgccaaggccaccgaggacagccgcttggtcttcgacgccggcaagccgcctcccttccgcatcggcgacgtccgcgccgccgtgccggcccactgctggcgcaagagccccctgcggtcgctgtcgtacgtggcaagggacgtggccgtggtggcggggctggccgtggcggcggcggcgctcgacacctgggcgctctggcccatctactgggcggcgcagggcacaatgttctgggcgctcttcgtcctcggacacgactgtgggcacgggagcttctctgacagcggcactctcaacagcgcggtggggcatctcctccactccttcatccttgtcccctaccatggatggaggatcagccacaaaacgc

SEQ ID NO: 20049 - protein, 139 aa, Panicum virgatum
  misc_feature: Ceres CLONE 1809821
  misc_feature: SWISSPROT Homolog: EC 1.14.99.33 Delta(12)-fatty acid dehydrogenase
  misc_feature: Functional homolog of the protein sequence given in SEQ ID NO 50897
  misc_feature: Useful for making plants with modulated heat sensitivity
MRHQQQQRRQEEEAAAKATEDSRLVFDAGKPPPFRIGDVRAAVPAHCWRKSPLRSLSYVARDVAVVAGLAVAAAALDTWALWPIYWAAQGTMFWALFVLGHDCGHGSFSDSGTLNSAVGHLLHSFILVPYHGWRISHKT

SEQ ID NO: 20050 - DNA, 280 bp, Panicum virgatum
  misc_feature: Ceres CLONE 1809821-R
agatctatgtatatatgtatatatatatatatatatatatatataattaaaccctacgtcgtgcatgctatagctatagctatagctatactatacttaattggtttgcaattcagcgatatgcataatgcatgctagctgtggctatttatatctggtttatttgcaattgatcgagctattttttttgtgttaatgtttcagctccatataaataatgtaatgtttaaatgatatgcttgtctatgaaatattgaaataaaacttaatttgtagggcc

SEQ ID NO: 20051 - DNA, 663 bp, Panicum virgatum
  misc_feature: Ceres CLONE 1809832
  misc_feature: Encodes the peptide sequence at SEQ ID NO. 20052
acctcgcggccagcgcacagcactccactcgaaccccttcttctccccctccccctccgcctcatttccatcgccgccaccctcctcctcctccgccgccctcgacctcgccgcggccgccgccatgcagagcctcctcctccccaccgccgcggcggccccggcggcggctccgcggggccggcggcaaccgcccgggcgcgtctccgtccgcgcttccgcggcggcggcggccccgcggcgggagacggatcctaagaagcgtgtggtgatcacggggatggggctggtctccgtgttcgggaacgacgtcgacgcctactacgaccgcctgctcgccggggaaagcggcatcggccccatcgaccgcttcgacgcctccaagttccccacccgcttcgccggccagatccgggggttctcctccgagggatacatcgacggcaagaacgaccgccgactcgacgactgcctccgctactgcatcgtcagcggcaagaaggcgctcgagtccgccgggatcgccctcggctccaagcccatggaaaagattgacaaggcccgggctggtgtgcttgtgggcactggtatgggtggcctcacggtgttttctgatggtgttcagaatcttattgagaagggatacagaaaaataactccttt

SEQ ID NO: 20052 - protein, 179 aa, Panicum virgatum
  misc_feature: Ceres CLONE 1809832
  misc_feature: SWISSPROT Homolog: EC 2.3.1.41 Beta-ketoacyl-acyl-carrier-protein synthase I
MQSLLLPTAAAAPAAAPRGRRQPPGRVSVRASAAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALESAGIALGSKPMEKIDKARAGVLVGTGMGGLTVFSDGVQNLIEKGYRKITP

SEQ ID NO: 20053 - DNA, 606 bp, Panicum virgatum
  misc_feature: Ceres CLONE 1809842
  misc_feature: Encodes the peptide sequence at SEQ ID NO. 20054
attcctaccggcgggcacgcctcgggggcaatcccgaggggaatttccggctagggtttcgcggatcgagagacgcgtggctcatcttggccctgctccccgcgctctgcctgggaacgctgcctagctcccacgcggcccgcgccttcttcgtcttcggcgactccctcgtcgacaacggcaacaacaactacctggtgacggcggcgcgcgccgactcaccgccctacggcatcgacacgccggaccaccgcgccacggggcgcttcagcaacggcaagaacgtgccggacatcatcagtgagcacctcggcgccgagccggtgctgccgcacctgagcccggagctggacggcgacaagatgctcgtcggcgccaacttcgcgtcggccggcgtcgggatcctgaacgacacgggaatccaattcgccaacgtcatccacatctcgaagcagctgctctacttccagcagtaccagaagcgtctgagctcgctcatcggcgcggagcagacggcccggctggtgcacggctcgctggtgctcatcaccctcggcggcaacgacttcgtcaacaactactacctggtgccctactcggcgcgct

SEQ ID NO: 20054 - protein, 201 aa, Panicum virgatum
  misc_feature: Ceres CLONE 1809842
  misc_feature: SWISSPROT Homolog: EC 3.2.1.51 Alpha-L-fucosidase
SYRRARLGGNPEGNFRLGFRGSRDAWLILALLPALCLGTLPSSHAARAFFVFGDSLVDNGNNNYLVTAARADSPPYGIDTPDHRATGRFSNGKNVPDIISEHLGAEPVLPHLSPELDGDKMLVGANFASAGVGILNDTGIQFANVIHISKQLLYFQQYQKRLSSLIGAEQTARLVHGSLVLITLGGNDFVNNYYLVPYSAR

SEQ ID NO: 20055 - DNA, 1692 bp, Panicum virgatum
  misc_feature: Ceres CLONE 1809849
  misc_feature: Encodes the peptide sequence at SEQ ID NO. 20056
accggccgcctccttctcctgcatcgcatcgcgcccatggtgccagctctcgctctctccgtggagccgctggctcgccgccaccaccaccctgcaatacgagggttccggaggggtcagggccacgcggcgacgcttagcgcgaggatcacgatgctcagccggcaggatccgccaggaggaggtggtggtggtggcgccgccggcgggacgcctctgtacctcgggatagacttcggaacatccggggcaagatactctctgatcgacaggaaaggcgccgtccattccgaagggaaacgagcttactcgccacctgtcggcggcggcggcgcgggctgggcgagctcctggcgggcggcgctgttccagctcctcggcgacatcccgccggcgcaccgcccgtccatctcctccatctccatcgacggcacctcggccaccgcgctcatcgtcgacagcgagaccggggagctcctcgccggcccgttcctctacaacgagagcttcccggacgcgctgcccgccgtggaggccgtcgcgccggcgaaccacacggtctgctccgcctcctccaccctctgcaagctcgtctcgtggtggaacacggcgggcgccggcggcggcgccggctccgccgtgctgatgcaccagtccgactggctcctctggctcctgcacggccggtacggcgtctccgactacaacaacgccctcaaggtcggctacgacccggcggccgacgcctacccgagctggctcatggcgcagccctactcgcgcctgctgccgccctccgtcatggtgccgggagcccccatcgccgccgtcagagacgacgtgcgctctcagtacgggctctccgaggagtgcgtcgtctgcaccggcacgacggacagcatcgcagcgttcctggcggcgcgcgccgccgggccggggcgggcggtgacgtcgctgggctcgacgctggcggtgaagctcgtgagcgaggcccgcgtggacgacgcgaggttcggcgtgtacagccaccgcttggacggcgcgtggctcgtcggcggcgcgtctaacgccgggggagccgtgctccggcagctcttcggcgacgaccggcggctggcggcgctgagcaggggcatcgacccggccgccgcgtccccgctcgactactacccgctgccgaggaaaggcgagagattcccggtcgccgacctcgacatggcgccaaggttggagccgcgcccggagagcgacgctgagttccttcacggcattctggaatcaatcgcgcgaattgaggcgaaagggtacagtctgctgagggagctcggcgcgacggcggtggaggaggtgttgacggcggggggagggacgcagaacgagacgtggacggcgatccgggagagggtgctcggcgtgccggtgaggaaggcggagcagaccgaggcggcgtacggagcggcgttgctggcactcaagggcgcggatcgccgagcaggagcaatggctagctagagcagcagatgctaaagaaattgtggagcctgcttgaacattcttctggacagatttctggtgccaagagaagtgcagatgatatcttctattacagagtaataaggccagctgcagattagaattgattcggatccaaaagtgtgtgcaagctcaaagctactcttttttttttttggc

SEQ ID NO: 20056 - protein, 491 aa, Panicum virgatum
  misc_feature: Ceres CLONE 1809849
  misc_feature (61)..(294): Pfam Name: FGGY_N Pfam Description: FGGY family of carbohydrate kinases, N-terminal domain
  misc_feature: SWISSPROT Homolog: EC 2.7.1.17 Xylulokinase
MVPALALSVEPLARRHHHPAIRGFRRGQGHAATLSARITMLSRQDPPGGGGGGGAAGGTPLYLGIDFGTSGARYSLIDRKGAVHSEGKRAYSPPVGGGGAGWASSWRAALFQLLGDIPPAHRPSISSISIDGTSATALIVDSETGELLAGPFLYNESFPDALPAVEAVAPANHTVCSASSTLCKLVSWWNTAGAGGGAGSAVLMHQSDWLLWLLHGRYGVSDYNNALKVGYDPAADAYPSWLMAQPYSRLLPPSVMVPGAPIAAVRDDVRSQYGLSEECVVCTGTTDSIAAFLAARAAGPGRAVTSLGSTLAVKLVSEARVDDARFGVYSHRLDGAWLVGGASNAGGAVLRQLFGDDRRLAALSRGIDPAAASPLDYYPLPRKGERFPVADLDMAPRLEPRPESDAEFLHGILESIARIEAKGYSLLRELGATAVEEVLTAGGGTQNETWTAIRERVLGVPVRKAEQTEAAYGAALLALKGADRRAGAMAS

SEQ ID NO: 20057 - DNA, 725 bp, Panicum virgatum
  misc_feature: Ceres CLONE 1809856
  misc_feature: Encodes the peptide sequence at SEQ ID NO. 20058
gcgcagcggggtcgacgcggagaggaagagaatcccacccaaaaggaagaagaacgaaggggagcgtattggaacttggaagcgccggagagggaaggttcgatctcggaagggagagagatcatggctccgatgaagctgtacggcgcgacgatgtcgtggaacgtgacgaggtgcgtggtggcgctggaggaggccggcgcccactaccagatcgtgcccttccacttcgccaccgccgagcacaagagccccgagcacctcgcccgcaacccatttggtcaggttccagctttgcaagatggtgacttgtacgtctgggaatcgcgtgcaatttgcaagtatgcagcccgtaaaaacaagccggagctgttgaagcaaggcaatcttgaggagtcagcaatggtggatgtctggatggaggtggaggccaaccagtacacctctgtgctgaaccccatcctcttccagtgcctcatcagtcctatgcttgggggatccactgacctgaaggttgtcgaggagaaccttgagaagctgaagaaggtgctggaggtgtatgaggcgcgcctgacctagtacaagtacctggctggagacttcctcagccttgctgaccttaaccatgtctctgccaccctgtgcttggttgcaacgccccatgcgtcggggtttgatgggtaccctcctgtgaagggctgggggtccaaccctgatggagaggc

SEQ ID NO: 20058 - protein, 151 aa, Panicum virgatum
  misc_feature: Ceres CLONE 1809856
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MAPMKLYGATMSWNVTRCVVALEEAGAHYQIVPFHFATAEHKSPEHLARNPFGQVPALQDGDLYVWESRAICKYAARKNKPELLKQGNLEESAMVDVWMEVEANQYTSVLNPILFQCLISPMLGGSTDLKVVEENLEKLKKVLEVYEARLT

SEQ ID NO: 20059 - DNA, 1561 bp, Panicum virgatum
  misc_feature: Ceres CLONE 1809858
  misc_feature: Encodes the peptide sequence at SEQ ID NO. 20060
agcaagccgcgccgcgtcgttttagtaaaacccgagaataattaacgacatggccaaccgctctaagtgtcacttgacgcaaaacctattcttcctgctcgcttacaccactgcgattgtagcagcatctactctgccgcaaccatactacagccagcatgatacgccctcgggctacccacagccacacgacttccctaatgagatgctttaccaggcctatgtcggtatccagcgcttcaagaaaacaatgacatgtgatcccaggaacattacctcgacctgggttggccgtgatatctgtggcgataagacctacgtcggcatctactgttctacactgcctaggctcagtaacaacctcacagtcacatcagttgttctgaatggctatggattgtgcgcaccaaagctgcaagagttcattgataagctccctgatcttgcggtcttccgggctacctccaacaaatttggtgccttcgacgtcaacaacctttctggcctcacctaccagtacaaactggacgtcagcgacgaccagcctgctcagcctttagacgatcatcgtgatttccagctaccaacaaaagatttgttgaaagtgaaggcttgcattggcacagcatgtgccgatattgggtttggtgaatcccttgtagctattcccggtgccacgaacgctagggcactcctcctcaactacaacaacctatctgggtcacttccggctaacctcgggctctccaagttgagctacctcgccctcgccaacaacaagctcacgggtccaatcccaccgtcgatcgagcacctgcaagactccctcttcgagctgctcctcctcaacaatcagctctccggctgcctcccccacgagctcggcatgctccacaaggcagctgtgatcgacgtcggcatgaaccagctcaccggcccgatcccgtcatccttctcctgcctcaacagcgtcgagcagctcaacctcgccgggaaccgcctctacggcccggtgcccgacgcgctctgcaacctcgccgggccggccgggcgcctcgccaacctcactctgtccggcaactacttcacctccgtcaggccggcgtgcgcggcgctgatcaaggacggcgtgctggacgtgaagaacaactgcatcccgggcctcgccgaccagaggcgcccggcggagtgcgcggcgttccagagccagcccaagacgtgcccggcggcgagcacccagcaggtggcgtgccccgccgcagctgccgcgggcgcggcggcgccgggggagaggaaggctagggactactccagctacgtgacctacgctactctgcatgagtgatgagcagcctcagctcggcatgcagtaggagacagatcgtcttggtggcgtttacttgttctttgtattcttatgtagtaccccgtgtgtgtgtgtgtgttggtgtgattgtgattgttgtctattttctccgcacgtacgttgctgtccaggttgctgtcacacctagatctatctttgtatccatttgagtgaaaaaattgttgttgttgttgt

SEQ ID NO: 20060 - protein, 431 aa, Panicum virgatum
  misc_feature: Ceres CLONE 1809858
  misc_feature: SWISSPROT Homolog: EC 2.7.11.1 Non-specific serine/threonine protein kinase
MANRSKCHLTQNLFFLLAYTTAIVAASTLPQPYYSQHDTPSGYPQPHDFPNEMLYQAYVGIQRFKKTMTCDPRNITSTWVGRDICGDKTYVGIYCSTLPRLSNNLTVTSVVLNGYGLCAPKLQEFIDKLPDLAVFRATSNKFGAFDVNNLSGLTYQYKLDVSDDQPAQPLDDHRDFQLPTKDLLKVKACIGTACADIGFGESLVAIPGATNARALLLNYNNLSGSLPANLGLSKLSYLALANNKLTGPIPPSIEHLQDSLFELLLLNNQLSGCLPHELGMLHKAAVIDVGMNQLTGPIPSSFSCLNSVEQLNLAGNRLYGPVPDALCNLAGPAGRLANLTLSGNYFTSVRPACAALIKDGVLDVKNNCIPGLADQRRPAECAAFQSQPKTCPAASTQQVACPAAAAAGAAAPGERKARDYSSYVTYATLHE

SEQ ID NO: 20061 - DNA, 462 bp, Panicum virgatum
  misc_feature: Ceres CLONE 1809861
  misc_feature: Encodes the peptide sequence at SEQ ID NO. 20062
agcgtttcgaacagacaccgccgccgcaacaggccgagttcctcgtcgtctcctcccaaatcgccctagcatcaaagctccgccgccgccgccgccgccgccatgggtaaggttcacggatcgctggcccgcgctgggaaggtgcgtgggcagacgccgaaggtggcgaagcaggacaagaagaagaagccccgcggccgcgcctacaagcgcatgcagtacaaccgccgcttcgtcaccgccgtcgtcggattcggcaagaagcgcggccccaactcctccgagaagtagatctagccaggccagccgcctgattcatacgcttgtgttcttggcaccttcatcttttttccaggtagttttgttcgagtaatcaacgttttggtaatgtactgatgacaagttgaagacctaagctatgttgctgcaatcctaccaagtatgatatgcatcgtttactgc

SEQ ID NO: 20062 - protein, 62 aa, Panicum virgatum; identical to SEQ ID NO: 10043
  misc_feature: Ceres CLONE 1809861
  misc_feature (3)..(61): Pfam Name: Ribosomal_S30 Pfam Description: Ribosomal protein S30

SEQ ID NO: 20063 - DNA, 1903 bp, Panicum virgatum
  misc_feature: Ceres CLONE 1809875
  misc_feature: Encodes the peptide sequence at SEQ ID NO. 20064
agtaactcggtcccgccgcccatgggagctccaccacgcaccgctgccccggctccacgccgcgaaccctagccgccccgcccctatggccgccgagtcctgcggcagccgcggcgcctcgccgccgccgccaccctcctccgctggcggcggcgcggccgggaggcggcggaaggccgaggcctacgccgaggtgctccgccgcatccgcgccggcggttacggcggcggccgcccggagttggaggacgagctctgggcccatttccaaggcctaccggccagatatgctttggatgtcaatgtcgaacgggttgaagatgtcttactgcacaagaaattgcttgagcaagcccgtgaccccatgaatgggctggtctttgatgttcgtccttcacaggttcttactctggaggaaaacactggatttgagtcctcaacctcctttaagcaagaacaagatccccgatgctcagcatttgcatcaagagatcaaaggcctttgcacgaaattatatttgcatgtgacgataagccaaagcttcttagtcagttaacctctcttcttggggagcttggtcttaatattcaagaagcacatgcatattcgacgaatgatggctattccttggacatatttgttgttgagggctgggagtatgaggttgacatactccgaaatgcattgaggaaaggcgttgataaaataaagtacagagcatggccgctggtccagtcgatgtctgctaggattgatcaccagccattggaggtttctgcttcatccaacttcgtccaaataccagttgatgcagctgatgtttgggaagttgatcccaggcttctcaaattcgaacaaaaattagcgtctggatcatttggtgatctataccatgggacgtactgtagtcaggatgtagctatcaaagtactcaagcctgagagggttagcgttgatatgctacgcgagtttgcacaggaagtatatataatgaaaaaggttcgtcacaagaatgttgtccaatttattggtgcatgcacgagaccacctattttgtgtatagttacagaattcatgcatggagggagtattttcgacttcctttacaatagacaaggaagttttcagctcccagatgtgataagaattgcatctgatgtgtccaagggaatgaattacttgcatcagattaatattgttcacagggacttgaagactgcaaatcttcttatggatgatcaggttgtcaaggttgcagactttggggtcgcaagggttaaagaccagtcaggagttatgactgcagaaactgggacctacagatggatggcccctgaggtcattgagcacttgccatatgatcatagggcggatgttttcagtttcgggattgttctttgggagctgctgactggaaagcttccatacgaagacatgacacctcttcaggcagctgttgccgttgttcaaaaggatctgaggcctactattgctgctgatactcatcctatgcttgctgatctacttcagcgatgcttgcagaaagatccagctctaagaccaaccttcgcagagattgtggatatactgaattccataaaagaggtggttcagagttctgggcatcacaagagacattcaggtcgatctcactctgggaggagacgaggctgttgatgtggcagttttgttctacgcctttgctttgttgccttctcacatgtttcatctttgatagcggcgacttctaggccttacttgtttccaaaagttttccgtttttggttgtagttcagcgatagcttcagaatatggccatatgagtttcttgtgttcatttcgagagggtctgttacaattttttcaaatacttttgactaatgttgcaagagttccacttag

SEQ ID NO: 20064 - protein, 530 aa, Panicum virgatum
  misc_feature: Ceres CLONE 1809875
  misc_feature (254)..(502): Pfam Name: Pkinase_Tyr Pfam Description: Protein tyrosine kinase
  misc_feature (141)..(205): Pfam Name: ACT Pfam Description: ACT domain
  misc_feature: SWISSPROT Homolog: EC 2.7.11.1 Non-specific serine/threonine protein kinase
MAAESCGSRGASPPPPPSSAGGGAAGRRRKAEAYAEVLRRIRAGGYGGGRPELEDELWAHFQGLPARYALDVNVERVEDVLLHKKLLEQARDPMNGLVFDVRPSQVLTLEENTGFESSTSFKQEQDPRCSAFASRDQRPLHEIIFACDDKPKLLSQLTSLLGELGLNIQEAHAYSTNDGYSLDIFVVEGWEYEVDILRNALRKGVDKIKYRAWPLVQSMSARIDHQPLEVSASSNFVQIPVDAADVWEVDPRLLKFEQKLASGSFGDLYHGTYCSQDVAIKVLKPERVSVDMLREFAQEVYIMKKVRHKNVVQFIGACTRPPILCIVTEFMHGGSIFDFLYNRQGSFQLPDVIRIASDVSKGMNYLHQINIVHRDLKTANLLMDDQVVKVADFGVARVKDQSGVMTAETGTYRWMAPEVIEHLPYDHRADVFSFGIVLWELLTGKLPYEDMTPLQAAVAVVQKDLRPTIAADTHPMLADLLQRCLQKDPALRPTFAEIVDILNSIKEVVQSSGHHKRHSGRSHSGRRRGC

SEQ ID NO: 20065 - DNA, 715 bp, Panicum virgatum
  misc_feature: Ceres CLONE 1809885
  misc_feature: Encodes the peptide sequence at SEQ ID NO. 20066
gaaattcgcacgcaaaagcaaagcaactgcttaaattgaaaaagaaaaaacagagctcaccaattcaactgaagagcaatcacaactaccctaccctccgccgccgtcgccgacgaagacctagctccgtcgcgatggccgccgccgcccgcgcgggccgccgcggcggacccgaggcgcgcctcctcgtggcgctcctcctgctcgcgctggtcgtctccgaccactgcctggacgcgcaccaccgcgggctgaagcgccgccgccggaagcacgagatccactccccgatcaagacggtggtggtcgtcgtgatggaaaaccgcagcttcgaccacatcctcggctggctccgccgcacccgccccgatatcgacggcctcaccggccgcgagtccaaccacctcaacgcctccgacccctcctccccggagatcttcgtcaccgacgaggccggctacgtcgactccgacccgggccacggcttcgaggacatccgcgagcagatcttcgggtccgccgacacctccgccgtgccgccccccatgtcaggcttcgcccagaacgcgcgcgggatgggcctcggcatggcgcagaacgtcatgagcggattcaagcccgaggccatccccgtctacgcctccctcgccgatgagttcgccgtattcgatcggtggttcgcctccgtgcccacctccacgcagcccaaccgcct

SEQ ID NO: 20066 - protein, 193 aa, Panicum virgatum
  misc_feature: Ceres CLONE 1809885
  misc_feature (53)..(193): Pfam Name: Phosphoesterase Pfam Description: Phosphoesterase family
  misc_feature: SWISSPROT Homolog: EC 3.1.4.3 Phospholipase C
MAAAARAGRRGGPEARLLVALLLLALVVSDHCLDAHHRGLKRRRRKHEIHSPIKTVVVVVMENRSFDHILGWLRRTRPDIDGLTGRESNHLNASDPSSPEIFVTDEAGYVDSDPGHGFEDIREQIFGSADTSAVPPPMSGFAQNARGMGLGMAQNVMSGFKPEAIPVYASLADEFAVFDRWFASVPTSTQPNR

SEQ ID NO: 20067 - DNA, 1597 bp, Panicum virgatum
  misc_feature: Ceres CLONE 1809887
  misc_feature: Encodes the peptide sequence at SEQ ID NO. 20068
gacgcaagagctagctagtagccggcgccgccgatcgatcgagcagctagctcggcctctcgctctccccgtccgtcctacgcagcgtgatcgaccgagccgagcgagctgcctgctgctccgatcgagctcatcatcagctagctagctactagctaggccgatcgaacgaccggccatggccgccgcctccaccccgtcgagggccaactcgcgggtgaactactcgaacgagatccacgacctctccaccgtgcagagcggcggctccgccgtccccaccatgtactacccggagaagtccctcgccgacatcttcccgccccacctcctcaagaaggtgatctcggaggtggtggcgacgttcctgctggtgttcgtgacctgcggcgcggcgtccatctacggcgaggacctcaagcgcatctcgcagctggggcagtcggtggccggcgggctcatcgtcaccgtcatgatctacgccaccggccacatctccggcgcccacatgaaccccaccgtcacgctctccttcgcctgcttccggcatttcccctggattcaggtgccgttctactgggcggcgcagttcacgggggcgatgtgcgcggcgttcgtgctcaaggcggtgctccaccccatcgccgtgatcggcaccaccacgccgacggggccgcactggcacgcgctcgtcatcgagatcgtcgtcaccttcaacatgatgttcgtcacctgcgccgtcgccaccgactccagggcggtgggtgagttggccggattagcagtcggttccgcggtttgcattacgtcaatcttcgcaggtgaaatggaattaaaagagaagatgaaagtgatcgggtgctctaacctaagaggaggagggggtgaattaggagaggctattgcaccatcctcgagtcattcattgcgtgtctctgcctagctagctagccatcgagccctagagctgagcaccggctcctagttaccgtcgcgggcctccgccaccgggccacttgtgtcacccacctcagtttgcaggacgtatagcaagatacggatggaaatatgcagaactttaggcccagatggaagcagccttccaagcacggcaggaggcggcagaggagaggtggagggccgagcgggacgacatccagcaaaaattggatcaaactctaacatttatgcaaagcctgggctcgccgatgggtgtttcgcctccacaattccctccggccccacttgttcgtcgtgcagaaactcctcctaccaatcagtcggcggcatccaatgatgggccagtgaatcctgacttctcgcctccggtgcagcagactcaacagcctcagcagtttgtgtggccaccgccttaatgggtggcttggattcagcagcagcagcagccaggttggtcgcagacgcctacatggccgcccccgcagatgtggccgcagcacccgccaccgccgccgccatcggccccgtgagttatgttgtatggacttgctttgtaccacttttatggatttgtttgaacttgatttgtatgaactcgaccagtacttgtggttgtcgatgaacgaaacaagacttt

SEQ ID NO: 20068 - protein, 254 aa, Panicum virgatum
  misc_feature: Ceres CLONE 1809887
  misc_feature (45)..(218): Pfam Name: MIP Pfam Description: Major intrinsic protein
  misc_feature: Functional homolog of the protein sequence given in SEQ ID NO 50898
  misc_feature: Useful for making plants with modulated silicon content
MAAASTPSRANSRVNYSNEIHDLSTVQSGGSAVPTMYYPEKSLADIFPPHLLKKVISEVVATFLLVFVTCGAASIYGEDLKRISQLGQSVAGGLIVTVMIYATGHISGAHMNPTVTLSFACFRHFPWIQVPFYWAAQFTGAMCAAFVLKAVLHPIAVIGTTTPTGPHWHALVIEIVVTFNMMFVTCAVATDSRAVGELAGLAVGSAVCITSIFAGEMELKEKMKVIGCSNLRGGGGELGEAIAPSSSHSLRVSA

SEQ ID NO: 20069 - DNA, 704 bp, Panicum virgatum
  misc_feature: Ceres CLONE 1809911
  misc_feature: Encodes the peptide sequence at SEQ ID NO. 20070
atttccagccacgagcatttctgaaaaaagaagaaggaaaaagatcattccacccgaggcttggaaggctcgaactagctaagagcccaagacctcacagcgtcggcagcggaagcggccggatcgtcggctgcggcggcagcggagatggcgtccgtggccgccgcggagggcgcggcggcggcgctccgctcggtgctgtcgcgcgcgcagcaggcggcggcgcgggcgggtcgcgcgccggggtccgtgcgggtggtggcggttagcaagaccaagccggtgcccgtcatccgcagcgtctacgacgcgggccaccgctgcttcggcgagaactacgtccaggagctcatcgacaaggcgccccagcttcccgaggatattgagtggcacttcattgggaacttgcaaagcaacaaagccagagccctacttgctggcgtgccaaatcttcatatggttgagagtgtagatgacgagaagattgctaaccgtcttgatcgcgtggtagctgacttggggagaaaacctcttaaggttttggtccaagtcaacactagtggagaggaatcaaaattcggagtagatccgtcaggatgcgcggaattagcaaagcatgtcaaattgagctgcccgaaccttgtgttttctggcttgatgacaattgggatgcttgattactcctccactccagagaatttcag

SEQ ID NO: 20070 - protein, 185 aa, Panicum virgatum
  misc_feature: Ceres CLONE 1809911
  misc_feature (9)..(183): Pfam Name: Ala_racemase_N Pfam Description: Alanine racemase, N-terminal domain
MASVAAAEGAAAALRSVLSRAQQAAARAGRAPGSVRVVAVSKTKPVPVIRSVYDAGHRCFGENYVQELIDKAPQLPEDIEWHFIGNLQSNKARALLAGVPNLHMVESVDDEKIANRLDRVVADLGRKPLKVLVQVNTSGEESKFGVDPSGCAELAKHVKLSCPNLVFSGLMTIGMLDYSSTPENF

SEQ ID NO: 20071 - DNA, 1715 bp, Panicum virgatum
  misc_feature: Ceres CLONE 1809923
  misc_feature: Encodes the peptide sequence at SEQ ID NO. 20072
atcaggggaagacgactccacctctggaggcggagcaatggagtccggcgagctcctgcgccgacccgggccgtccgctggctccaaatccgacgtccggggcggctggtgcgcggcgttctacctcgttgtggtcgcgttcttggagcgcctcgggttctacggcgtgcagggtaacctgatcatgtacctgaccggcccgctcggcatgcccacggcggccgcggccgccggcgtgaacgcgtgggccggcaccgtgcaggtgctgccgcttgtcggcgcgctcgccgccgactcgcgcctcgggcggtaccgcgctgtcctggccgccggcgtgctctatctgctgagcttggggatgctgacggcctcctccgcgctgcaagcagcgcagcctcactctgcgagctcgccaccgtcgacttctcctgcgcacctcaccttcatctacgtcgcgctctacctcctggcgctggcgcagggcttccacaggccgtgcgcggaagccctcggcgcggaccagttcgcgctgagcgacggcggcgaccccagctcgcccgcgtcgcggagctcctacttcaactggttccacttctccatctcgtggggctacgccacgtccacgacggcgctgagctacgtggaggacaacgccggctggaccgccgggttcggcgcgtgctgggccgtgatagtgctcagcctagccgtcttcttgctcggcgcacggacgtatcgtgctgaggaacccgtcgacggcagccgattcgtcgagaccgtgcgcgcatgggccgcgaggttcttccaccgcaaggatgccgctggcaccgaacgacttctagatcgacaacccgaggagggtgaaggagtcgtcgtgaagctgctcccaatatggttgggtgccatggtctacgcggccgtcacttcgcaggtctacactctgttcaccaagcagggcagcacgctggaccggcgcctcggcacggggcttgtcgtgccacccgcggcgctccagtgcctggtcagcttcaccttcatcgccatgctcccggtgtacgatcgggtcttcgtgcccctggcgaggcgcgtcaccgggcaccccgccggcgtcaccacgctccagcggataggcgctggcatggccatgtcctgcgccgccatggccgtcgcggcgctcgtcgaaggcaggcggctccgcgtggccacggccgcgggcctggtggataggccggacgtggccgtgccaatgagcctgtggtgggtggcgcctcagtacgttctgatgggcctggcgatggcactggccgacgtcggcctggaggagttcttctacgaccaggtacccgacacagtccgcagcatcggcctcgcgctgtgcctgagcgccatgggcgcggggagctacgccagcggcatgctcgtgtcggcggtcgactgggcgaccaggggcagcggggagagctggatctccgacaacctcaaccgagcgcacctcgactacttctactggctcctggcagggctcgccgctctagacgtcgccgtctttttgtatttttcaaagcggtttgtgtacaggagcaaaggcgagcagcgatgatatgccccctgcgggcagtgctgttcgtcttcggcttctatcggtagtgattgatatatagttgaatgacaggagcaaaggggaataggccgtgtccccaatcgatttgaaaggc

SEQ ID NO: 20072 - protein, 520 aa, Panicum virgatum
  misc_feature: Ceres CLONE 1809923
  misc_feature (92)..(451): Pfam Name: PTR2 Pfam Description: POT family
MESGELLRRPGPSAGSKSDVRGGWCAAFYLVVVAFLERLGFYGVQGNLIMYLTGPLGMPTAAAAAGVNAWAGTVQVLPLVGALAADSRLGRYRAVLAAGVLYLLSLGMLTASSALQAAQPHSASSPPSTSPAHLTFIYVALYLLALAQGFHRPCAEALGADQFALSDGGDPSSPASRSSYFNWFHFSISWGYATSTTALSYVEDNAGWTAGFGACWAVIVLSLAVFLLGARTYRAEEPVDGSRFVETVRAWAARFFHRKDAAGTERLLDRQPEEGEGVVVKLLPIWLGAMVYAAVTSQVYTLFTKQGSTLDRRLGTGLVVPPAALQCLVSFTFIAMLPVYDRVFVPLARRVTGHPAGVTTLQRIGAGMAMSCAAMAVAALVEGRRLRVATAAGLVDRPDVAVPMSLWWVAPQYVLMGLAMALADVGLEEFFYDQVPDTVRSIGLALCLSAMGAGSYASGMLVSAVDWATRGSGESWISDNLNRAHLDYFYWLLAGLAALDVAVFLYFSKRFVYRSKGEQR

SEQ ID NO: 20073 - DNA, 1671 bp, Panicum virgatum
  misc_feature: Ceres CLONE 1809934
  misc_feature: Encodes the peptide sequence at SEQ ID NO. 20074
gaggtcaccctccgcgctgccgatctccggctgccagcggcggcgaccgtcacctccggccgagctcgcctgccccactgatccgccggcgaaagtcaccttcgtccgagcctgcttgctccgacgactgcgccccacctgccactcccgcgatggggaagctgcgcaccgccgcctccaactccggcgacctgcccctggacgcgctgagcgagatcctgctgcgtttctcagccaaggagctctgccgcctccgcgccgtcagccccacctggcggtccctcacctacgaccgggccttcatcgctgcccacagggcccgccaccgggagccgctcctcgccttcgcccgccgcgacgacgaccatggtcacagcgtcgacatcgtggatctgtccggcgagctcgtgaggcggatgccgagacccgagaacggcgtcggcgtgcttggaactcgcctcgacctcgtccccgtcgcgtgcaggtaccggcacatggctctctgggtgctgaacccgtccaccggtgctgctctggcgttgccagattgccactcggagtacatggggaacgggccggaccagcggttcgtctttggctgtggctttgtggagaggtatgcaatgggccgggtctccactggagagtacaaggcactccgcatcacccgctgctcttttcgctccaaagataaggtctgtgaggtgatcaccattggcgctgatggcagcaaccacggagtgtggagggaaatgcctaggactccctcccttatgtgtacaggtgatgatgtgcgcaggagtccctcgattgcggacgagatgaaatgtgtggttgtggatggactggtgcatttcttgatagagtttaaatccaacaacttaggggaggccagttgtgagcctggcagcatagcttccttcaacttggagactgaggagtggatgccgattctccatgggcctgatcccgtgcgttcatttgttctggacaacaacaggaagtactcatatgaggacctgggtacgcaattatcgttgtcgaatttatctggctgcttggttacagttcataatattcataacacttccatggacctatggtttctgtctgattttgagaaggggctgtggattaaaatgtacagcttgccttcccaggttgctcggttacttgtgtatccattgctggtattggatgatgagaggatattatttgtgcatcgaataaatttgttcgtatgctttgacctgaaaactggcatttacacttacaacctgaaaactagtgcttgcactcgtgtgttcgacttggacatgggaggttctgattcaggatccattggcgtttacaccggaagtctgctgagtgcatagagatgttgtcagttggcactgatgagttatcatctataatgttgtggtggttaggaagtagttgcgtgctagaggatgaaggtcaatacttggctctgaagacttgaatgttaatatgcaggaaggctattttcagtaatgtgtggtactgcagacttcatatgggttttacagataactgcgcttggtgattcatgggctacttctgtatctactgccctctgaaccttctttcagaacagtgaacacaatcatgttgagccactgagacctgtttctttcaggcgtttccgtg

SEQ ID NO: 20074 - protein, 407 aa, Panicum virgatum
  misc_feature: Ceres CLONE 1809934
  misc_feature (9)..(56): Pfam Name: F-box Pfam Description: F-box domain
MGKLRTAASNSGDLPLDALSEILLRFSAKELCRLRAVSPTWRSLTYDRAFIAAHRARHREPLLAFARRDDDHGHSVDIVDLSGELVRRMPRPENGVGVLGTRLDLVPVACRYRHMALWVLNPSTGAALALPDCHSEYMGNGPDQRFVFGCGFVERYAMGRVSTGEYKALRITRCSFRSKDKVCEVITIGADGSNHGVWREMPRTPSLMCTGDDVRRSPSIADEMKCVVVDGLVHFLIEFKSNNLGEASCEPGSIASFNLETEEWMPILHGPDPVRSFVLDNNRKYSYEDLGTQLSLSNLSGCLVTVHNIHNTSMDLWFLSDFEKGLWIKMYSLPSQVARLLVYPLLVLDDERILFVHRINLFVCFDLKTGIYTYNLKTSACTRVFDLDMGGSDSGSIGVYTGSLLSA

SEQ ID NO: 20075 - DNA, 724 bp, Panicum virgatum
  misc_feature: Ceres CLONE 1809940
  misc_feature: Encodes the peptide sequence at SEQ ID NO. 20076
ctcgccattccctcctctctagagctttgctcggtctacctcgcgcttcccgagctctcatcgccgagagaggcggagggaggggctcgaggagccagcgggcggcggcaaatgacggaggcggcggcggcggcggcggcggcggcggcggggttcaaggcggcgaggcgggcggggctcgcggcggcgctgctgctgttcgtcctcgtcgtggtggtcgccggcggacccggcggccgggtgctccacgggctccagccccggagcgcggcggcggcgggcggctcgaggcggtggctgcgggactcgtcatggccggcggcggcgacgccgagggccgacggtgacgacgacgggccagcgatggccgttcgcggcgcggtggaggacccggaagcggtggtcgacgacgtgcacatgtccatcaggaacagcacggcccggcggaatctcgggtacctgtcgtgtgggacgggcaaccccatcgacgactgctggcgctgcgacccggactggcacaagaaccgccagcgcctggctgactgcggcatcggcttcggccgcaacgccatcggtggccgcgacggcaagatctacgtcgtcactgacccgagcgacgacgacgccgtcaacccgcgcaagggcaccctccgctacgccgtgatccaggacgagccgctctggatcatctttcagcgggatatggtgatcacgctcaagcacg

SEQ ID NO: 20076 - protein, 204 aa, Panicum virgatum
  misc_feature: Ceres CLONE 1809940
  misc_feature: SWISSPROT Homolog: EC 4.2.2.2 Pectate lyase
MTEAAAAAAAAAAGFKAARRAGLAAALLLFVLVVVVAGGPGGRVLHGLQPRSAAAAGGSRRWLRDSSWPAAATPRADGDDDGPAMAVRGAVEDPEAVVDDVHMSIRNSTARRNLGYLSCGTGNPIDDCWRCDPDWHKNRQRLADCGIGFGRNAIGGRDGKIYVVTDPSDDDAVNPRKGTLRYAVIQDEPLWIIFQRDMVITLKH

SEQ ID NO: 20077 - DNA, 449 bp, Panicum virgatum
  misc_feature: Ceres CLONE 1809943
  misc_feature: Encodes the peptide sequence at SEQ ID NO. 20078
gtgtggctcctccttccgcttcttctcccctcctgccggtcccgaaaagagagctgcagccccaaatgttggtggagtaatttacccattaacctttatgcagatggcttggccgcgaagagcttcctattcaccttccatttcttgagcgatgcccacctctaccatttgtgctactcttcgctccatcctctcctgttactcgtgatctggcgcatgaccccgacctcctcgtggcctgccagacctgcaccaagactaacatgatgatggtgttccgcaacatatccaccagcgccaccgtcaactatgagaaaatcgtgctcgacacctgcagcgagatcgcgcttcacctccgacaagttggccctctacgcataccgctgcgaggtgatcatctacatccaacggccgaccccctacctcgcgcagggcatgtccctccactt

SEQ ID NO: 20078 - protein, 61 aa, Panicum virgatum
  misc_feature: Ceres CLONE 1809943
  misc_feature: SWISSPROT Homolog: EC 2.5.1.6 Methionine adenosyltransferase
MMMVFRNISTSATVNYEKIVLDTCSEIALHLRQVGPLRIPLRGDHLHPTADPLPRAGHVPP

SEQ ID NO: 20079 - DNA, 695 bp, Panicum virgatum
  misc_feature: Ceres CLONE 1809983
  misc_feature: Encodes the peptide sequence at SEQ ID NO. 20080
aaacaaactccaacagaagacggagcagcagtagagtcctccactcctcctcttggtcttccgcatcgcaatcctcgcctcgccggcctctccatctctatttatccgcccgccggatttccagatcgagcgaggcgacaaggacgagcagttgggggatcgccgcacccggaattcagccagagctcggatccgggcaggggcagagatggccatggaccacgcagcggcggagggggaccacctcgccgccgagagggccgcggcgcgcttcgacgtcgaggcgatgaaggtcgcgtgggccggctcgcggcacgccgtcgacgtcgccgaccgcatggcgcggctcgtcgcgtccgacccggtcttccgcaaggataacaggaccatgctctccaggaaggacttgttcaaggacactctaagaaaagctgcccatgcgtggaagcgcattgtcgagctacgtcttacagaggaggaagcaagtctgctgaggcaatacgtcgatcagcctggttatgttgatctgcattggggcatgtttgttcctgctataaaagggcaaggaactgaggagcaacagaagaagtggttacctctggcttacaagttccaaataattggatgctatgctcagactgaacttggtcacgggtcaaacgttcagggacttgaaaacactgctacatttgatc

SEQ ID NO: 20080 - protein, 160 aa, Panicum virgatum
  misc_feature: Ceres CLONE 1809983
  misc_feature: SWISSPROT Homolog: EC 1.3.3.6 Acyl-CoA oxidase
MDHAAAEGDHLAAERAAARFDVEAMKVAWAGSRHAVDVADRMARLVASDPVFRKDNRTMLSRKDLFKDTLRKAAHAWKRIVELRLTEEEASLLRQYVDQPGYVDLHWGMFVPAIKGQGTEEQQKKWLPLAYKFQIIGCYAQTELGHGSNVQGLENTATFD

SEQ ID NO: 20081 - DNA, 1729 bp, Panicum virgatum
  misc_feature: Ceres CLONE 1809987
  misc_feature: Encodes the peptide sequence at SEQ ID NO. 20082
gagaactccccttctccgccgctacccaagcctcccccctgtatccccccacccgccgccgccgctgctgctagggagcttccacccgcgcgcctacaacgagagctagcagcagcgagcggtcgctatcgggtgccgctccggccgtgccagtgctcgccaaccctaaccccccgatgccgtatatggtgggggccgccgactcggcggccgagcggccggggggcctgccgaggagcggctcgtccagccgcctcaacgcgcaggcgccggagttcgtgccgcgggggccgccgtcgccggcgcccgcggtcgtggtgccaccgccgccgccgcaggtgatccgagtgttcgccgcgccgcccccgccgccgcgcgccgccttcttcgcggcgcccccgccccggccgttcgagtacttcgcgccggtggggggacgcgccggatttaccaccaaggagcggcaggtgctggagccagagccggatgtggagctgatcccgcccgcggcgcaggcggagccggtagcggacgggctcgaagatgaggtggtgcacaagatcaccaagcaggtggagtactattttagtgatataaatctgactaccacagaacatttgatgagattcatctccaaagatcctgagggatatgtgccaatatcagttattgctggcttcaagaaagtaaaagcttctgtgcgtaataactccatgcttgctgcagctctccgagcctcatcaaaacttgttgtaagtgatgatggaaaaagggtcaaacgtcaacagccatttactgaatctgatttgcaggagctcaagtcccgaattgttgttgcagaaaatcttcctggtgatccttcgtaccagaatcttaagaagatattttcagctgttggcagtgtgatttcaatccgcacttgctatcctcagactccaaatggctctggtcctgcaactaatagatctgccaagctagatatgctttttagtaacaagctgcatgctttcgtggagtacgagacacctgaggatgctgagaaggcaattgtggcgcttagtgatgaggaaaactggagaaatggacttagagtccgcttgctgaatgcttgctcggcaaaggggacaggcaagagcaaaaaggaagcacatgaaactaatggaaatgctgaggaagatgtctccatttcgaaccaatcaaatgagaaacagtctgaagaatcctctcaactgttagatgtgttgccagagcacttgtttgacgagaccttcaatgagaaggaagttccaaaacgtggcagaggacgcggtcgaggtggcagggggcgtgggcgtggcaaccaccagtacaacaaccagcagtaccagaaccaccagccgcactacaatcaccacggcaacaaccaccacggtggtgcccacccggttggaactccggtgcacaacctgataaacaagcccgagcagcatcagcagctgccgattggggccagcaagcttcctccggggccccgcatgcctgatggtacccggggtttcgccatgggcagagggaagctgcaagctgtgctgccaggtctgtgtgctgttggggagccttaaaatgttggtggtgagcgagaggcattgcttattgctgctcttgtttgtataccttacggcgggtgaatttctgtgtcaaaagacttgtttccagatggatgcgtgcgaaagtgtttcgacgtcttgtc

SEQ ID NO: 20082 - protein, 474 aa, Panicum virgatum
  misc_feature: Ceres CLONE 1809987
  misc_feature (129)..(188): Pfam Name: La Pfam Description: La domain
  misc_feature (22)..(39): Pfam Name: PAM2 Pfam Description: Ataxin-2 C-terminal region
MPYMVGAADSAAERPGGLPRSGSSSRLNAQAPEFVPRGPPSPAPAVVVPPPPPQVIRVFAAPPPPPRAAFFAAPPPRPFEYFAPVGGRAGFTTKERQVLEPEPDVELIPPAAQAEPVADGLEDEVVHKITKQVEYYFSDINLTTTEHLMRFISKDPEGYVPISVIAGFKKVKASVRNNSMLAAALRASSKLVVSDDGKRVKRQQPFTESDLQELKSRIVVAENLPGDPSYQNLKKIFSAVGSVISIRTCYPQTPNGSGPATNRSAKLDMLFSNKLHAFVEYETPEDAEKAIVALSDEENWRNGLRVRLLNACSAKGTGKSKKEAHETNGNAEEDVSISNQSNEKQSEESSQLLDVLPEHLFDETFNEKEVPKRGRGRGRGGRGRGRGNHQYNNQQYQNHQPHYNHHGNNHHGGAHPVGTPVHNLINKPEQHQQLPIGASKLPPGPRMPDGTRGFAMGRGKLQAVLPGLCAVGEP

SEQ ID NO: 20083 - DNA, 1579 bp, Panicum virgatum
  misc_feature: Ceres CLONE 1809989
  misc_feature: Encodes the peptide sequence at SEQ ID NO. 20084
agcacagctcctgtcccttgtaccggacgagagccaaaccaggcgaagctcactggcggctagggttttgcggcatcccgcagtgtacaaaccctagagctctcgcacctattcatggctattcagtctctgatcaccatgtgctaggtttctatcggggtttggggattggaccgctagttgtatcgcggtttggggattagagcaagcggaaatggcgtcgaggaaccaattcgatctccttggggatgtcgacaacgacgaccccgccgacctcctcgctgctgcagagaagaaggcggcagcggcgcccaagccggcgcccgcgcccgcgccggccaagctgcccaccaaacctccgccgcccgcgcaggctgtgagggaggtcaggaactatggtgctccgccacgcgatggagctggacgtggtggtccaggacgtggaagaggcggccgtagtggcaggactggcccaaggcgagatttcggcgatgctgatgccaatggctttgagggagggtatggtggtggctttggagatgggggagtggctcgcggtgaaaacggtgaggggaggcaggcagagaggggccgcggaccgcgccaaccttactgtggaggcggccgtcgtggtggctttgttgatgggcaggctgtggatgagtttgggcgtccacgccgggcatatgagcgccacagcggcactggccgtggctatgagatgaagcgcgagggggcaggacgtggcaattggggaactgtaactgatgaaggccttgcacaggatgctgtggaggctgtaaatgttgaggagactactgctgcggctgaggatgagaagcctgaagatgcaccacagtccgaggttgagaaggacaaggagggtgtggagaatgaagaggaagaaaaggaacctgaggataaggagatgactctagaggaatatgagaaagtactggaggagaagcggaaagctctgcttgcccttaaggctgaggagagaaaagttgaaattgataaggagctgcagtccatgcaacaactgtctgttaaaaaggatgctgatgaagtgtttatcaagctgggctctgacaaggacttgaaaaagaaagaaaatgcagaaagagatgagcgtgcaaagaagtccctgagcatcaatgagttcttgaaaccggctgaaggtgagaggtactacaaccccagtggccgcgggcgtggccgtggcaggggccgtggtgagcgtgggggattctgcggaggttactacggtggttatcggggaccagctgcagctccagcgatcgaagaccaggctcagttccctgccctggcgtagacgctcggttccctgtaggttcgctcaagtttgttcactgtcattgggtcttctcttctccgcgtcatcactgttgctgctgctggttctatcctggtatgtttgtcgccgcgtcgtgtatcccgtgtgcatcctaggtgcaccgagtgctctgttgtgttttcaggtgttagccgcttctgttttttttataggactatgtatcgaacgtttctgatgtactatccagtggttagtcagctg

SEQ ID NO: 20084 - protein, 373 aa, Panicum virgatum
  misc_feature: Ceres CLONE 1809989
  misc_feature (154)..(266): Pfam Name: HABP4_PAI-RBP1 Pfam Description: Hyaluronan / mRNA binding family
MASRNQFDLLGDVDNDDPADLLAAAEKKAAAAPKPAPAPAPAKLPTKPPPPAQAVREVRNYGAPPRDGAGRGGPGRGRGGRSGRTGPRRDFGDADANGFEGGYGGGFGDGGVARGENGEGRQAERGRGPRQPYCGGGRRGGFVDGQAVDEFGRPRRAYERHSGTGRGYEMKREGAGRGNWGTVTDEGLAQDAVEAVNVEETTAAAEDEKPEDAPQSEVEKDKEGVENEEEEKEPEDKEMTLEEYEKVLEEKRKALLALKAEERKVEIDKELQSMQQLSVKKDADEVFIKLGSDKDLKKKENAERDERAKKSLSINEFLKPAEGERYYNPSGRGRGRGRGRGERGGFCGGYYGGYRGPAAAPAIEDQAQFPALA

SEQ ID NO: 20085 - DNA, 2011 bp, Panicum virgatum
  misc_feature: Ceres CLONE 1809990
  misc_feature: Encodes the peptide sequence at SEQ ID NO. 20086
actttgcggctccgtctcacggcctcagcttcccagtcagcgcgcgctccgctcccatggcatcggaggcgcccacgcccacgggcatgcccgtcgtcgtcacgggcaacttcggcgacctcgtcccgctcgctcgtgccatcgcagcgcccctcgccgccgtcctccacccgggggacgttgccgcgctcgtcgccgatgtcagcgtcgagtcgtgtgtcatgggcctggcgttacgctgggcgggcgccacggtgaagatgcacaaccggggcgacacgcaggaggggtttgagctgaagctctccgccaccaacgtccgcctcatcgtcaccatcgccgagggcaacgccgccgcgcaggccgccgcggacaagctcggcctcgtccacgtcaccgccagcgtgcagaatgaagcggacggccaggtacacgtccgccttgccgggctcccggtggagtcccacgccacgaacgggaacgcctcccaaggttcgggcttccccgcgtcggcgacgccgattcgcgcggcagtgccggagtcgtcgcacaacgccgcgcgcctgaagcattgcagggtgtgcatcgtcggcggcgggccctcggggctcgccgtggcggcgtgcctgaggaaccgcggcgtcaccgccgtggtcatcgagcacggcgaccgcatcgctccgctctggcaggagcgcacctacgacggccaaaagcagcacctccccaagagtttgtgcgagcttccgctcatggcgatctccgacaaatacccggagtacatcaccggcaaccagtacatcgactacctcgagggctacgccgccatgttcgacatcaggccggagttcaacagcaccgtggtgtcggcccgctacgacgacacctccggcctgtggtgcgtgcgcgcgcgcgccgcggaccccgccgttagtgacatggagtacatcgcccgctggctcgtcgtcgccaccggcgagaacgcccagcgcgtcgtcccgaacatcccgggcctacggaacagcttcactggcgaggtcatgcacatcggcgactacgagcacgacgaggcctaccgcgggaagcgtgttctcgtcgtcggcagcggaaactgcgccatggatgtcgcgctcgacctctgcgcacacggcgcccgcccgatcgtggtggcgcgggacgccgtgcacgtcctgccccgcaagatgttcgggagacacacgctggaggtcgccagcatgctcctggagcgctggcggctcccgcgctggttcgcggacaagatactggccctcaccgctcggttcgtcctcggcgacgtcgccaagctcggcctccgccgccccgccaacgggccgctggagcgcagcgggacccgcgtccacacacgggtgttcgacttcggcgccctggaacacatccgcgccggcgacatcgatgtggcccccggcgtcgcccgcttctgcggcggcaaagccgagctggtgaacggtcaagtcctcgacatcgatgccgtcgtgctcgccaccgggcggcgcagtaacttgccgcaagccgagtggcatggagaccggagcgggtaccccgcgaccgcgttcccctacggctggcgcggacaatgcgggctctacgccgttggcttctcgcgccgcagtttcggtggcgcgcccaaggacgccgtgcgcgtcgcggaggacatcgtcggggcttggagggacctcagggagggggccgagcccgccgccggccacggcgagaggaagggcgtccatgtcatcttctgaagttctgatagacctccgatcggcaggcctgtccgtgtcgagatacgaacggaaagagcacagcagctttatactaatagccttttgagttttaaatctgttttgttttcgttcgggtttggagcagcaatgggcgtggttggagaaatagtttttagctattcgggctagagctattttattcaaacaaataatcttccaatgaaatagctatttacatgtttggattc

SEQ ID NO: 20086 - protein, 574 aa, Panicum virgatum
  misc_feature: Ceres CLONE 1809990
  misc_feature (174)..(534): Pfam Name: Pyr_redox_2 Pfam Description: Pyridine nucleotide-disulphide oxidoreductase
  misc_feature: SWISSPROT Homolog: EC 1.14.13.8 Flavin-containing monooxygenase
MASEAPTPTGMPVVVTGNFGDLVPLARAIAAPLAAVLHPGDVAALVADVSVESCVMGLALRWAGATVKMHNRGDTQEGFELKLSATNVRLIVTIAEGNAAAQAAADKLGLVHVTASVQNEADGQVHVRLAGLPVESHATNGNASQGSGFPASATPIRAAVPESSHNAARLKHCRVCIVGGGPSGLAVAACLRNRGVTAVVIEHGDRIAPLWQERTYDGQKQHLPKSLCELPLMAISDKYPEYITGNQYIDYLEGYAAMFDIRPEFNSTVVSARYDDTSGLWCVRARAADPAVSDMEYIARWLVVATGENAQRVVPNIPGLRNSFTGEVMHIGDYEHDEAYRGKRVLVVGSGNCAMDVALDLCAHGARPIVVARDAVHVLPRKMFGRHTLEVASMLLERWRLPRWFADKILALTARFVLGDVAKLGLRRPANGPLERSGTRVHTRVFDFGALEHIRAGDIDVAPGVARFCGGKAELVNGQVLDIDAVVLATGRRSNLPQAEWHGDRSGYPATAFPYGWRGQCGLYAVGFSRRSFGGAPKDAVRVAEDIVGAWRDLREGAEPAAGHGERKGVHVIF

SEQ ID NO: 20087 - DNA, 2126 bp, Panicum virgatum
  misc_feature: Ceres CLONE 1810004
  misc_feature: Encodes the peptide sequence at SEQ ID NO. 20088
aattttgatgcttaaaccctcgccgggagggccgactccgccaatcccgacgcgcgccaccgcccccggatctccgccgccatggccgccgcgccgccgcaggcccagcagggctccgcagacagcgtgatcccgctgcagtcggaagctgtgctggagaataacccctccaagagcgcaagctccaaggatcaggtaatttagtttcccgttatggtgtatttccctctcttgtgcgatttgaaatgttactcgtaagttttttttttttttttgctattgcggcagattctttctggtacagagaatacgaatgcaagcaatgcccgtggtgccacctcaataaaatctccaaaaggagcacatgagaaggctggctctgtcggaaaaggtggagagcaaccttatctctacctgcacaatgtgtatgcgccgcagccacaggctctctatcctggaggatacatgaatccttcagggcaatgggaagaatatccccattatgtgaatatggaggggctccactctgtatcacctggtatctacaatgacaaccagtcactcatgctatctcctggatatgcaaacaacccccaaatgatgtatggggcctattctcctgtttcaaccgtcggggatggccaacaatacttgcctatgcacttccctttatcaagttcatattatcagccaccagcttctcctagcatgggatactcgaactcagtgacaggaatatctcaaggagaccctatgcttcagccagagtacttccttcctgatggccttctatattcacccacaccagggtatcaccaaccattcagttcatttgacagagcaccaacacagccaaataacactcctggattatttggtcaagggaacatgccgctggcttctggaatgcatcatggatcggcgtatggtcctggatcatacaaggtacgccagcaaggtagcaaatttggaggcactactccaagttggagttctggtcgcagatttggtgctttcgacttcagtgccaatcaacaaaggggcatgccatttggtagccataatggctctctggagtttatgaatgagcaaaaccgtgggccacgcgctacaaaaccaaagatacaagacacggagaactcctcaggagatgaaaaaagtgagaaaacagttcctctgattgatagtgaactgtacaatcgccctgattttatcactgagtacaaagatgccaaattctttgtaataaagtcctacactgaggaccatgtacataggagcattaagtatagtgtttgggccagcacagctagcgggaatagaaagctggattctgcttaccgtgcggccaaagagaaagaagagcattgtcccattttcttgtttttctcggttaatggcagtggtcaattctgcggtgtggctgagatgattggacctgtcgatttcgacagaagtgttgattactggcagcaggacaagtggagcggccagttccctgtgaagtggcacataattaaagatgtcccaaacaaccttctgcggcacatcattctcgagaacaatgataataaacctgtgacgaatagcagggatacccaggaggtaaagctggaacagggcctccagatgctaaccatcttcaagaaccatgaggctgagacgacaatcctggaggattttgacttctatgagcagcgggagaaagccttgcaggagaatagacgtcaacagcagcctggcagcgccgatcctcagaagccagcagataccaaggaagctgtggccaatatgtcagacgcatttgctaaggtccagttgaaggagactgagaacagtgggaaaccccagaaagctgagggcgtgtcagctgaaaatggaaccacggctacagctaaggttgaggaaggcgacgcaaacgcgaaggcaggccctgtggaggaaagtggttgatttgtctgtctgctaatttggaagcagcagttgaatagagtgctgctgtgtgaaggttggagggggcaaagtgcaggttgattgtgttaaatatggtggccgcgtcagttgtacaacatcataggctttgtttcatctccatttaggttataatttcaatatcatagttctat

SEQ ID NO: 20088 - protein, 495 aa, Panicum virgatum
  misc_feature: Ceres CLONE 1810004
  misc_feature (306)..(396): Pfam Name: YTH Pfam Description: YT521-B-like family
MNPSGQWEEYPHYVNMEGLHSVSPGIYNDNQSLMLSPGYANNPQMMYGAYSPVSTVGDGQQYLPMHFPLSSSYYQPPASPSMGYSNSVTGISQGDPMLQPEYFLPDGLLYSPTPGYHQPFSSFDRAPTQPNNTPGLFGQGNMPLASGMHHGSAYGPGSYKVRQQGSKFGGTTPSWSSGRRFGAFDFSANQQRGMPFGSHNGSLEFMNEQNRGPRATKPKIQDTENSSGDEKSEKTVPLIDSELYNRPDFITEYKDAKFFVIKSYTEDHVHRSIKYSVWASTASGNRKLDSAYRAAKEKEEHCPIFLFFSVNGSGQFCGVAEMIGPVDFDRSVDYWQQDKWSGQFPVKWHIIKDVPNNLLRHIILENNDNKPVTNSRDTQEVKLEQGLQMLTIFKNHEAETTILEDFDFYEQREKALQENRRQQQPGSADPQKPADTKEAVANMSDAFAKVQLKETENSGKPQKAEGVSAENGTTATAKVEEGDANAKAGPVEESG

SEQ ID NO: 20089 - DNA, 693 bp, Panicum virgatum
  misc_feature: Ceres CLONE 1810022
  misc_feature: Encodes the peptide sequence at SEQ ID NO. 20090
ctccgctccttccccattgctgaaagctcagtggcatcatcgtcgaggtcgaggcgctcctgcagtcctgctggctgccatggagatgcagcagctcgacgactactctccggacaagctcgccagccttgctcttgcgcccagcaaagggcgtacggactcacaggaaggcagctggagcgcgccggagaggccggtcgagaactggcgtgcgatcaactcgaggaggaacgccaagtggtggtacgccgccttccacaatgtcaccgccatggtcggcgccggcgtgcttagccttcccttcgccatgtccgagctcggctgggggattggcatcacggtgctggtcctgtcgtggatcatcacggtgtacacgctgtggcagatggtggagatgcacgagatggtgccgggcaagcggttcgaccggtaccacgaactcgggcagcacgcgttcggcgagaagctgggcctctggatcgtcgtgccgcagcagctgatggtggaggtcggcctgaacatcgtctacatggtgaccggcggccagtcccagcagaagttccacgacctggtctgccatggcaggtgcaacaacatcaagctcccctatttcatcatgatcttcgcctccgtccagttcgtactctcccagctcccccacttccactccatctccagcatctccctcatcgc

SEQ ID NO: 20090 - protein, 204 aa, Panicum virgatum
  misc_feature: Ceres CLONE 1810022
  misc_feature: Functional homolog of the protein sequence given in SEQ ID NO 50668
  misc_feature: Useful for making plants with altered oil content
MEMQQLDDYSPDKLASLALAPSKGRTDSQEGSWSAPERPVENWRAINSRRNAKWWYAAFHNVTAMVGAGVLSLPFAMSELGWGIGITVLVLSWIITVYTLWQMVEMHEMVPGKRFDRYHELGQHAFGEKLGLWIVVPQQLMVEVGLNIVYMVTGGQSQQKFHDLVCHGRCNNIKLPYFIMIFASVQFVLSQLPHFHSISSISLI

SEQ ID NO: 20091 - DNA, 2361 bp, Panicum virgatum
  misc_feature: Ceres CLONE 1810027
  misc_feature: Encodes the peptide sequence at SEQ ID NO. 20092
aagcttttctctagcgaagtttgaaccgcaaactctatttacaggggggaagagctcacctgccccaggaatttgttcttttcctctgctccagctttcagcctgcaaaaagatgccatttttgcagttcttgccggttgcctcggttccccattaaataaagatactacatttctctcctagatacattcaagattggcgggccatttgatctcgagagctcaggtacttcgcgcaaacacgaaattggacacgggaatcgcaacaatgtcagtgagccatgccgacgagcacgagatatcgctgtgcgacccaaactccgaggacgaccggcgccggcggaagatcgggtcgttccggcggaaggccatccacgcgctccggaagaagcgcggcaggcggcgcgtcaccgacttccgcttccccgccgccatctccatcgaggacgtccgcgacgccgaggaggagcgcgccgtcgccgcgttccgcgaccgcctcgccgcgcacggcctcctgcccgacaagcacgacgactaccacatgatgctgaagtttctgaaggccaggaagttcgatcccgagaaagcgacgcaaatgtgggcggagatgctgagatggaggaaagagtttggagccgacacaatcgtggaggactttgagttcgacgagctcgatgacgtgctccggtactaccctcagggttaccacggcgtcgaccgggaaggccggccggtgtacattgagaggctcggcaaggttgatccaaacaagctcatgcagatcacttcggtagaccgatacatcaagtaccatgtgcaggagttcgagaaggctttcagggagaagttccctgcttgcacgttagcagccaagagacacattgattccactactaccatattggacgtccatggcgtgggcttcaagaatttctcgaagactgcaagggagcttgttcaacgtatgcagagaatagacagtgactactatcctgagacactacatcagatgtatgttgtgaatgctggtagtggattcaagctgatctggaatagtgttaaaggatttcttgacccaaaaacttcttccaagattcatgttcttggctcaaactaccagagcaggctaattgaacttattgactcaagtgaattgccagagtttcttggtggttcatgcacatgtagtgaccagggtggttgcctcgggtctaacaaagggccatggaatgatcctgccattctgaagctgatacacagtatgggaggtggtggtagcacaagagaaaccaaacaaatttctgacgggtatgaaagaagtggatcttccctaagggcagaaaacctgaagggcttgctgagtgacgtatcaaatgctgaatcagagtcagatgttgatgatgttggtttgtcagccattcagaatagttccgaccacagcttgcttaccccagttcatgaagaagttaagggatcagattcttcaacctcttgtagttctaatagtaagcatctcctggatatgaatcctggatctcctcagggcagccaacaattggagagggtgtccattcagttgaccagtcagaaacatttttccacctttggatggctgcaaaacttagggagcatttctcttattctgcacaccacatcggctctaaggactttggaagatcttgcaagaggactggccacagtcttggtcaggatatcatccttattaaacttttttgtctgtagacaagaaaggatgataggaaatgcccattcttatgctgaagcagagcaaggaaaccctcaaactgtaagagacgaagacgtgagtgcttgtttacaacgccttgaaaagctcgagtcactgtgcaatcatatgatgagcaaacctccagatatgccaaaggataaagaacttttactgctgcagtctttcgatcggataaaatcccttgaagctgacctggagaggacaaaagtagcgttgcaggccgccatggtaaagcaaatggaattggaggagactctgcagcgccggtcatctagtggtgttaggaggagtttttgctgttcataggagtaagatcaccgttaaaccgtctggattaactgtgatgaggctgaagctggcgaccccattttttgactcgagttcttgtcagccctgtgagcgaaatatcacgcacgaaaaatcaaccacatgatcaatcggcttctgtagttgctagcagtagcctccctttgttgctacactaaacattcagtgatctccatgggctgtaagaatgagctggatgacatagcttttgcacattctctgtaaacgcagcagttgacgccattggagtacagaagcatcttcatg

SEQ ID NO: 20092 - protein, 601 aa, Panicum virgatum
  misc_feature: Ceres CLONE 1810027
  misc_feature (143)..(329): Pfam Name: CRAL_TRIO Pfam Description: CRAL/TRIO domain
  misc_feature (57)..(126): Pfam Name: CRAL_TRIO_N Pfam Description: CRAL/TRIO, N-terminus
MSVSHADEHEISLCDPNSEDDRRRRKIGSFRRKAIHALRKKRGRRRVTDFRFPAAISIEDVRDAEEERAVAAFRDRLAAHGLLPDKHDDYHMMLKFLKARKFDPEKATQMWAEMLRWRKEFGADTIVEDFEFDELDDVLRYYPQGYHGVDREGRPVYIERLGKVDPNKLMQITSVDRYIKYHVQEFEKAFREKFPACTLAAKRHIDSTTTILDVHGVGFKNFSKTARELVQRMQRIDSDYYPETLHQMYVVNAGSGFKLIWNSVKGFLDPKTSSKIHVLGSNYQSRLIELIDSSELPEFLGGSCTCSDQGGCLGSNKGPWNDPAILKLIHSMGGGGSTRETKQISDGYERSGSSLRAENLKGLLSDVSNAESESDVDDVGLSAIQNSSDHSLLTPVHEEVKGSDSSTSCSSNSKHLLDMNPGSPQGSQQLERVSIQLTSQKHFSTFGWLQNLGSISLILHTTSALRTLEDLARGLATVLVRISSLLNFFVCRQERMIGNAHSYAEAEQGNPQTVRDEDVSACLQRLEKLESLCNHMMSKPPDMPKDKELLLLQSFDRIKSLEADLERTKVALQAAMVKQMELEETLQRRSSSGVRRSFCCS

SEQ ID NO: 20093 - DNA, 1877 bp, Panicum virgatum
  misc_feature: Ceres CLONE 1810060
  misc_feature: Encodes the peptide sequence at SEQ ID NO. 20094
cagccagccagtcccctcaacctcgccgctcgccccagcctccgcttccctccccacccgaaattccgagtcctaccacccccgcgcctcccccaatggcgtcgccgggcgccgccttcgccgccgcgctcgccgccgaggacttcccgttggtggagggccaggaggggatggggatggccccggacaagtaccgcgaggtgttcgacctcgcgctgcgtggcacgcgcgccttccgggaccgccgcttcgacgaggcaatatcgttttactcaaaagctctaaatttgagaccaggagatccaattatacttagcaaccggagtttggctttctgtcggataagtcaactgttgagggagagatcatcagctgattctgaatatcagcccttaaatggccttgatcctacaacacatgcagagttagctctgaaggatgcggagaagattgtatctaacaacagtaattcccctagaccatatcttctcaaggcatatgcgctaattctgctggagcattaccatgaggcacgtgaagcccttctagctggtcttcaagttgatcccctcagccatgtcttgcaaacctgtctgagtgatctggataggaatacaaatattgcagctggggcaaggcgtgcaaggttagataggactgatgatttcgagtgcacgttatgctttaagctattgtatgaacctgtcactacaccatgtgggcattcattttgccgttcttgtctacatcagtcaatggatcatggaaataagtgtcccatgtgtcggacggtgctatttatcggtccaagaacataccctataagtgtaacattgagcaacataattcagagaaatttcccagaagaatatgctgagaggagatcagaacatgagactatgacatatgccggcgttgatttgatgcctctctttgtaatggatgttgtacttccatgccaaaagatggcactgaacatatttgaacctcgttacagactgatggtacggaggataatggaagggaaccatcgaatgggaatggtcgctattgattcggcaacgggtactgtagctgattgtggctgtgaggtggaaattttggagtgtgaaccacttccagatgggcgcttttatttagaggtggaaggctctcgtcgatttcatatcttacgatcatgggatcaagatggatatagagttgctgaagttgaatggttgcaagatatacctctgccagaaggatcacaagagagaagagaactaatcgaacttgccaatggagcttcagaactggccagggcatatattaggcgtgctagagaaaccgtacggactgcaaggcgaacaagacatttggatcttgagagcatgcctggaccacaggatcctgaaaaatttagcttctggctagtcaacttgataagtttgaggccttcggatagattagatctgttacgcctccgtgacactcgggaggtaagctctgaggaccagcttctgtttttatggcagataccatgttttaagtttgcattgctgttacctctgcagagaatttctagtagcatcaggttgctaagtgatgccgaacaaggttgccgtgtacagtaacagaactatagcacaagaattgtttccacaggccaatttattctgagaaatttgcaaaaatgggactgcaaacaagtggtcaatgtttgcggtcctaatattgcaattttttcatttattctaggggtatatactgagcagctcctatgtataccgattcagagtatagatttatcatatttgttatttaattgattctgtgcggtataattccctcatgtactaactgtcaatgaaaaaggtaatcataacttccttattctt

SEQ ID NO: 20094 - protein, 505 aa, Panicum virgatum
  misc_feature: Ceres CLONE 1810060
  misc_feature (36)..(69): Pfam Name: TPR_2 Pfam Description: Tetratricopeptide repeat
  misc_feature (193)..(230): Pfam Name: zf-C3HC4 Pfam Description: Zinc finger, C3HC4 type (RING finger)
  misc_feature (273)..(473): Pfam Name: LON Pfam Description: ATP-dependent protease La (LON) domain
MASPGAAFAAALAAEDFPLVEGQEGMGMAPDKYREVFDLALRGTRAFRDRRFDEAISFYSKALNLRPGDPIILSNRSLAFCRISQLLRERSSADSEYQPLNGLDPTTHAELALKDAEKIVSNNSNSPRPYLLKAYALILLEHYHEAREALLAGLQVDPLSHVLQTCLSDLDRNTNIAAGARRARLDRTDDFECTLCFKLLYEPVTTPCGHSFCRSCLHQSMDHGNKCPMCRTVLFIGPRTYPISVTLSNIIQRNFPEEYAERRSEHETMTYAGVDLMPLFVMDVVLPCQKMALNIFEPRYRLMVRRIMEGNHRMGMVAIDSATGTVADCGCEVEILECEPLPDGRFYLEVEGSRRFHILRSWDQDGYRVAEVEWLQDIPLPEGSQERRELIELANGASELARAYIRRARETVRTARRTRHLDLESMPGPQDPEKFSFWLVNLISLRPSDRLDLLRLRDTREVSSEDQLLFLWQIPCFKFALLLPLQRISSSIRLLSDAEQGCRVQ

SEQ ID NO: 20095 - DNA, 1766 bp, Panicum virgatum
  misc_feature: Ceres CLONE 1810064
  misc_feature: Encodes the peptide sequence at SEQ ID NO. 20096
atgccttccttgtaaccttcttgctagattggcgagtccgctgatcccatccgccccttttccgctacgcgggctgcaattcttgatttggtttctctctctctctctacgatggaggatggtgtatctacgtatactgtggacgaggcccttgtgtccatggggtttgggaaattccacgcatttgtccttgcatactccgggatggctaaaatctctgaagcaatggagatgatgcttctgtcatttgttgggcaatcggttcaagctgaatgggagctttctgcacaggcagaaagtctcataacaagtgttgtcttcgtggggatgcttgtaggagcatatgcatggggcattgtttcagataactatggaagaagggttgggttcaacttcacagccattgtaactgggggggctggtcttcttagcgcttttgctccaaattacttatctttgattgtactgaggtttatggtcggtgtcggactgggtggtggaccagttctaggttcttggttcctagagttcattcctgctcctaaccgaggaacttggatggttatgttctcagcattttggactgttggaacaataatggaagcttctcttgcttgggctgttatgccagcttttggctggaggtggctgctggcactttcatcattgccatcatttgctctactactcttctacccagtgacactggagtcaccaagatacctatgcatgaagggtagaatagccgaagcagttcatgttttggaaacaatggcgcgagtgaaccgtgttcctctcccctctggtcgacttgtctctggccatcggacagagcttcatgagattggggattcctcagaaacggcacaattggtaacaactaagaaaaataatactggtgatcttgctaccaaatctgagattggaggcctcaatgccatcttgaagcttctatctccaaacttaatcagatcaagtcttctactttggacagtttttcttggccatgcattcttgtattatggtcttgttctgctaacatcagaactgaatcatggaaataggatttgtggatcagaagagggagcagaagtgaccacagcagcccacataaatgatgaaaatctctatagaaatgtattcatcaccagctttggagaggtccctggcctcctcctatctgctgccattgtggacaagatcgggcgcaagctctcgatgtcttccatgctttacatcagttgcctgtgcatagctccacttatgttcgctaagacagaagctcttacaaccgtctttttattcggcgcgcgggtttgcatctcagcaagcttcactgttttgcacatctatgcccctgagatttaccctactgcagtcagggccactgatgtcggttttgcgagctcaattgctcgcttcggtgggatcttgtgcccccttgtggccgttggtctggtgcacgcatgccaccagacggcagccatcctgatattcatcacagtgatgctggtctccggcattgctgtctcatacttccccctggaaacaagtggccgaaagttgagcgaccacatcgccgcatagagctgaatagttttgtgactcggtgggaacacacacacagaatcaaggcccagagccagaggccattttgttgtctgttctttgatagaggatgcaaatggaaaggaagagtaaaggaggcatgagattattaactgattacattgctttcaatagagatgtacactgatttttgagac

SEQ ID NO: 20096 - protein, 491 aa, Panicum virgatum
  misc_feature: Ceres CLONE 1810064
  misc_feature (29)..(443): Pfam Name: MFS_1 Pfam Description: Major Facilitator Superfamily
MEDGVSTYTVDEALVSMGFGKFHAFVLAYSGMAKISEAMEMMLLSFVGQSVQAEWELSAQAESLITSVVFVGMLVGAYAWGIVSDNYGRRVGFNFTAIVTGGAGLLSAFAPNYLSLIVLRFMVGVGLGGGPVLGSWFLEFIPAPNRGTWMVMFSAFWTVGTIMEASLAWAVMPAFGWRWLLALSSLPSFALLLFYPVTLESPRYLCMKGRIAEAVHVLETMARVNRVPLPSGRLVSGHRTELHEIGDSSETAQLVTTKKNNTGDLATKSEIGGLNAILKLLSPNLIRSSLLLWTVFLGHAFLYYGLVLLTSELNHGNRICGSEEGAEVTTAAHINDENLYRNVFITSFGEVPGLLLSAAIVDKIGRKLSMSSMLYISCLCIAPLMFAKTEALTTVFLFGARVCISASFTVLHIYAPEIYPTAVRATDVGFASSIARFGGILCPLVAVGLVHACHQTAAILIFITVMLVSGIAVSYFPLETSGRKLSDHIAA

SEQ ID NO: 20097 - DNA, 2013 bp, Panicum virgatum
  misc_feature: Ceres CLONE 1810072
  misc_feature: Encodes the peptide sequence at SEQ ID NO. 20098
acacttggctccgcgcaatcctggccgtccgcaacgctggccaggagacgctttcacacttccaccccccaaaacaacacgcacatccgcatcagcttctctctctccctcggcggctgcccgtctcctcgtcgtccggccatgggggtgctcacggcggcggagctcaacttcctcgtcttccgctacctccaggagtccggtttcattcatgcagcattcactctagggtatgaagcagggatccataagggtggcattgatggaaatgcagtcccacctggtgctctcattactattgtgcagaaaggcctccagtacatagaactggaagcaaataccgaagagaatgatgaagaaattgagaaggattttgcccttctggaaccaattgaaatcatcacaaaggatgttgaagagttgcaacagcttgtaaagaagagaaaaagggagagatctcaaactgaccgcgagaaggataggggaaaagagaaagaacgtaatgaggagcatgaatggcgtcctggaggcgaacgtgagagggatcgccatgacaaagaaaaagaacaggtgagggagaaggataaatctgaaaaagacagggagcatgagaaagaaaaggagaaagaaaagcagcatacagagcgcatcgataagattaagcacgatgaagattctcttgctggcggaggtcccactcctatggatgtaagtgtaactgctcaggagatttctagtaccgatgtgactgtattggaagggcacagttctgaggtttttgcttgtgcatggagtccaactggttctcttctagcttcagggtcaggagactcaacggctagaatctggacaattccagatggtccatgtggttccaacatgcaatcatctcctctgggtgttcatgttttgaaacattttaaaggtcggaccaatgagaagagcaaggatgtcaccacccttgactggaatggtgaaggtacactactggctacaggctcctatgatgggcaggcaagaatatggagtagagatggagagctgaagcagacacttttcaaacacaagggtcccatattttcgttgaaatggaataagaaaggagattatctcctaagtggaagtgttgataaaactgctattgtttgggatacaaagacatgggagtgcaagcagcagtttgaatttcattcggctccaacactagatgttgattggagaaataataactcttttgcaacatgctcaaccgacagcatgatctatgtttgcaagattggggaacagcgtccagttaaatcatttattggtcatcagagtgaagttaatgctatcaagtgggatccaactggttctcttttggcttcatgttctgatgatgggacagctaagatatggagtatgaagcaagataaatgtgtatttgattttaaggagcataccaaggaaatatacaccattcggtggagcccaacaggcccaggaacaaacaatcctaatcagcagttgcttttggctagcgcatcttttgattctactatcaagctttgggaagttgagcaaggacgccttctgtacagcttggctggccataggcaaccagtgtattctgttgcatttagccctgatggtgaatacttagctagtgggtccctggatcagtgcctacacatctggtctgtgaaagaaggcaggatcctcaagacctacagagggactggtggcatcttcgaagtttgctggaataaggaaggcagcaagattgcagcctgtttctcgaacaacacagtctgcgtgatggatttcaggatgtagtccaaccagtatggtagtgcataacaggcctaaaaacagggctatatgggagtggcattgttagcttaatgttcatcttaggtggctttaatttctccatccatgtacaggtttcttctcggttatattgaccatagagtagctatgttgtaatgcaggtcttaaaaaggtttagtcttatggaaatgttttggtggc

SEQ ID NO: 20098 - protein, 557 aa, Panicum virgatum
  misc_feature: Ceres CLONE 1810072
  misc_feature (382)..(420): Pfam Name: WD40 Pfam Description: WD domain, G-beta repeat
  misc_feature (475)..(513): Pfam Name: WD40 Pfam Description: WD domain, G-beta repeat
  misc_feature (199)..(237): Pfam Name: WD40 Pfam Description: WD domain, G-beta repeat
  misc_feature (424)..(471): Pfam Name: WD40 Pfam Description: WD domain, G-beta repeat
  misc_feature (299)..(337): Pfam Name: WD40 Pfam Description: WD domain, G-beta repeat
  misc_feature (258)..(296): Pfam Name: WD40 Pfam Description: WD domain, G-beta repeat
  misc_feature (7)..(33): Pfam Name: LisH Pfam Description: LisH
  misc_feature: SWISSPROT Homolog: EC 2.7.11.7 [Myosin heavy-chain] kinase
MGVLTAAELNFLVFRYLQESGFIHAAFTLGYEAGIHKGGIDGNAVPPGALITIVQKGLQYIELEANTEENDEEIEKDFALLEPIEIITKDVEELQQLVKKRKRERSQTDREKDRGKEKERNEEHEWRPGGERERDRHDKEKEQVREKDKSEKDREHEKEKEKEKQHTERIDKIKHDEDSLAGGGPTPMDVSVTAQEISSTDVTVLEGHSSEVFACAWSPTGSLLASGSGDSTARIWTIPDGPCGSNMQSSPLGVHVLKHFKGRTNEKSKDVTTLDWNGEGTLLATGSYDGQARIWSRDGELKQTLFKHKGPIFSLKWNKKGDYLLSGSVDKTAIVWDTKTWECKQQFEFHSAPTLDVDWRNNNSFATCSTDSMIYVCKIGEQRPVKSFIGHQSEVNAIKWDPTGSLLASCSDDGTAKIWSMKQDKCVFDFKEHTKEIYTIRWSPTGPGTNNPNQQLLLASASFDSTIKLWEVEQGRLLYSLAGHRQPVYSVAFSPDGEYLASGSLDQCLHIWSVKEGRILKTYRGTGGIFEVCWNKEGSKIAACFSNNTVCVMDFRM

SEQ ID NO: 20099 - DNA, 3014 bp, Panicum virgatum
  misc_feature: Ceres CLONE 1810092
  misc_feature: Encodes the peptide sequence at SEQ ID NO. 20100
aaaaacatgctggtggagaggagcagcatatgctccacagaacagaaaagaagcacaagtaaccagccggccttgattacgcgcagttactgcggccacctgcttcacaacccccacctacatcaatgccgtgaccagcgccctcgtgcctcgccaccaccaccccaaccgtgaattgattcgaaacgaacacccagcaagcagctcgagctgcgtcgccattgcaggctttcagctgagccgagcacttctctctctctctctctctctctctctctctcagacacagggaaaacaggagaggaaaacggcaggtgcgtgaaacccaatccggcgcatccccgcctccattaataggggggatgcgtgtcgcgggctcgcggctacctcagcgacgcgagctgcctaggtgcctcgctcctcctcctccttctcctgcgccagctagctgcgctggccactcagtggagactggagagaggagccgccagcagctagtaggagacaggaagagacagagaggggagtgggcggagcagctagagatagcgtcgtcgtggagatggacggcggcggcggggaggcgtggcgcggggcggtgtcgccggcggcgcgctacgcggagtccggcggcgccagcctgacgtgggagaacctcacggcggtgctgccgggcggcggtggccgagccaccaagaagctggtgcaggggctgtacggctacgccgtgcccggccgcgtcgtcgccatcatggggccgtccggctccggcaagtccacgctcctcgactcgctctccgggaggctggccaggaacgtggtcctcaccgggaaggtgctgctcaacggcaagaagaggcggctcgactatggcgtcgtggcgtatgtgacccaagagaacatactgttgggcacgctgacagtccgggagacggtgacctactcggccctgctgcggctgccgtcgagcatgcgcaagtcggaggtgcgccgcatcgtggacgacacgctggacgagatggggctccgggagtgcgccgaccgccacatcgggacctggcacctccgcggcatcagcggcggcgagaagaagcgcctgagcatcgcgctggaaatcctcacccgcccgcgcctcctcttcctggacgagcccaccacggggctcgacagcgccgccgccttctccgtcgtgcagacgctgcgccagctcgccgtcgacggcggccgcaccatcgtgtcctccgtgcaccagcccagcagcgaggtcttcgcgctctttgacgacctctgcctcctctccggcggcgagtgcgtctacttcggtgatgcgaagctggcaacgcagttctttgcggaaacaggcttcccctgccccagccggagaaatccatccgaccatttcctccggtgtgtcaactctgacttcgatgatgtccctgccaccatgaaaggatccatgaagctgcgagcagaggcagagcttgatcccctgctgaattactccacgtcagagatcagagaacggctagtggagaagtacaggatctccgattatgccatgatggtcaggaacacaatacaggagatagccaagattgagggtgtggtggaggaggtgatccgtggcagcgaggcgagctggttcaagcagctgcgcacgctgacgagccggtccttcaccaacatgtcccgggacctcaactactactggctgcgcatcatcatctacatcgtcatggccatctgcctgggcaccatctactacgacgtgggcaccagctacacggccatccaggcgcgcgcctcctgcggcggcttcgtgtccggcttcatgaccttcatgtccatcggcggcttcccgtccttcatcgaggagatgaaggttttcaccctggagcgccagaatggctactacggcgtcgccgtctacatcatctccaacttcctgtcctccatgccgttcctgctcaccgtgtcttgggccagcgcctccatcacctactggatggtcaagttccggcccgggttcagctacttcgccttcttcgccctcaacctctacggcggcgtctccgtcatcgagagcctcatgatgatcatctctgccctcgtgccaaacttcctcatgggcctcatccttggtgccggcgtcattgggatcatgatgctgacatcaggattcttccggctgcttccagaacttcccaagatcttctggcgctacccggtgtcctacgttgtgtatggctcatggggattgaagggagggtacaagaacgacctgatcggcctggagttcgagcccatgatgccggggcagccgaagctcaagggcgagtacatcatcaccgagatgatggggctgagcctggaccactccaagtggctggacctcgccatgatcttcgtcctcctcttcgcctaccgcctcaccttcttcatcgtgctcaaggtcaaggaggccgccgcgccgtacatccgcgtcgcctacacgcgcttcaccgtcaagcgcctggagcggcgcgcgtcgttcaggaagacgctggccatgacctcgctgtccaagcggcacaaccagccgcaccccatggccatccaggaggggctcaactcgcccatgccgtactgagctagctgaggaacacgaagagccgctgggagctaatggtagcatcaccggttacttgtggatgtgcttacagatattatatgtttgttccattgtttaggatttggagcgttcacaaagatgatacccacgatatagtcttcaaagcattcgtttcactgtaataactctctctgaacacgatacacatacaagatagtgatgtgcctacttgtttttttgttttaccttctgttttgtaaacatttaattcgtgcaatggtcttgggggggaatcatgcagggaaaaatactgtaggattttttagttttttttttgtaatgtatgggtatgtgaataatgttttgtgcactgtttggagaataaactttctggccgaatctc

SEQ ID NO: 20100 - protein, 688 aa, Panicum virgatum
  misc_feature: Ceres CLONE 1810092
  misc_feature (58)..(248): Pfam Name: ABC_tran Pfam Description: ABC transporter
  misc_feature (362)..(574): Pfam Name: ABC2_membrane Pfam Description: ABC-2 type transporter
  misc_feature: SWISSPROT Homolog: EC 3.6.3.28 Phosphonate-transporting ATPase
MDGGGGEAWRGAVSPAARYAESGGASLTWENLTAVLPGGGGRATKKLVQGLYGYAVPGRVVAIMGPSGSGKSTLLDSLSGRLARNVVLTGKVLLNGKKRRLDYGVVAYVTQENILLGTLTVRETVTYSALLRLPSSMRKSEVRRIVDDTLDEMGLRECADRHIGTWHLRGISGGEKKRLSIALEILTRPRLLFLDEPTTGLDSAAAFSVVQTLRQLAVDGGRTIVSSVHQPSSEVFALFDDLCLLSGGECVYFGDAKLATQFFAETGFPCPSRRNPSDHFLRCVNSDFDDVPATMKGSMKLRAEAELDPLLNYSTSEIRERLVEKYRISDYAMMVRNTIQEIAKIEGVVEEVIRGSEASWFKQLRTLTSRSFTNMSRDLNYYWLRIIIYIVMAICLGTIYYDVGTSYTAIQARASCGGFVSGFMTFMSIGGFPSFIEEMKVFTLERQNGYYGVAVYIISNFLSSMPFLLTVSWASASITYWMVKFRPGFSYFAFFALNLYGGVSVIESLMMIISALVPNFLMGLILGAGVIGIMMLTSGFFRLLPELPKIFWRYPVSYVVYGSWGLKGGYKNDLIGLEFEPMMPGQPKLKGEYIITEMMGLSLDHSKWLDLAMIFVLLFAYRLTFFIVLKVKEAAAPYIRVAYTRFTVKRLERRASFRKTLAMTSLSKRHNQPHPMAIQEGLNSPMPY

SEQ ID NO: 20101 - DNA, 1750 bp, Panicum virgatum
  misc_feature: Ceres CLONE 1810093
  misc_feature: Encodes the peptide sequence at SEQ ID NO. 20102
ctcccctccgcctcctctactccaggagccgccgcctcctagagggagagggagagagagagagagagggaagggaggacgccgcagccgcagccgccaccccccgccgcccgcctacccctgatcgagccgggctagggttcccgcacaccaggccggcgccatggcgggctgctccaggggctccctccccacctggatgaccgccgccgcctcgcgggtcgacctcaccggcggcgccgtctcgccgtcgcatcagggttccccctccccgtccccctcgggccccgcgccggccgcgggggcggaccaggagctcgggatgttcgagcgcgcgctctccgccgccggcgccgccttcgtctccgccatcatcgtcaaccccctcgacgtcgccaagacgaggttgcaggcgcaggcggcgggggtgctgtaccattaccctccccaggtggcggcgctcggcccggatgcgatcctttctgaattcagatgttctccgtcatgcactcgtggtctcatattcggaagcgagcctgtttgccctcctgaatgcttccagtacaagggaacacttgatgtattcttgaaagtagttagacaggagggattcggtagattgtggagaggaacaaatgcaggcttggcattagctgtaccaactgttggaatatacttgccttgctatgatatattccgcaactggattgaggatttcacaagaagtaatgctccaggattgacaccatatgccccgctagtagcaggatcagttgcacgttcattagcatgtattgcttgttccccaattgagctagcaaggacacgtatgcaggcctataaagaatttcgccctggcgtaaagcctcctggaatgtggaaaaccttggttggtgttctctcgccacttgcaagttcgagtcagagtgtacaaaactaccgtgttctgtggactggggtgggcgcacaacttgctcgggatgttcctttctctggtatatgctggtcaactcttgagcctattcgaagaaaactgcttggtcttgttggagaagaaggcaatgcagctagtgtattgggagcaaattttgctgctggctttgtagcaggtagtcttgctgctggtgctacatgccctctggatgttgcaaaaacaaggagacagatagagaaggatactgagaaggcaatgagaatgactacacggcaaacattgactgagatatggaggtctgcaggtgtgaaaggtttgttcactggggttggcccacgcgtggctcgtgctggtccatcagttggcattgtggtttccttttacgaggttgtcaagtatgctctccatcaaaggaacgcctcatgatccatatttgtcgagaagactgaactctcttgactctgtaaaaacaagacatacctctccctagaaagtacctctggttactccagggctccaagcatcggacggcagggctaggtgtcacttggaaagatcagagtactcagcatcgcacactcaacaaaggctttttcatggacgcagtccatttcagcctgataccatctcagttttgatttggtggagccggctctagttttgtctcgcaggggttttggaccatcgtcgaagcttatgttatgttctggacggagctggagctgctttgattaacttaggtagaccctgtaattggaggtgtagtcaggttgatgctgatcaataataccaccaaaactacagaagaaattttgc

SEQ ID NO: 20102 - protein, 398 aa, Panicum virgatum
  misc_feature: Ceres CLONE 1810093
  misc_feature (53)..(186): Pfam Name: Mito_carr Pfam Description: Mitochondrial carrier protein
  misc_feature (304)..(396): Pfam Name: Mito_carr Pfam Description: Mitochondrial carrier protein
  misc_feature (194)..(295): Pfam Name: Mito_carr Pfam Description: Mitochondrial carrier protein
MAGCSRGSLPTWMTAAASRVDLTGGAVSPSHQGSPSPSPSGPAPAAGADQELGMFERALSAAGAAFVSAIIVNPLDVAKTRLQAQAAGVLYHYPPQVAALGPDAILSEFRCSPSCTRGLIFGSEPVCPPECFQYKGTLDVFLKVVRQEGFGRLWRGTNAGLALAVPTVGIYLPCYDIFRNWIEDFTRSNAPGLTPYAPLVAGSVARSLACIACSPIELARTRMQAYKEFRPGVKPPGMWKTLVGVLSPLASSSQSVQNYRVLWTGVGAQLARDVPFSGICWSTLEPIRRKLLGLVGEEGNAASVLGANFAAGFVAGSLAAGATCPLDVAKTRRQIEKDTEKAMRMTTRQTLTEIWRSAGVKGLFTGVGPRVARAGPSVGIVVSFYEVVKYALHQRNAS

SEQ ID NO: 20103 - DNA, 611 bp, Panicum virgatum
  misc_feature: Ceres CLONE 1810095-R
  misc_feature: Encodes the peptide sequence at SEQ ID NO. 20104
actatatccatggtcagtgtgccatcatcatgtttgatgtcacttcaagactgacatacaagaatgtaccaacatggcacagggacttgtgcagggtttgtgagaacattcccatcgtcctctgtggtaacaaggttgatgtgaagaacaggcaggtcaaagccaagcaagttacattccacaggaagaagaacctgcagtactatgaaatttctgcaaagagcaattacaatttcgagaagcccttcctttaccttgcaaggaagctggcaggggaccagaaccttcactttgtcgaggctgttgctctgaaaccaccggaagtgcagcttgatatggccatgcagcaacagcatgaagctgagcttgcggctgctgcggcacaacccctgcctgacgacgatgatgacttgatcgagtaatcatggcccttgttgatgcgagaggaaggacttcactataaaaggccgtagtggctcatccttaggaacctggatgttttcttgttatgtgtctgatgagttgagaacgagttatgacatttctggatttgttttttttaaaaaacgatttctggatttgttggtgactgaacccagctcctttcgagc

SEQ ID NO: 20104 - protein, 139 aa, Panicum virgatum
  misc_feature: Ceres CLONE 1810095-R
  misc_feature (1)..(91): Pfam Name: Ras Pfam Description: Ras family
YIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQLDMAMQQQHEAELAAAAAQPLPDDDDDLIE

SEQ ID NO: 20105 - DNA, 1168 bp, Panicum virgatum
  misc_feature: Ceres CLONE 1810095
aggtgcaaccgtgcaagacgctcccggctccccaccacgacttctccacaagtccatcccgaactctctaggccctccttctcggtcccccctcgcgagccgcggaaatggtgagcacgcccgaccaccattcgaagaatacatctagggtttccgatcggtgtttccgacggcgacggagatcctgaggcaggagtcaagccgcctcatcgatccgtgtatgcttctgattcgttggttttcccccctcccctctcgcaggcgttgccgaatcagcaggtcgtggattacccaagcttcaagctcgtcatcgtcggcgacggtggaactggtgaatttctccgtccttttttcttcgccttccatgagtttttttattgctcgacccgggatattgggagatgtggcctctgatgcgcgcgcctggtctcggcgagatctgatgggccgggtgacggttcgttggtggcaagcggtagggacctgtagggatttattttgttctgctggagacgtatgcgaatgggtcgtagggtgatttggggttcaagcgtatttaggttttagatggggaatcgttagattgcaggacctgtggagatttgttttgtccctgttactgtgaggcattgatgctatgaatttctcccatggcaattatttccctagtacttagctaaggtattgcccatgccacatattgtttatgttaataaacaaggctcggtggatctgtttgcctccttaaagctgtcaattagttttggagtattttgtgtgacaaggcatgatgcaagtaaggtgtttattttctgatcctgaaaagatggcgagccaagtttttgtggtgagatgccatcttgctgtatgtgttaggcctatggtgcagtctacagtgatcaggtgctgttgggacctggcacagtgctgggcgtttttcgtcctagtattggatggccctcgtttcaatggttacaatttataaatgttgcctacattccttgttttgttgcattccactgctgtatttatatgtaatgctgcaaacatgtatatatgttttaggttatttaaatgctctttagcgattgttgtcgataactcaacatctgattgccttatattttctgcaagtaaaaccacatttgtcaaaaggcatcttactggc

SEQ ID NO: 20106 - DNA, 1417 bp, Panicum virgatum
  misc_feature: Ceres CLONE 1810100
  misc_feature: Encodes the peptide sequence at SEQ ID NO. 20107
atcccgcactcgctcgctcctttgatcctttcctccagcaggcagcagctccccttctctcaagaaataatggccgcggcggcggacccagcgtcctcggcagccgctgagcggctgctggaggtgtcggaggaggaggtggtgatagacttcaagcccgacgccaagtgccgcgccgacctccgcctccgctccctgcacccgtccctccccgtcgccttcaaggtccagacctcctccccgctcaagttcctcgtcagcccgccgcgcggcgccgtgcagccgctctcctcggcgtccctccgcgtcgtgctccgcccgcaggcgcacccgccgccgtcgttcccgcgctcccgcgccgaccgcttcctcgtcctctcctcgctctccgccgcgcgcctcgacgccgccaccgacgacaccggcggctgcggcggcggcggcgtcagcaccgtccgcctacgcgtgttcttcggcgggccgtacctgctccgcctcgccgcggacgccggcgacgccgcggccgtgcggctcatcctccgccggcagccgcaccttctgccgttcctcgagccccagcccgcggcgcccgacgccgccgagcagtgggcgccgctgcacgcggcggccgcgaggggggactgcggggaggtgaggcggctggggcccgaggcgctggccgcgcgcgaccgcgaggggaggacggtcctgcacgccgcggccgcggccggcgaggcggaggcggtggccgtgctggtggacatgggcgccgacacatcggcggccgacgcgcgcgggaggacgcccatggacgtggcgcgcgagaagggataccaagaggtggtggacgtgctggagcggtgggagctggtcatgacggcggcgaggcgcggcgacctccagagcctcgagtccctgctgggcaagcgcgcgggggtccgcggccgcgaccagtacggcctgacggcgctccacctggcggcgatcaagggccacagcgacgcggtcgccttgctggctgggtcggggtgcatggacatcgagtgcgaggacgtggaagggcacaggccgctgcacctcgccgtcgagggcggccacgccgaggccgtggagctgctgctggacatgggcgccgacgtcaatgccaggaccaggcgcggcgccacgccgctccagatggcggaggccatggggcacgaggccatcgcccagctcctgtgcggcaggggggcggaggtgcccgctgcgccggcgctgtgcgtcgcgtcgtcatcttcgtcgtccatctcgtgcgcctgacctcgctgggttcagttcgcaaatgttccgaggacacgatacggcactgtattagtccacagatgcgtttgttcggttttattggagagtatatcatgcagtgttaccatgcaattgc

SEQ ID NO: 20107 - protein, 409 aa, Panicum virgatum
  misc_feature: Ceres CLONE 1810100
  misc_feature (330)..(362): Pfam Name: Ank Pfam Description: Ankyrin repeat
  misc_feature (209)..(241): Pfam Name: Ank Pfam Description: Ankyrin repeat
  misc_feature (16)..(121): Pfam Name: Motile_Sperm Pfam Description: MSP (Major sperm protein) domain
  misc_feature: SWISSPROT Homolog: EC 2.7.11.1 Non-specific serine/threonine protein kinase
MAAAADPASSAAAERLLEVSEEEVVIDFKPDAKCRADLRLRSLHPSLPVAFKVQTSSPLKFLVSPPRGAVQPLSSASLRVVLRPQAHPPPSFPRSRADRFLVLSSLSAARLDAATDDTGGCGGGGVSTVRLRVFFGGPYLLRLAADAGDAAAVRLILRRQPHLLPFLEPQPAAPDAAEQWAPLHAAAARGDCGEVRRLGPEALAARDREGRTVLHAAAAAGEAEAVAVLVDMGADTSAADARGRTPMDVAREKGYQEVVDVLERWELVMTAARRGDLQSLESLLGKRAGVRGRDQYGLTALHLAAIKGHSDAVALLAGSGCMDIECEDVEGHRPLHLAVEGGHAEAVELLLDMGADVNARTRRGATPLQMAEAMGHEAIAQLLCGRGAEVPAAPALCVASSSSSSISCA

SEQ ID NO: 20108 - DNA, 622 bp, Panicum virgatum
  misc_feature: Ceres CLONE 1810101-R
  misc_feature: Encodes the peptide sequence at SEQ ID NO. 20109
attgctagcggcagattggatcacgacgaggacagtgaaatcaaggagagaccactggttcttcgtaataagccacctaggtggcatgaacagctgcagtgctggtgtctcaacttccgtggccgtgtgacaatcgcctctgtgaagaacttccagctgattgccgcaacaactccacccgcaggtgctccaactccctcgcagcctgctccatcagatcctgacaaagtgattctacagtttggaaaagtggcaagggatatgttcacgatggactatcgctacccgctctcggctttccaggcatttgctatctgtctgagcagctttgatacaaaattggcctgtgaataaatggagaacaaaggtagaaggagaacgcagatgccctggcaataggccctcggtatctctttgctttttccagtcgtgttatcttgcttgtaattgttcttgcgtgcttgctgtagccatgaagtggacatatgtgggatgcatgtattgttggccccctctccccaattgattacaagttccattaggaccacatgttacccgatctgtaatatacttccagtggcattgccacatgataagaaagttcccactggtggttgtaccg

SEQ ID NO: 20109 - protein, 117 aa, Panicum virgatum
  misc_feature: Ceres CLONE 1810101-R
  misc_feature (1)..(111): Pfam Name: Tub Pfam Description: Tub family
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
  misc_feature: The sequence is a functional homolog of SEQ ID NO 462 in the 10/666,642 US patent application
IASGRLDHDEDSEIKERPLVLRNKPPRWHEQLQCWCLNFRGRVTIASVKNFQLIAATTPPAGAPTPSQPAPSDPDKVILQFGKVARDMFTMDYRYPLSAFQAFAICLSSFDTKLACE

SEQ ID NO: 20110 - DNA, 1381 bp, Panicum virgatum
  misc_feature: Ceres CLONE 1810101
gtcctcttcattcggttcctcttcctcctccctcccctgcccctcctcctcgtctcaccttccccgcctggtcttcgcgtgcgccgcggcggccgtggcccgtggaggacggacagcccgggggacgctcggggctcgtcccgggcgcactgatctgcggcctgcgtgtccccggtggcggggcgggccggcatcggcttcgaggaatattgtagcatctgtttcttctgcatatgcactttgtattgttgatatcatttcaaaggaggccatagtctcctggattttgtatgccttgttatctggaattggttaccgtagatgtcatttcgtagcatcgtccgtgatgttagggatggcttcggtagcttgtccagacgcagctttgacgtgaccctcgcaagcatttatggccttaccgggcatcacaaaaggaggacccagagctcatcgcatgaactcgatgactcgccttccataatccgagaaagccgctgggcaagcctacctcctgaactcatccgtgatataatacggagactcgaggctgatgagagtacctggccagcacggaagcattttgtttgctttgcagctgtttgtaggacatggagggaaatgtgtaaagagattgtgttgagcccagagttttgtgggaagctcactttccctgtctctctaaaacagcctggtcctcgagaaggaaatacaatgattcaatgttttataaagaggaataagtcaaaatccacctaccatctctacctgtgccttagcaatgttgttacttcagaaagtggaaaattcctcttatcggctagaagacaccgcaaagccacatgcacagagtacactatatcaatggattctggcagcacctcaagatcaagcagaacctacattggaaaaataaggtcgaacttccttggcacaaaatttttaatttatgatacacaacccccctataatggggctgtagttcctcctgttggaaggaccagcaggaggttcaactccacaaaagtctctccgaagttgccttctgttagttacaacatcgctcaggtgtcatatgagctaaacgtccttggaacgagaggtccaaggcggatgcgttgcatcatgcactccatacccgcctcatcagtggagccaggtggcatagtaccaggacagccagagcagattgtacctcgcgctttggaggactcattccgcagcacagcttccttttcgcagtcattccgtagcaccacctcactgtccaagtccatcatggactcatccatggatttcaatagcgctcgcttctcagacattgctggcagcagtgctcgattctctggcattggcagcagtgctcgtatctcgggcattgcta

SEQ ID NO: 20111 - DNA, 1619 bp, Panicum virgatum
  misc_feature: Ceres CLONE 1810106
  misc_feature: Encodes the peptide sequence at SEQ ID NO. 20112
aaatttactcatgttacactcagcatggcgaccttagtttaactagtttttgctgtgtgagcgagccgtttgtgtgtatggttgcaaccatcatggagacaatattcaaagagaaatcaagagggaaagtttccctgatccatttcctagtccgatgttttgccgtggcagctaccattttgctcctgacggataggatccacgctcatgttgatggtgtagagattctcggcaacgacgtcgatgcgccgccgtcgtctgtccaaggaatagaagtaataaacagcgaggcgatccgcgacgaccagtggcagacggtcaagaccaggggcagccagttcgtcgtcggtgaccggccgttctacgtgaacggctttaacgcgtactggctgatgatcctcgccgccgacccgtcgaccaggggcaaggtcaccgaggtcttccagcaggcggcggcggtcggcctcacggtgtgccgcacctggggcttcaacgacggtggctggagggcgcttcagaagtcacctgctgtctatgacgaggatgtcttcaaggcgttggatttcgtagtgagtgaggcaaggaactacaggatcaggctaatactgtcgctgatcaacaactgggacggctacggcggcaaggcgcagtacgtgaaatgggccagggacgccggcctcaacatcacctccgacgatgacttcttctccgaccaaaccgtaaagggctacttcaagaaccacgtcaagaacatgctgacgagggtgaacacgtacacgaacgtgacgtacaaggatgacccaaccatcttcgcctgggagctcatgaatgaactgcgctgcacgtcggagccaaccgggaacaagctgcaggcgtggatccaagagatggctttccatgtgaagtccatcgacccggatcacctgctggaggtcggggccgagggcttctacggcccctcgtcgccggcgcggcttcaggccaacccgaacacctacgccggccaggtcggcaccgacttcatccgcaaccaccgagtcctgggcgtcgacttcgcctccgttcacatctacccggacacctggatgccgggcgcgagtgtggatgcacagctcaagtttgcgcagtcgtggatgcaggcgcacatcgccgacgccgagggcacgctcggcatgccggtggtgttcacggagttcggggtgtccaccaaggctcggagcgccttcaacgcgacgtcgagggaccggttcatccaggcggtgtacgggttgctcctggactcgacgcgtcgcggcggcgccggagcgggggccctgctctggcaggtgttcccggagggggcggaatacatggacgacggctacggcgttgtgctgcccaaagcgaaggccaccgccgggatcatgtcggtgcactccaggcggctggtggtcttcaactccaggtgcgcgtggagctgccgctgggggtgcaggaaggaggaggagcagtcggaggatgttgatgatgagatgatgctgttccacgatgaactgtggacttaggatgttacaatgtttagctagttgaatactacgcccataacttcatcatcaacttattaataagcttcattctcc

SEQ ID NO: 20112 - protein, 483 aa, Panicum virgatum
  misc_feature: Ceres CLONE 1810106
  misc_feature (81)..(420): Pfam Name: Cellulase Pfam Description: Cellulase (glycosyl hydrolase family 5)
  misc_feature: SWISSPROT Homolog: EC 3.2.1.78 Mannan endo-1,4-beta-mannosidase
  misc_feature: The sequence is a functional homolog of SEQ ID NO 2 in US patent 7148399
METIFKEKSRGKVSLIHFLVRCFAVAATILLLTDRIHAHVDGVEILGNDVDAPPSSVQGIEVINSEAIRDDQWQTVKTRGSQFVVGDRPFYVNGFNAYWLMILAADPSTRGKVTEVFQQAAAVGLTVCRTWGFNDGGWRALQKSPAVYDEDVFKALDFVVSEARNYRIRLILSLINNWDGYGGKAQYVKWARDAGLNITSDDDFFSDQTVKGYFKNHVKNMLTRVNTYTNVTYKDDPTIFAWELMNELRCTSEPTGNKLQAWIQEMAFHVKSIDPDHLLEVGAEGFYGPSSPARLQANPNTYAGQVGTDFIRNHRVLGVDFASVHIYPDTWMPGASVDAQLKFAQSWMQAHIADAEGTLGMPVVFTEFGVSTKARSAFNATSRDRFIQAVYGLLLDSTRRGGAGAGALLWQVFPEGAEYMDDGYGVVLPKAKATAGIMSVHSRRLVVFNSRCAWSCRWGCRKEEEQSEDVDDEMMLFHDELWT

SEQ ID NO: 20113 - DNA, 2237 bp, Panicum virgatum
  misc_feature: Ceres CLONE 1810107
  misc_feature: Encodes the peptide sequence at SEQ ID NO. 20114
gttaattcgaaaattttcgaaccaaaccacctctctctctctctctctctctcgtcttcctcctcctgcgcctgcctcccttccccaccccaccgcacagcgcccggcccggccccaaccagacagctccgtttcccctccccgtcctccctctccctccacctcgaccgcgcaccaaacccaaaagcgcacccacattccctccaccccccgctctcgcgcccctcccctccgcgtcacccggagcgccggctacggccgtggtggcggcgccctccccaccccccgggcagtggcggcggcggcggcggaagggtctgtccctggaacagggagagctctggcgggagtgtgtacggccgcttcgtgctaggggcaggcgctgcgcgagatccgggccggaaggcgcggggggtctcggggtggcgccgtgccgtcggcgtgatctgaaatgagattgggcccggcggcgcggtattcgcagcggaggtgccggccatgaccaccaacaccaagcgcgcctacaagctccaggagtttgtggcgcactcgtccaatgttaactgcctcaagattgggaggaagacctcacgggttcttctcacaggaggagaggatcataaggtcaatctttgggctattgggaagcccaattcaatattgagtttatctgggcatacaagtgctgtggagtcagttggttttgattccacagaagtttttgtggctgcaggagcagctagtggaacaataaaattatgggatttgcaggaggcaaagattgtccgcactcttaccggacataggtcaaactgtatgtcagttgatttccatccctttggggaattctttgcctctgggtcattggacactaatctgaagatatgggatataagaaggaagaattgcatccatacttacaaaggtcacacacgagaggtgaatgctattagattcacacctgatggccggtgggttgtatctggtggtgaagataatacagtgaagctctgggatctgacagctggaaagttattacatgaattcaagtgccatgagggtcagattcagtgcatagatttccatccccatgagttccttctggcaacaggttcagctgataaaactgtcaagttctgggatttggagacctttgagttgattggatctactggacctgagacaacaggtgttcgatccatgacattcaatcctgacggaagatctctgttatgtgggttgcacgaaagcttaaaggttttctcttgggagccaataagatgccatgatactgtggatgtgggatggtctagacttgccgatttgaatgttcatgagggaaaacttcttggttgttctttcaatcaaagttgtgttggaatatgggttgttgatctgacgcgtcttgagccatatgcaactggtacatcaacaaaagtaaatgggcattctgaattgaagactgtgttaagcggcactatgcctctacaaaatgacagtggttcgagggctaacattgggcgatcatctgttttgcaaaattcagagaataacttaaaagcttcttcaggaagactgtcggtttctcagaacacagattctgcactgaaagagactaaatcaacagcctcaagcggattggtcccaagcacaccacaaagggctggagttggctccaataatagatcttttggaaattcagcttttgcatctggtggtaccaccttgaagagaagttcattgaggagtcacaatgcctctagtgttagcaatttcagtaaagctgatatagtgcctgtgattgttccaagaactagctcaggaggcgagctgaccactgattctagaagtgatgctgctgatgtggcacctgttctttctaaggcaaccagaagggctgatcctgctactgagtctagaaaagaaagtactgatgtggaacctattattcctagagcaagcccaagaatggaaatatcctctgattcagcacctgttattatttccaagtcaggcagaaggctggagtctggcgctgattcaaaaaaggaaagccccgatgcagcacctgttgttcctaggtcaaatacaaaaatggaaatggcctttgagtctgcacctattctttcaaaggcaaacagaaaagtagattccggtaccgattcaaagaaagaaagtgctgatgcgacacctgtcatcggccccagaacaggttcaagaacagaaatgtcctctga

SEQ ID NO: 20114 - protein, 579 aa, Panicum virgatum
  misc_feature: Ceres CLONE 1810107
  misc_feature (135)..(173): Pfam Name: WD40 Pfam Description: WD domain, G-beta repeat
  misc_feature (177)..(215): Pfam Name: WD40 Pfam Description: WD domain, G-beta repeat
  misc_feature (93)..(131): Pfam Name: WD40 Pfam Description: WD domain, G-beta repeat
  misc_feature (51)..(89): Pfam Name: WD40 Pfam Description: WD domain, G-beta repeat
  misc_feature (8)..(47): Pfam Name: WD40 Pfam Description: WD domain, G-beta repeat
  misc_feature (33)..(296): SWISSPROT Homolog: EC 2.7.11.7 [Myosin heavy-chain] kinase
  misc_feature (307)..(579): SWISSPROT Homolog: EC 3.2.1.14 Chitinase
MTTNTKRAYKLQEFVAHSSNVNCLKIGRKTSRVLLTGGEDHKVNLWAIGKPNSILSLSGHTSAVESVGFDSTEVFVAAGAASGTIKLWDLQEAKIVRTLTGHRSNCMSVDFHPFGEFFASGSLDTNLKIWDIRRKNCIHTYKGHTREVNAIRFTPDGRWVVSGGEDNTVKLWDLTAGKLLHEFKCHEGQIQCIDFHPHEFLLATGSADKTVKFWDLETFELIGSTGPETTGVRSMTFNPDGRSLLCGLHESLKVFSWEPIRCHDTVDVGWSRLADLNVHEGKLLGCSFNQSCVGIWVVDLTRLEPYATGTSTKVNGHSELKTVLSGTMPLQNDSGSRANIGRSSVLQNSENNLKASSGRLSVSQNTDSALKETKSTASSGLVPSTPQRAGVGSNNRSFGNSAFASGGTTLKRSSLRSHNASSVSNFSKADIVPVIVPRTSSGGELTTDSRSDAADVAPVLSKATRRADPATESRKESTDVEPIIPRASPRMEISSDSAPVIISKSGRRLESGADSKKESPDAAPVVPRSNTKMEMAFESAPILSKANRKVDSGTDSKKESADATPVIGPRTGSRTEMSS

SEQ ID NO: 20115 - DNA, 648 bp, Panicum virgatum
  misc_feature: Ceres CLONE 1810107-R
acagacatttaggtgtttcattggaattgttggtgaagcttgtcaggacctttggtccaatgatacattcgacagtatcagcaggtcctttttctgttggtgtagatcttgaggcagagcaaaggcgggagcgctgcaacttatgcttcattgaattggagaaagtaaaaaataagcttccttttcttacaagaagaaaaggggcagttgcaaatgcggcacaggagctcactcttgtcttccaggaagttatgagttgacaattagatgggaaatgcttccccctgatggcacgttgatatcagcagctgctgagcgctagctgttcaatcttgggctgccatcaatctccaaggccacaccagcagcagaaatatttttgtttctgctgttcgtgccatttgtacacatgctaacagcgggactgacatccatatcatttggggagagaagcagccatggacaatgacttcagccacaatattatgtggacgtggtttcatggctgctgaagatggtgtgcttttcgagcacttctagtactttgccgtctataccgtgtggtgtggtcgatttagttacaagatggacgagtgaagcaagcaaggcatgtatatcatttttgaatgtttgatatctattctccgg

SEQ ID NO: 20116 - DNA, 1684 bp, Panicum virgatum
  misc_feature: Ceres CLONE 1810128
  misc_feature: Encodes the peptide sequence at SEQ ID NO. 20117
ctccgatccccggctccttcctcctccctcccaccccgccccgcccgccaatcatttcgcttgctcgcttccaagttccaccgcagccgccgccgccgcgcgcatgccgcccgccgccccgcccctgtttcgtagagtatatatatagccccgggcggcgatgatcaggccgcaggccgggctgctgctgcggtcgctcggagcgggaggcgcgcgcccgacggcggcgtccatgaggtcggccacctcgctcctcctcggcgccgcgctcgccaccgccttcttcctcctctacaccgccctctgccgcgacatcggcggctcccccggcacgccgccgccgccgcgctgggagcgggaggccgggaaggccgtcgacacgggcggcgccaccgctgctgatcgggaggtgcgccgggacctcaaccccaagcaacgacaacatgccgccgaggaggaggggaggaaagaggaggtgacgacgcgcggcgacggcggcggcggcgggcacggcggaggaggagaagatgaggagagcggccgggacagcaagcaggaggagcagccgcagcagattgtgatgcctgcgacttggactccaacgaccaagcagcagcaggagcaacagacccaggacgacgatctggcggacctgctccggcgagcggcgacggcggacaagacggtgctgatgacggcgatcaacgaggcgtgggcggcgccgggctcgttcctggacctgttcctggagagcttccggcacggcgagggcacggcggacctgccgcggcacctcctcatcgtggccatggacggcaaggccttccggcggtgcgtcgccgtacacgccttctgctactggttccgcgtcgccggcctggacttcgccggcgagcagaagtacatgaagggcgactatctggagatgatgtggcggcggaacgggctccagcggcgcgtcctggagctcggctacagcttcctcttcacggacgtggacatcctgtggttccgctccccgttcccgcgcctccccgccggcgcgcaggtggttatgtcgtcggacttcttcgtcggcgacccggcctcgccgaacaactaccccaacggcggcctcctctacgcccggtcgtcgccggccgccgtggcgttctacgagcactggcaggcggcgcgggcgcggttccccgggaagcacgagcagtacgtgttcgacatgatcgtcaaggagggcgcgccggcggccgtcggcgccgccgtgcggttcctggacacggccgtcttcggcggcttctgccagcacagcaaggacctgggcagggtggccaccatgcatgccaactgctgcgtggggctggagaacaagctcttcgacctcaagaacgtgctcgacgactggaaggcgtacagggcgcgcgtcgccgccggggacgacgcgcgggggttctcgtggagggtgcccgggagatgcatacactgatgggctcctcattcttacagtagtgtggctattgtagctcatttttctaatgagtatagatacatttgcaaatatgtttctttttcgttttccgcaaacaaatttgaaagagacatggtgttatacatatgcaccaacatcgaggagcaggcatatgcatgaaccattcaaggctgcaggccacagccatggttgatctacagc

SEQ ID NO: 20117 - protein, 439 aa, Panicum virgatum
  misc_feature: Ceres CLONE 1810128
  misc_feature: Functional homolog of the protein sequence given in SEQ ID NO 50775
  misc_feature: Useful for making plants with altered carbohydrate content
MIRPQAGLLLRSLGAGGARPTAASMRSATSLLLGAALATAFFLLYTALCRDIGGSPGTPPPPRWEREAGKAVDTGGATAADREVRRDLNPKQRQHAAEEEGRKEEVTTRGDGGGGGHGGGGEDEESGRDSKQEEQPQQIVMPATWTPTTKQQQEQQTQDDDLADLLRRAATADKTVLMTAINEAWAAPGSFLDLFLESFRHGEGTADLPRHLLIVAMDGKAFRRCVAVHAFCYWFRVAGLDFAGEQKYMKGDYLEMMWRRNGLQRRVLELGYSFLFTDVDILWFRSPFPRLPAGAQVVMSSDFFVGDPASPNNYPNGGLLYARSSPAAVAFYEHWQAARARFPGKHEQYVFDMIVKEGAPAAVGAAVRFLDTAVFGGFCQHSKDLGRVATMHANCCVGLENKLFDLKNVLDDWKAYRARVAAGDDARGFSWRVPGRCIH

SEQ ID NO: 20118 - DNA, 2286 bp, Panicum virgatum
  misc_feature: Ceres CLONE 1810142
  misc_feature: Encodes the peptide sequence at SEQ ID NO. 20119
gacgcgtcgtctccttcctcctcagcctcgccgcaaaaaccctagccaccgctccctccgcctccacggttctctctccgaaggcaaaggggatttggtgccgcgccgcgggctcgaggcgatggcgggcggcgggaagaaggataagggggaggcgctgggccgcgcgctgatccggcagcggaacaaggcggcttcggccgccaaggagcgcggcgaggcgctcaccttcgcgcgccgccgcgcgacgccgctcgagtccgtcatcgacgtcaatgacatcgacgccgtgctgcagcgggccgcggaggccgaccagctcgccgaggccgcgtccgtctcctccgactccgacctcgtcatcgacctggacgcgacgggggagacgaacgaggagaggcggcggctgcggaaggagcaggaggccctgcacgctagcagcctcagggttccccggcgtccaccatggcataatcagatgaccgtagaggagcttgatgcgaacgagaggcgggcgttcctggtgtggcgcaggaatcttgcgagattggaagagaatgacaagcttgtcctgacaccctttgagaagaatattgacatctggagacagctctggagagtgcttgaacgtagtgatttgctggttatggtggttgatgctcgagatcccttattctatcgctgccctgaccttgaggcatatgcaaaggaaattgatgaacacaagagaacaatgcttcttgttaacaaggctgatctgttaccgttaaatatcaggaagagatgggctgactattttaaggcacatgatattctctttgttttctggtcagctaaagctgctactgccacgcttgaaggcaaaaagttaagtggatactctgaagaagaatctgattcgcttgatttggacaccaagatatatggcagggatgaactcttgatgaggctgcaagctgaagcagaatctattgtagcacaaaggagggcctcaacttctgaagaggatcatgatgtcagttcttctgattctgtttcgtcagtggttaagcatgtagttgttgggtttgttggttatccaaatgttggaaagagttccactataaatgctttggttggtgagaagaggactggtgttactcacacacctggcaagactaaacatttccagacactgataatctctgaagagctcactctgtgtgattgccctggactggtcttcccttctttctcaagctcaaggcatgagatggtggcatgtggtgtcttgccgattgacaggatgacaaagcaccgggaagctattcaggtggtggcagatcgtgtcccgagaaatatccttgagcagatttacaaaatcaccttgctgaagccgaagccttacgaatcgcagtctcggccaccaactgccgctgagctgttgcgggcctactgtgcatccagggggcatgtcagccatgctgggctgccagatgagaccagggctgctcgacagatactgaaggattacattgatggtaaaatcccgcactttgaactccctcctggggtaacagacgttgaaaaagaacttgaaataatagccagatcagaaggtccaacgacttcatcagcagttaatgaatcagatgctgatgatttggatgaagaggatgaggacgcagttgatccagcagaaccagacatgagagatgtcctggatgacctggaatctttcgacttggccaatggaggatctaagactgctgcaaagaagaaagaggcgtcccacaagcaccacaagaagccccagcggaagaatgatcggtcctggagggtcggcaacgatggtggcgatggaacagcagttgtaagggtgttccagaaacccgctgttaacttgtccgctgtcggtgcaagtggcagggtctaataccccaactttctgctttgcacaaccacacgacacatgggaagggcactgagcctctaccgtatgccgatgctgaagcttcttacggtggaagggacaagcagaatgtttcggttttgcatgacagcttgtaaaaccttacacagccctgatagtcgttaccagaaactcgtgttgcccctgtggccttccatatgcagggagttgtagtgcgatagatacatacggctgcgtgtattgtttgcttctccatgtcctacatagcaacacatatgtgaaggtattcagatggttgatacttgctatggttggactcggttccaaacccttatctttgatgtattgatagacgttcttaatacaaatgtcag

SEQ ID NO: 20119 - protein, 597 aa, Panicum virgatum
  misc_feature: Ceres CLONE 1810142
  misc_feature (312)..(423): Pfam Name: MMR_HSR1 Pfam Description: GTPase of unknown function
MAGGGKKDKGEALGRALIRQRNKAASAAKERGEALTFARRRATPLESVIDVNDIDAVLQRAAEADQLAEAASVSSDSDLVIDLDATGETNEERRRLRKEQEALHASSLRVPRRPPWHNQMTVEELDANERRAFLVWRRNLARLEENDKLVLTPFEKNIDIWRQLWRVLERSDLLVMVVDARDPLFYRCPDLEAYAKEIDEHKRTMLLVNKADLLPLNIRKRWADYFKAHDILFVFWSAKAATATLEGKKLSGYSEEESDSLDLDTKIYGRDELLMRLQAEAESIVAQRRASTSEEDHDVSSSDSVSSVVKHVVVGFVGYPNVGKSSTINALVGEKRTGVTHTPGKTKHFQTLIISEELTLCDCPGLVFPSFSSSRHEMVACGVLPIDRMTKHREAIQVVADRVPRNILEQIYKITLLKPKPYESQSRPPTAAELLRAYCASRGHVSHAGLPDETRAARQILKDYIDGKIPHFELPPGVTDVEKELEIIARSEGPTTSSAVNESDADDLDEEDEDAVDPAEPDMRDVLDDLESFDLANGGSKTAAKKKEASHKHHKKPQRKNDRSWRVGNDGGDGTAVVRVFQKPAVNLSAVGASGRV

SEQ ID NO: 20120 - DNA, 1901 bp, Panicum virgatum
  misc_feature: Ceres CLONE 1810154
  misc_feature: Encodes the peptide sequence at SEQ ID NO. 20121
cccgcacggcacagcgctactcgacacctcaccagctgcgcccacgcacgtacgcgccgcgccccgtgccccgtgccccgtgccccgggggctttccaatcctttccacgctgtcgccgcgcgcgctctcctgcgctgctccgtccgtccccccttccggcgttcacaccgcctgctcagcctcgcgtcttacaaagaggcacaggtgcgtaccctccgatccccctgagaggcggcacggcggagagagcggcggcggcggcgcgagaagctgctcgtgtcggcgactcggctcgaaagccgccagctttcgcagagctgccgccgcagcagcagcagcagcttgtgccgcggggggtcatgagctgcctgggctggttcaaacggaggtcgaggagcggcggggcgtcgtcggggaagcgcggggcgtcggcgccgccgtcgtcgggcccggcgaccaccacgacgacgaccacggtgtcgggggtgagcacgagccggtcggacgactccggcgcggtgcggccggtgagcaagtcggcggggtcggccgcctcgtcgcagtcgcagcggagcatctcgtcgctgtacgaggagcggggccatggccagctgcgagtgttcgactacgaggagctccgggccgccaccgccgacttcggccgcgcgcagaagctcggcgagggcggcttcggcagcgtctacaagggcttcgtccgcgcggccgacggcaagggggaccgcatccccgtcgccgtcaagaagctcaaccagcgcggcctgcagggacataagcagtggttggcagaagtacagtttcttggtgttctggagcacccaaatcttgtaaagttacttggatattgcgccgttgactccgaaagagggccacaaagattgttggtgtatgaatttatgccgaacaagagcttggaagaccacttgttcaggcgagctaatcctcctttatcgtggaacaaaaggcttcaagttatcttgggtgctgccgaaggattggcctacctgcatgaaggggtagaagttcaggtaatctaccgggacttcaagacgtcgaacattttactggacaaggacttcagagccaagctgtcagacttcgggctagccagggaaggaccaactggagcaaacacccacgtctcgactgcggtcgtcgggacgcaagggtacgcggcgccggagtacgtcgactcggggcacctgacggcgaagagcgacgtgtttagcttcggcgtggtgctgtacgagatcctgacggggcggcggtccctggaccggaacaagccggcggcggagcagaagatgctggagtgggtggcccagttcccgccggacagccgcaacttccggatgatcatggaccccaggctccgcggcgagtactcggcgaagaccgcgcgggagatcgccaagctggccgacagctgcctgctcaagaacgccaaggatcggcccaccatgggcgaggtggtcgaggtgctcaggcgcgccgtgcaggcggccgagccggatagccggtcacccggtgccggcgccgtcagggggaggagaggcgacgcggccgcgccgtccaggaggtgattgctattgctatgccacggtgtcatcgccggcaaaggctctggttggcttgagtcgaagctagctggtcatggaacgatggaagggagactgatatgcggctgtcgtcagacgtgacactgacagcacacagagaatgttagttttgggtctgtgtcggtgagtggcgggggcttacaaatatttttctggcacattacttggacaaatagagacgattcggcggattgaagttttagttttctttttcccttaacctttcgaaagtgagaattttagaagaattttgcaccggctcc

SEQ ID NO: 20121 - protein, 413 aa, Panicum virgatum
  misc_feature: Ceres CLONE 1810154
  misc_feature (100)..(381): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50301
  misc_feature: Useful for making plants with modulated heat sensitivity
MSCLGWFKRRSRSGGASSGKRGASAPPSSGPATTTTTTTVSGVSTSRSDDSGAVRPVSKSAGSAASSQSQRSISSLYEERGHGQLRVFDYEELRAATADFGRAQKLGEGGFGSVYKGFVRAADGKGDRIPVAVKKLNQRGLQGHKQWLAEVQFLGVLEHPNLVKLLGYCAVDSERGPQRLLVYEFMPNKSLEDHLFRRANPPLSWNKRLQVILGAAEGLAYLHEGVEVQVIYRDFKTSNILLDKDFRAKLSDFGLAREGPTGANTHVSTAVVGTQGYAAPEYVDSGHLTAKSDVFSFGVVLYEILTGRRSLDRNKPAAEQKMLEWVAQFPPDSRNFRMIMDPRLRGEYSAKTAREIAKLADSCLLKNAKDRPTMGEVVEVLRRAVQAAEPDSRSPGAGAVRGRRGDAAAPSRR

SEQ ID NO: 20122 - DNA, 1565 bp, Panicum virgatum
  misc_feature: Ceres CLONE 1810161
  misc_feature: Encodes the peptide sequence at SEQ ID NO. 20123
acgagaccgccgagaaatcgaagctccgtaggcagaagaacagcaaaatcgttccacgggccggattgggcatcccaatcagaccaggcttcttcgtcaacatctgcttccgtcgagatggccaaatcaccaatccatcggggggcctcctgtagtataagcatccgagctcgacctccatcaacagcgcctgccacctgcctacgctactcgtgacatcatccatccccgcacggaggtggtgcgctgccgctccgccgctgaacaaaacttgttcatggccaaacctccctccagaccacgccaaaccaccaaaatttcctcaccaaaccttcaccaaaaaatcgaactcccaagcacaaatcatctccagtcgctcgaatcccagatcaaacccaaggccacaacaagctcaaaatcatacaccgagccgcccgaaaatccgagaccgaagctgccaaggcagatcgccatctgaccacgatgccacaccagagtgccacgcccagaactcgtgccacccatccctcctgctccatctccatggacgcacaccgccgcggccaccatcagcgaccacaaaatcgagacggcaaccgcacgagcacgagccgctctccccacgacgaagacgacgactcccatctaacgaccctccctatccgatccactccccccgaatcgcacgaggaaacttaggggaaaaaaaacgcatctccctcaccaccgagccgcactcccttctctattcaccctgacacttgggaagcccattagaacacacaaagaacaagaaccggagcgcggagaagaagagagagagagaaaaaaaatccccaaaatcccaggacgattcctcttcgtcaacatctggccatcccatccaaggtcgtttccggttcgctttccgccgccgccgcgagggatcgggaggtgggaggagcaccccaattcaccgaattcgcgcggcaggctggtagggttagggtttgccaaggtggttcgggcccccacgattcgccggggcggtctagcggcctatccggcggtccgggatgatcttcaagcggaaccagcggtcggagatcctcgcgctgcggcgatgcaatgccgcgggcggcggaggggaggacgaagggggaggcgacccccgcccgaggaagaggcggaggggcgacgagttcttccccgtcgagctgctcggccacgtccctgcctccggcatcccgtacgcagcatatgggttccggtggagcgaggagcccgaggcaccggcagaggccgcgcagccggtggccgcggcgaggccgccggtggtgcgcacgtcgcgaggccgcacccaggtattgccctccaggttcaatgactctgttcttatcgacccctggaagaaggagaagccggcaaagcccccggcgcctgtcaagacagagcagttggtgcgcaaaaatggggtgctgcacgacagaggtgcaatctcttacaggagctatgcattgtccgagctggatgacgatgatgatgatgataacgccattgtggctccttaccaagcacgccggaat

SEQ ID NO: 20123 - protein, 169 aa, Panicum virgatum
  misc_feature: Ceres CLONE 1810161
  misc_feature: SWISSPROT Homolog: EC 2.1.1.43 Histone-lysine N-methyltransferase
MIFKRNQRSEILALRRCNAAGGGGEDEGGGDPRPRKRRRGDEFFPVELLGHVPASGIPYAAYGFRWSEEPEAPAEAAQPVAAARPPVVRTSRGRTQVLPSRFNDSVLIDPWKKEKPAKPPAPVKTEQLVRKNGVLHDRGAISYRSYALSELDDDDDDDNAIVAPYQARR

SEQ ID NO: 20124 - DNA, 818 bp, Panicum virgatum
  misc_feature: Ceres CLONE 1810161-R
tttcgacttcttcccccatctcgcagcagagggctgtgctgctgttcgtccggcgactcctctcccgcgcttgcccttcctcccgaacggccagtccttgcatggcagcagcagctagcttcaaggggcgggcgatcgctgggagcttcgtcagccgcgtcctggccggcaaggccgcctccccgaggagggccgtgcacgcctcggtgtacgacaagaacctggaggaccaggtgcgccccgcgttcgtgccggacgatgtgatcggcggcgccgccaaccccgacaagtactgggccccccaccccaggaccggcgtcttcggcccggccgcggtggacgccacgctgcccgccgccggcgcgccggacgccgccgcggatgctccgggcacgatgctggaccagaaggtgtggttccgccccctggaggacgtcgagaagccgccgcccgtcgcctgaggcgcgccggccgggcgctcgcagccggcgcgctgccttgctgataaggcagggagagcctggcgctgatacgcctatcactctgctcagccgggctcccttgcttatagctataatactgcttggttagtagtggctctggctgtggcgctgtacttatagtagtactggtttctattatcgtggtgtgagtaatcgggcatgacgggcctcaggaccggtagcggctgtacaaaaatgatgctcgtgctcgtgcctgtaataagagcaagcaggaggtgtgtgcccgtgctgcttgtggatgtgatgtacctgtattcttatcagtgttataagtatctggatccttggttgtgc

SEQ ID NO: 20125 - DNA, 1587 bp, Panicum virgatum
  misc_feature: Ceres CLONE 1810164
  misc_feature: Encodes the peptide sequence at SEQ ID NO. 20126
gtatctcctcccaactctctcaaacctaccccagaccctcaccggcctgtgtgcgccgccgccgccgcctcctcgatgactcccgcgcccgtccgattggcgtcccccctccccccctggttcccgagattcggcggcgagagcgggattgatgcgcgcatggcgctgcgggcgcggctgatggggccgggcggcgggccgcgggtgctgctgctgctctccgctgccttcacggcgctcctcgtcgcctccatcctcctcctcccgtcgctcctcctccggacgggcggcgcgcgggggcccagcttcctcctctcgtcccccgccgccgccgccgccgccgacctccagcaggagcagcaggaccagcggtacccggtctcgttcgcgtacctgatctcggcggcgtcgggggacgcggcccgcgcggcgcggctgctggcggcgctctaccacccggccaacacctacctgctgcacctggaccgggaggcgcccgcgggggagcaccgccgcctggcggagctcgtgtcggcgcgggccgtgtacgcgcgcgcgggcaacgtctgggtcgtcggccgccccaacctcgtcacctaccggggccccaccatgctcaccaccacgctgcacgccgtcgcgatgctgctccgcctgcgctgccgctgggactggttcgtcaacctcagcgcgtccgactacccgctcgtcacccaggacgacatgatggaggccttcgccgggctgcccagggacctcaacttcatccagcacaccagccacctcggctggaagataaagaagcgggcgcggccggtgatcctggacacggcgctgtacgaggacgggcgggcggagctcatccggccagagaacatcaccaccaacctccggaggttgcccacggccttcaagctctacacagggtccgcgtggacgatgctgtcgcgtcccttcgccgagtacgtgacgatggggtgggacaacctcccccggaccctcctgctgtaccacgccaacatcgtctcctcgccggagttctacttccagacggtggcctgcaactcgctgcggttccgcaacgccaccgtcaaccacgacctgcacttcatccgctgggacaacccgcccaagcagcacccgctgcacctcaccgccagggactaccgccggatgctgctcagcggcgcccccttcgcgcgcaagttccgggagggcgacccggtgctggaccggatcgaccgcgacatcctgcgccggcgcgggcccggccagttcgcctacggcgggtggtgcgccggggacggggacgggggcggagacggcggcgcggcggcgctgtgcggcagcaacccgcaggagccccggaggaagggggccgtcagggccggcgccggggcgcgccggctcaaggtgctgctgggcaaggcgctggccccggggaatctcaggagaaggcagtgtagatgaaataaatttgttttgggctttttattcacagggtggactgattctgatcaaacatgacatgtatagcgaaagggacaacgacatgaattacaggcaattttggttcggaaggaccct

SEQ ID NO: 20126 - protein, 436 aa, Panicum virgatum
  misc_feature: Ceres CLONE 1810164
  misc_feature (76)..(304): Pfam Name: Branch Pfam Description: Core-2/I-Branching enzyme
  misc_feature: SWISSPROT Homolog: EC 2.4.2.26 Protein xylosyltransferase
  misc_feature: Functional homolog of the protein sequence given in SEQ ID NO 50706
  misc_feature: Useful for making plants with altered carbohydrate content
MALRARLMGPGGGPRVLLLLSAAFTALLVASILLLPSLLLRTGGARGPSFLLSSPAAAAAADLQQEQQDQRYPVSFAYLISAASGDAARAARLLAALYHPANTYLLHLDREAPAGEHRRLAELVSARAVYARAGNVWVVGRPNLVTYRGPTMLTTTLHAVAMLLRLRCRWDWFVNLSASDYPLVTQDDMMEAFAGLPRDLNFIQHTSHLGWKIKKRARPVILDTALYEDGRAELIRPENITTNLRRLPTAFKLYTGSAWTMLSRPFAEYVTMGWDNLPRTLLLYHANIVSSPEFYFQTVACNSLRFRNATVNHDLHFIRWDNPPKQHPLHLTARDYRRMLLSGAPFARKFREGDPVLDRIDRDILRRRGPGQFAYGGWCAGDGDGGGDGGAAALCGSNPQEPRRKGAVRAGAGARRLKVLLGKALAPGNLRRRQCR

SEQ ID NO: 20127 - DNA, 617 bp, Panicum virgatum
  misc_feature: Ceres CLONE 1810171
  misc_feature: Encodes the peptide sequence at SEQ ID NO. 20128
agcggagcgatccaaccgtagcaatccatcgatcaatcaatccatcagcctgccgatcgaccgatcgaggagagcgccctgcacgtctgctgcggcctgcgggggagggggggagatggcgtccgggtaccgcgcggaggaggagtacgactacctgttcaaggtggtgctgatcggggacagcggcgtcggcaagtccaacctgctgtcgcggttcgccagggacgagttcagcctcgagaccaggtccaccatcggcgtcgagttcgccaccaagaccgtccaggtcgacgacaagctcgtcaaggcgcagatctgggacaccgccggccaggagaggtacggacgcgccgcgcccttcgccgtgcaatctcttctcgttcgtttgctgtgtgtgctctgtgctgctgctttaggatttctgcgccatttccagggcctgcctatgttgattgataatgggtattcgtatggaaaattaagcgtaactgacatggggatgcttctggttcatagtatttctgatatgaaaaaaccaaaccaccaagtccaaagggatcgctgatgatgatcgcttaatgtttatggctgaatacgggattccttgattcacatgt

SEQ ID NO: 20128 - protein, 149 aa, Panicum virgatum
  misc_feature: Ceres CLONE 1810171
  misc_feature (16)..(137): Pfam Name: Ras Pfam Description: Ras family
MASGYRAEEEYDYLFKVVLIGDSGVGKSNLLSRFARDEFSLETRSTIGVEFATKTVQVDDKLVKAQIWDTAGQERYGRAAPFAVQSLLVRLLCVLCAAALGFLRHFQGLPMLIDNGYSYGKLSVTDMGMLLVHSISDMKKPNHQVQRDR

SEQ ID NO: 20129 - DNA, 711 bp, Panicum virgatum
  misc_feature: Ceres CLONE 1810172
  misc_feature: Encodes the peptide sequence at SEQ ID NO. 20130
aagccaaaccgcacacggccacgccgcccatggacgcgagcggggcgccgccgcccctcctggccgtgtcctccttcgccgcggccgcgctgctcttcgccgcggtgctggggtggctcttcgccgcgcggtcgtccaagcgcgggtcggcgcggctgccgccgggcagcacggggctgccgctcatcggggagacgctgcgcctcatctccgcctacaagacccccaacccggagcccttcatcgacgaccgcgtggcgcgccacggcagcggcgtcttcaccacccacatcttcggcgagcgcaccgtcttctccgccgacccggccttcaaccgcctcctcctcgccgccgagggccgcgccgtcggctgcagctacccgtcctccatcgccacgctgctcggcccgcactcgctgctcctcaccaggggccccgcgcaccgccgcctccacacgctcacgctcacccgcctcggccgccccgcgtcgccgccgctcctcgcctacatcgaccgcctcgtcctcgccaccatgcgggagtgggagcccgccgccaccgtccgcctcctcgacgaggccaagaagatcaccttcaacctcaccgtcaagcagctcgtcagcatcgaccccggcccgtggaccgagagcgtccgccgcgagcgaggaagaaggtggccggcgctctgcgggaggtgataaggaagaggat

SEQ ID NO: 20130 - protein, 222 aa, Panicum virgatum
  misc_feature: Ceres CLONE 1810172
  misc_feature: SWISSPROT Homolog: EC 1.14.13.93 (+)-abscisic acid 8'-hydroxylase
MDASGAPPPLLAVSSFAAAALLFAAVLGWLFAARSSKRGSARLPPGSTGLPLIGETLRLISAYKTPNPEPFIDDRVARHGSGVFTTHIFGERTVFSADPAFNRLLLAAEGRAVGCSYPSSIATLLGPHSLLLTRGPAHRRLHTLTLTRLGRPASPPLLAYIDRLVLATMREWEPAATVRLLDEAKKITFNLTVKQLVSIDPGPWTESVRRERGRRWPALCGR

SEQ ID NO: 20131 - DNA, 272 bp, Panicum virgatum
  misc_feature: Ceres CLONE 1810178
  misc_feature: Encodes the peptide sequence at SEQ ID NO. 20132
tcgtcgctgttcggccacgtcgagcccgcgcccagagatcctatcctcctcctcaccgacgcctacctccaggacccctcggccgacaagatgaacctcggcctcggcgcctagcgggacgacgaccgcctgcccctcgtgctccactgcctgcgcgacaccgagcgccggattgccggccacctcaacatggaatacctcccaatgggaggcaggataaagacgattgaacaatctctgaagctggcgtacggagaggattccgaattcat

SEQ ID NO: 20132 - protein, 37 aa, Panicum virgatum
  misc_feature: Ceres CLONE 1810178
  misc_feature: SWISSPROT Homolog: EC 2.6.1.1 Aspartate transaminase
SSLFGHVEPAPRDPILLLTDAYLQDPSADKMNLGLGA

SEQ ID NO: 20133 - DNA, 496 bp, Panicum virgatum
  misc_feature: Ceres CLONE 1810198
  misc_feature: Encodes the peptide sequence at SEQ ID NO. 20134
ccacgatcactgataccacttcgcatgaaccaaatttcttgtgcggttccgagccacgtctccggttcctcggccgccgctccctcagcgtctctgcttcctcgaacacccaagagatgatcacccagcccgcgcccgatgggcacccccaagtggcgacggcggcagtcgaggtggtggcgccggaggagaccgtgttcccgtcgaatgtgcccgacatctcgatccccagccacctgcccctgcgcgagtactgctttgattgggcggccgaactcccgcactcccctggcctcaacgcgtcagccgcggggacgacgcacaagtccgccaatactgccctcctgtcccccgtggcctccacgtctctgcacggcctcggtgtcggcccgggttaccgcgtcaagatcctgctccagaactccgaggagtacgtgctcactttctttgacgcgtcggtcctaggtgccgtcaccaccgccaccgacgtgttctg

SEQ ID NO: 20134 - protein, 126 aa, Panicum virgatum
  misc_feature: Ceres CLONE 1810198
  misc_feature: SWISSPROT Homolog: EC 6.2.1.12 4-coumarate--CoA ligase
MITQPAPDGHPQVATAAVEVVAPEETVFPSNVPDISIPSHLPLREYCFDWAAELPHSPGLNASAAGTTHKSANTALLSPVASTSLHGLGVGPGYRVKILLQNSEEYVLTFFDASVLGAVTTATDVF

SEQ ID NO: 20135 - DNA, 1503 bp, Panicum virgatum
  misc_feature: Ceres CLONE 1810199
  misc_feature: Encodes the peptide sequence at SEQ ID NO. 20136
gccctacgcgggagcccaagcacaactccttcaaagccctagctactaccaagtaccaacaccgcccccctccaccatccccacgcagccgttgctgtcccttccggcagcctcgagaacctcccccattccccttcccctccgcctcgccgacggggcctccctccgctccgctccgcaccctcccctccccgccgacgcacgcacccgcgcggcgccgcccgtcgactcggatcgaggcgtaagggatggcgagtctgaccggcctgaccgcgaaccccaacccgaacaagtcattcgagatccagcccaaccccggcgactccgtctcgagcctcagcttcagccccaagagcaatctgctggtggcaacctcctgggataaccaggtgaggtgctgggagattgttggcgggaacagtcagcccaaggtgtccatatcgcatgatcaaccggtcctctgctcagcttggaaggatgatggaacaactgtcttctctggaggctgtgacaagcaggtcaaaatgtggcctctgctgtcaggcgggcagcctcagacggttgcgatgcatgatgcgcctgtcaaggaggtcgcgtggattcctcagatgaatcttcttgtctctggaagctgggataagactctgaggtactgggacacaaggcaagcaaatcctgtgcatatccagcaacttccagagcgttgctatgctctcacagtgaattatccccttatgattgtgggaactgctgatcgtaatcttgtagtcttcaacttgcagaatcctcagacggagttcaagcgtattcaatcaccactaaaataccagacacggtgtcttgctgcattccctgatcagcaaggatttctggttggctccatagaaggaagagttggtgttcaccatatcgatgattcacaacaaagcaagaatttcaccttcaaatgtcacagggaaggaaatgatatattctctgtcaattcactgaacttccaccctgtccatcacacatttgcaactgctggatctgatggtgctttcaacttctgggataaggacagcaagcagaggctgaaggcttttagtagatgccctcttcccatttcttgcagcacctttaacagtgatggttccatatttgcttacgcggtctgctatgattggagccgtggggctgaaaaccacaatcctgcagctgcaaagacatccatctacctccacagtccacaggattctgaggtcaaaggaaagccgcggattgcaacaggcaggaagtgatttggttccaacttgcgggatccattcgtctttaggccagtcaccagttttgttatgccccctcctgcattggaagtctggtatatgtaaatttcagggtacctgtagcgtctaggcactgaatatagggatcccgtttcaagatttggatccaacaccgtattcgaattcgatccggtgtgaaagggtttttatccatccgtatccgtatctgatttcgagc

SEQ ID NO: 20136 - protein, 343 aa, Panicum virgatum
  misc_feature: Ceres CLONE 1810199
  misc_feature (99)..(137): Pfam Name: WD40 Pfam Description: WD domain, G-beta repeat
  misc_feature (14)..(52): Pfam Name: WD40 Pfam Description: WD domain, G-beta repeat
  misc_feature (57)..(95): Pfam Name: WD40 Pfam Description: WD domain, G-beta repeat
  misc_feature: SWISSPROT Homolog: EC 2.3.1.48 Histone acetyltransferase
MASLTGLTANPNPNKSFEIQPNPGDSVSSLSFSPKSNLLVATSWDNQVRCWEIVGGNSQPKVSISHDQPVLCSAWKDDGTTVFSGGCDKQVKMWPLLSGGQPQTVAMHDAPVKEVAWIPQMNLLVSGSWDKTLRYWDTRQANPVHIQQLPERCYALTVNYPLMIVGTADRNLVVFNLQNPQTEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPISCSTFNSDGSIFAYAVCYDWSRGAENHNPAAAKTSIYLHSPQDSEVKGKPRIATGRK

SEQ ID NO: 20137 - DNA, 2188 bp, Panicum virgatum
  misc_feature: Ceres CLONE 1810204
  misc_feature: Encodes the peptide sequence at SEQ ID NO. 20138
attcatcatcatcagctcctacgatccatccctcgatctccctcccccttccgcgcgagcagctgcatgctctcccggcccagtgttcgatctccattgctagtactagcagcagatgaacatagccgccgccatggcgagcaagaaaggccgcggcggcggctgcgacatccaggccaccggcatcgactaccgcatcgccgtctccaccaaccctcctctcaaggtgtggagcaggtcagacgacgacgcccaggagcagaaccacctcatcaacaacggcgtccgccacgtgctccgcaacgtctcctgccgcgcgcgccccggcgagctgctcgccatcgtcggccccagcggcgccggcaagtccacccttctcgagatcctcgcaggccgcctctccccgtccccgccgccggacctgcatatgcatatgctcctcctcaacggcgccgctgccgccagcgccgacctccgccgcgtctccggctacgtgacccagcgggacgtcctcttcccgctgctgaccgtgcgcgagacgctgctcttcagcgcgcgcctccgcctcggcgcgaccctgcccgccaaggacatggacgcccgcgtcgacgcgctcctcgacgacctgaccctgcgccgcgtcgccgccacgaggatcaaggacctctccggcggagagcggaggcgcgtctccatcggcgtggaggccgtccacgaccccgcggtgctcatcctcgacgagcccacctccggcctcgacagcgcctcggcgctccagatcgtcggcgcgctccgcgccatggccgagacgcggggccgcaccgtggtgctcagcatccaccagccgggcgcgcgcatcgtcaagatgttcgactccgtcctcctgctggcagccggctccgtcctccaccacggcaccgtggatcagctgcgctccctgcttgccgacgcgggcctcggcctgcccccgcacgtggacgccgtcgagttctccatcgactcggtggacgcgctccgcgcccaccgccgccgcgccgacggtatgcagcatccccagcagacggcgtcctcccggtgcacactgcagcagctgttccagctgcacagcagcaagcagcagcaggaggtggctgctgctgtccccacggccacggccaattcgcgggcgcgcgaggtggcggtgctgacgcagcgcttgttcaagaacgtggcgcgcacgcggcagctcttcgcgtgccgcaccgtgtgcatgctggtggccgggctggcgctgggctccatcttctacgaccttggcgaggaccaggtagcggagcgcgtgggcctcttcgccttcctgctcaccttcctgctctcctccaccacggaggcgctgcccatcttcctgcaggagcgcgacatccaggccaaggagacgtcctcgggggcgtaccgcgtgtcgtcctatgcgctggccaacgcgctggtgttcctgcccttccagctcgcgctggccgtcgtcttcgccgcgccgctctactggctggcggggctgcgtcgcacggcgccggccttcggctacttcctgctgctcgtgtggctcatcctctacacggccaactccgtggtggtgtgcttcgcggcggcggcgcccgacttcgtcgtgggcaacgccgccatccagggggtcatgggctccttcttcctcttctccggctacttcatcgccaggtccgccatgccggggtgctgggtgttcatgcactacctgtcgctcttcaagtggccgttcgaggcgctgctggtgaacgagttcgccggcggcgggaggtgcgcggtgcgggtgctgggcgcctgcgtggccacgggggacgaggtgctgcggcgcgaggggctcggcgaggagtgccggtggcgcaacgtgggggtcatggtggccttcgtggcggcctacaggctgctgggctacgccgtgctcagggtcaggtgcagctgcaacagggggaattcaaaagccgctagctagctagcttgtgtgactgatcaaataattcaaatgtgctatcaccttagttttaaaaaatgtgctattacattaatttcaaaaaaaatgtgctattacccgcgccagatacgatgtataagctctgcaaactggtacagcagatacacatacacataaacttggagggcaacagcagtcgccacc

SEQ ID NO: 20138 - protein, 623 aa, Panicum virgatum
  misc_feature: Ceres CLONE 1810204
  misc_feature (346)..(554): Pfam Name: ABC2_membrane Pfam Description: ABC-2 type transporter
  misc_feature (65)..(255): Pfam Name: ABC_tran Pfam Description: ABC transporter
  misc_feature: SWISSPROT Homolog: EC 3.6.3.27 Phosphate-transporting ATPase
MASKKGRGGGCDIQATGIDYRIAVSTNPPLKVWSRSDDDAQEQNHLINNGVRHVLRNVSCRARPGELLAIVGPSGAGKSTLLEILAGRLSPSPPPDLHMHMLLLNGAAAASADLRRVSGYVTQRDVLFPLLTVRETLLFSARLRLGATLPAKDMDARVDALLDDLTLRRVAATRIKDLSGGERRRVSIGVEAVHDPAVLILDEPTSGLDSASALQIVGALRAMAETRGRTVVLSIHQPGARIVKMFDSVLLLAAGSVLHHGTVDQLRSLLADAGLGLPPHVDAVEFSIDSVDALRAHRRRADGMQHPQQTASSRCTLQQLFQLHSSKQQQEVAAAVPTATANSRAREVAVLTQRLFKNVARTRQLFACRTVCMLVAGLALGSIFYDLGEDQVAERVGLFAFLLTFLLSSTTEALPIFLQERDIQAKETSSGAYRVSSYALANALVFLPFQLALAVVFAAPLYWLAGLRRTAPAFGYFLLLVWLILYTANSVVVCFAAAAPDFVVGNAAIQGVMGSFFLFSGYFIARSAMPGCWVFMHYLSLFKWPFEALLVNEFAGGGRCAVRVLGACVATGDEVLRREGLGEECRWRNVGVMVAFVAAYRLLGYAVLRVRCSCNRGNSKAAS

SEQ ID NO: 20139 - DNA, 1687 bp, Panicum virgatum
  misc_feature: Ceres CLONE 1810206
  misc_feature: Encodes the peptide sequence at SEQ ID NO. 20140
gtccagctgctgcctgatcttttatcccccacttgccgcttgctgcccggggactgggctgctgggggaaggtcgccgacgggatcgatggaagattcgtctacgtttacggaaggagaggtggccgaagaagcgaaggggcaggctccaggccaaggaagctctgaaggtagtcatggtactcttttgcaagatataagggagaaggaaacaagaaaaggaaaggcggctgttggatccactgagctgatgagggaggatctggttcagagtgctgttagttttctgaaacatccaaaagtagtaacctcttcagacggacagaggcgatctttccttgaaaataaaggactcactgtggatgaaatagatgaagcatttcggcgtttacaagtaaggacttgtctgctcactttctactttctctgattttcttctctgattattctgacttcttttgttttctaaactcttttttggggttgaattaaagagcccatattcacattctttgagctcaaatacttgcacatctcaaggtatggaaagagactccatttgttaataatttttatgatatccaagtttaattttagtttgatatttttgtagatcctatcattatatttcattgtccatttgtgttctctgtaaagaacggtgattctaaatgaacttctcagttcagcccaaaatgtgtcatgggcactttgggctgggatagtagtccatcccattactgtagcgccggggtactgtagtaccggcgggattaggtcattagagtaagggttggtttagttctatataagtagaggttgtgcatctatttggaatcaagaaaaaattatcatgagcgatcctcatctaactctgggccttgagattgggcgcagccgccgccagcgtgcccgatctcaagtgtccagttcagcatccgtttattccgcacaatccccaattcccctaattctgcacggtctccccgatcagggccgtgacaaaatgacttgaccatgagtccatgacacatctaacttcattgtgttatattttgccttcattttaacaggggtgtctgatcattcgtgcaagattagtcaggaaactaaagctggcacaaagtgtatggatggttcagatagggttgaacctgaaactgaacctgtggcccctgtggtgcctcgtcatccaaaatcttatatggagatcatggaaatgatacaaaggggtgagcggccagatgatatacaggatattaatgatgaccctccaaaccctgatcaaccaatctcggaaccccgtatggcaccaaaacccaagccatgggaaaagcaaggtcaagaaagttcagcctgtggtttgaaattaccatcaagtgactccagtgatttgagatcagaggttcaacaagacggcaccgacaaggctacgaagtcagccgacacctcccaccaaggggactcactgctgcaagaagaagtagctgcaggctctgaatctcccacagattatgctgccacttcgtagtagtatcacacagtgatgtaatgaaacaagtagggaaaaagaaagttgtctgggcatatagcttgctaaagatgtttcagatcccaataccacaccactcttctgaattctgggacacctgcaattctcaggagctatttgagttgaaacttctccc

SEQ ID NO: 20140 - protein, 113 aa, Panicum virgatum
  misc_feature: Ceres CLONE 1810206
  misc_feature (55)..(112): Pfam Name: Pex14_N Pfam Description: Peroxisomal membrane anchor protein (Pex14p) conserved region
MEDSSTFTEGEVAEEAKGQAPGQGSSEGSHGTLLQDIREKETRKGKAAVGSTELMREDLVQSAVSFLKHPKVVTSSDGQRRSFLENKGLTVDEIDEAFRRLQVRTCLLTFYFL

SEQ ID NO: 20141 - DNA, 718 bp, Panicum virgatum
  misc_feature: Ceres CLONE 1810208
  misc_feature: Encodes the peptide sequence at SEQ ID NO. 20142
gcacgcgcgaatcgccgtggacctcgccgggggcggcgacgagctcggatcccggcgatctagtcgccggaggcggcccccatggctcgccggtcgtcatcctcgtcgtcgggggcgtggcggtacctgaaccccgcgtactacctcaagcggcccaagcgtctcgcgctcctcttcttcgtcttcgtcgcggccaccttcgccttctgggaccgccagtcgctcgtccgcgagtacgagtctgagatttccaaattagaagatgatataaatcggttgcaagaccagctaagaaaggctggagttcatgtggatgaaaatccaacaaaatacaccagaaaagatcttgtagaattcgatcctgtcaataatgaaaggagggaaaaagttaaggaggcaatgctccatgcttggaattcctatgtaaagtatgcctggggaatggatgagcttcagccacaatcaaagaatggcatcaatagctttggtggccttggagcaacccttgtggactcacttgatacactgtatatcatgggcctgaaagatgaatttcagaaagctagagactgggtggcggagtcattagactttgacaaggattatgatgcaagtgtttttgaaacgaccataagagtcgttggaggtctacttagtgtgtacgatctgtctggtgataaagtatttcttgagaaggctaaagatattactgatcgac

SEQ ID NO: 20142 - protein, 212 aa, Panicum virgatum
  misc_feature: Ceres CLONE 1810208
  misc_feature: SWISSPROT Homolog: EC 3.2.1.113 Mannosyl-oligosaccharide 1,2-alpha-mannosidase
MARRSSSSSSGAWRYLNPAYYLKRPKRLALLFFVFVAATFAFWDRQSLVREYESEISKLEDDINRLQDQLRKAGVHVDENPTKYTRKDLVEFDPVNNERREKVKEAMLHAWNSYVKYAWGMDELQPQSKNGINSFGGLGATLVDSLDTLYIMGLKDEFQKARDWVAESLDFDKDYDASVFETTIRVVGGLLSVYDLSGDKVFLEKAKDITDR

SEQ ID NO: 20143 - DNA, 2016 bp, Panicum virgatum
  misc_feature: Ceres CLONE 1810222
  misc_feature: Encodes the peptide sequence at SEQ ID NO. 20144
gtggccggcgcacgcgcctcgccggggcagcagggcacgtcggccggccagggtccccgcccccgtctcggcgcggcgggtgacggacgacggcaggggcggatcgttgcgggagtgggtgtgccgtgcaagcgaccgccaaaacgggggaccgggcgggcggaggcgcggagccaccaagccatcgactcatcgtcatcactcatctcagcagtaaaaaataccgcgggcgaaaagaaaaccaacaaacggggggcagaaccgaaggaggaggaggaaaaaaaatcagctcgtcggcttccccgaacacttgagtccggctggagcgcaggaggataatattcagtccgctatggctctttcatgggattgttgcgcgcggaaggttttcaatgccagcaccttctttgccacatggccgtcattgggcaccatgtcattcaattgtcgcagcacctttgctaattgcgtttgagctgcttctctgcatctatcttgaaagcttaagagttaggaatcatccatctgttcatctgaagattgtgttccttcctctgctggcctttgaagctattatacttatcgacaattttaggatgtgcagagctttaatgcctggagatgaagaaagcatgagcgatgaagctatttgggagacacttcctcatttttgggttgcaatttcaatggtttttcttatagctgctacaacattcacacttctcaagctatctggtgatgttggtgcgctggggtggtgggatttgtttataaattatgggattgcggagtgttttgcatttcttgtttgtacaagatggtttaatcccatgattcataagcatcccgctaatggggaagctagctcgtcatcagcagcaattagataccgtgactgggaaagtggccttgttctcccatcactagaagatcatgaaccagagaggctttgtggtctccctgatatcggaggtcatgtaatgaaaatacctctggttggtttccaagttttgctttgtatgaggttggagggcacaccgcctagtgctcggtacatcccaatatttgctctcttctcgccactatttattctgcaaggtgctggtgtccttttcgctttagcaagattggtggagaaggttgttctactactgcgtaatggaccagttagtcctaattatcttacagcttcatcaaaagttcgtgattgttttgcttttcttcatcgtggttcaaggcttcttggttggtggtctatcgatgaagggagcaaggaagagcaagcccgtttgttttatgctgaatctactgggtacaacacattttgtggttatccacctgaggtggttaggaaaatgcctaaaaaggatcttgcagaagaggtttggaggctactggcagcgttgggagagcaatctgaaattacaaagtgtaccaaacaggaatatgaaaggcttcaaaatgagaaggttctttgtaggatttgctatgagggggagatatgcatggtcctacttccttgccggcacagaacattatgcaagtcttgttctgagaagtgcaagaagtgtccgatctgccgtatgccaattgaagagtgcatgcctgtatatgatgtttaaacctcactaactcaggttaacattacgaacctgtacatgtgggtctgtcatgccgtgcacttgggctcgatcacaactttaagctgattgaggtgcgcacaacatcagaaaaggtttacggtaaaagcatatatgggggaaatacaagtatatcatgtctaaccaaaagaatgcaaaggttgctgatgagcattttgttggttcggtccagttatctattgtaagtatatggtcactgtagttcccttcctcttgtgattgatagacgggtcaggtagtcttggtttagcagcatcttctcagggacatgcagttgtctcagtgtaaataaaaactttgcttttgtttgaatgtagttctctcttggttgagaagtgaaaccaaaacagactgt

SEQ ID NO: 20144 - protein, 409 aa, Panicum virgatum
  misc_feature: Ceres CLONE 1810222
  misc_feature (362)..(396): Pfam Name: zf-C3HC4 Pfam Description: Zinc finger, C3HC4 type (RING finger)
MPAPSLPHGRHWAPCHSIVAAPLLIAFELLLCIYLESLRVRNHPSVHLKIVFLPLLAFEAIILIDNFRMCRALMPGDEESMSDEAIWETLPHFWVAISMVFLIAATTFTLLKLSGDVGALGWWDLFINYGIAECFAFLVCTRWFNPMIHKHPANGEASSSSAAIRYRDWESGLVLPSLEDHEPERLCGLPDIGGHVMKIPLVGFQVLLCMRLEGTPPSARYIPIFALFSPLFILQGAGVLFALARLVEKVVLLLRNGPVSPNYLTASSKVRDCFAFLHRGSRLLGWWSIDEGSKEEQARLFYAESTGYNTFCGYPPEVVRKMPKKDLAEEVWRLLAALGEQSEITKCTKQEYERLQNEKVLCRICYEGEICMVLLPCRHRTLCKSCSEKCKKCPICRMPIEECMPVYDV

SEQ ID NO: 20145 - DNA, 693 bp, Panicum virgatum
  misc_feature: Ceres CLONE 1810277
  misc_feature: Encodes the peptide sequence at SEQ ID NO. 20146
gaagccaaacgctaaaacctccccgtgtcagttgtcacacgagccggagaaaatgcgcgcgtcgatcccgaccccctcgctcctcgtcgccccgagcccgccgcggctccgctccctctacgctgccgcggctcccacctcccgtcaccacgcccgcggaggaggacgtcctcgcacccgcctgcgcgtggcggcgccgccgtccgcccccggtgaagcggcggagcagcaggcggagccgagcacgtcggcgcccgagtccggcgagaagttctcatggagggaccactggtaccccgtttccctcgtcgaggacctcgaccccagccgccccaccccgttccagctcctcaaccgcgaccttgtcatctggaaggaccccaagtccggcgagtgggtcgcgctcgacgaccgctgcccccaccgcctcgctccgctctcggaggggaggatcgatgagacggggtgcttgcagtgctcgtaccacggctggtcattcgacggctccggcgcctggaccaggatccctcaggccatgcccgagggtcccgaggcccgggcaatgcggtcgccgaaggcgtgcgcgaccaagttccccaccctcgtctcccaggggctgctcttcgtgtggcctgacgagaatggatgggagaaggccactgccaccaagcctccaatgttgccgaaagagtt

SEQ ID NO: 20146 - protein, 213 aa, Panicum virgatum
  misc_feature: Ceres CLONE 1810277
  misc_feature (79)..(188): Pfam Name: Rieske Pfam Description: Rieske [2Fe-2S] domain
  misc_feature: SWISSPROT Homolog: EC 1.13.12.14 Chlorophyllide-a oxygenase
MRASIPTPSLLVAPSPPRLRSLYAAAAPTSRHHARGGGRPRTRLRVAAPPSAPGEAAEQQAEPSTSAPESGEKFSWRDHWYPVSLVEDLDPSRPTPFQLLNRDLVIWKDPKSGEWVALDDRCPHRLAPLSEGRIDETGCLQCSYHGWSFDGSGAWTRIPQAMPEGPEARAMRSPKACATKFPTLVSQGLLFVWPDENGWEKATATKPPMLPKE

SEQ ID NO: 20147 - DNA, 3323 bp, Panicum virgatum
  misc_feature: Ceres CLONE 1810281
  misc_feature: Encodes the peptide sequence at SEQ ID NO. 20148
accctcctgttcctccctcttcgtctccctccgttccattctctcatggaagctgctcccgcagggatcagaacccgagcttgcccgcagcccactcccgcgggccccacgctctccgctcgttgctcctgacagccattgccctcttctcgatctgatccgtcgaattcggtccaccgcgcgcacccggggccgcatttcttttccccccgtcaagattcggtctggaggggccgtccccgcgcgattttgccggttcgtttggccagttcttgccggatttgctcctgctcccgtggtcgggagtggttggtggtcgggtggagctgcggaaggaatcaaattccaatcttttccggtcaccttcttccccaattagctgggatcagtgtggattctgactcgtaggtccttggctttccactgcgaggctcacattggtgtggttatgccatttgcctcgcgatttgtatctgttgttggtgtgaaaatctgagagtttggagatttgggaggtcttctccctcctgtgctctatgaggagcagcttcctgtcggagtcgccgtgcgacgagcagcacatccatggctacgggttcaacccccagtcatggctgcaggtggagcgggggaagctgcccaagtcatcctactcgccttcctccattgagtctctcatcaagattgctgagccgccggtagttccattgtataagcctttggattatgtcgaggttatgtccaggatccacgaggagatggagcagtgcatgccgagtgagcgaccagggctgtacctggtccagtcccaggtgtttaggggccttggggaggcgaaattgtgccagaggagcctgcactctgcattgcgctgtgcaagcactgtgcatgaaaaggtcatatttggggcatggttgcggtataagaagcgtggggaggagatcatatccgatgtgcttgcatcatgtaggaagtgctgccgagagtttggcccacttgatattgcttctgagatgccagtggggaattttcagatatttcgttcgtgtgagatgggctcctcatctcgagtttcttccacggtgacatttcaaatacgagatgggagggtgacatgcgataggtgcaagattgcatctttgtcgatcccatttttctccatgcttaatggaccatttactgagtcacagcttgagcttgttgatttgtcggagaatggtatttcattggaaggcatgagagctgtttccgagtttagttctacttatagcttagcggatttgcctttggaaatcttgttggagatcctggtgtttgcaaacactttttgttgtgacaggctaaaggatgcctgtgatatgaaactggctttgtttgtttcatcaaggcaggatgctgttgagctcatggcattggcatttgaagaaaatgcgccagttcttgctgcttcttgcttgcaaatgcttttacaggagcttcctgattgtctaactgatgatctagtaattagcctcttcttgggtgcgactgcacagcaacagcttatcatggtcggacaagcctcgtttttgctatactgcttgcttagtgaagttgcaatgaacattgatcctagggcagagacaactgtatgcttatcagagaagcttgttcagttagcagttacccctactcagaagcaaatagcttttcatcaacttggatgcattagacttttgagaaaggaatataacgaagctgaacacccatttgagattgccttctctgctggtcatatatattccattgctggtcttgctagaatcgctggcatgcgaggtcaaaaggctttggcttatgagaaactcagttcagtcatagcatctaatctgccattagggtggatgtatctggagagatctttgtattctgaaggtgatagaaagttggcggaccttgacaaagcaaccgagctggatccgactcttacttacccttacatgtaccgagctgcatccttgatgagaaagaaagatgctaaacttgccttggaggaaattaaccgactcttgggtttcaagttagcattggagtgcctggagctccgaatttgtctatacttggctctagaagactacaagtctgcgatctgcgatatccatgcgattctcactctttcacctgagtatcggatgttggaaggacgtgtagctgcttccaaaattggcactcttctcggtgctcatgtcgagcagtggaatacagctgagtgttggctccaactgtatgagcgctggtcatcagtggatgacattggttccctttcagtgatctaccggatgctcgagtcagatgctgcaaaaggtgttctgtactttaggcaatctttactgctcctcaggttgaactgtcctgaggcagcgatgcgcagtttgcagtcggcaagacatcatgctgcaactgagcatgaacgactagtatatgaggggtggcttttgtatgacactggacactgtgaggaggctctacaaaaagcagaagaatctatttctattcaaaggtcatttgaggctttctttctgaaagcctacattttggctgactcaggagttgatccttcttattctgcgactgttatctcgcttctcgaagatgcattgaaatgcccttcagaccggcttcggaagggtcaggctttgaacaaccttggtggtgtctatgttgattgtggaaaattagacttagcagctgattgctatacaagtgccctgaagattcgacacactagggcccatcaaggtcttgctcgtgttcatttcctcaggaacaacagggacgctgcatatgaggaaatgacaaaattgatagagaaagctaacaacaatgcttcagcttatgagaagcgctcagaatattgcgagcgagaacaaactatgacagatttgcaaacagtgacccaattggatcctttacgtgtttatccgtacagatatcgagcagcagtgctgatggatagccacaaggagaatgatgcaatagcggagctcagccgcgtcatcaccttcaaagctgacctccacttgctgcatcttcgggcggcattccacgagcacatcggggatgtcccaagcgctctccgtgattgtagagccgccctctccttggacccaaatcaccaggaaatgctagagcttcagaaacgtgtgaacagccaagagccctgacactgtggtgctatattgtgtattgtataccacgtaggtgcgcctcatggcagcctcaacccgattcattgttcttggtttgattcttaattaatcaccatcatatggtgttttaagcag

SEQ ID NO: 20148 - protein, 888 aa, Panicum virgatum
  misc_feature: Ceres CLONE 1810281
  misc_feature (711)..(744): Pfam Name: TPR_1 Pfam Description: Tetratricopeptide repeat
MRSSFLSESPCDEQHIHGYGFNPQSWLQVERGKLPKSSYSPSSIESLIKIAEPPVVPLYKPLDYVEVMSRIHEEMEQCMPSERPGLYLVQSQVFRGLGEAKLCQRSLHSALRCASTVHEKVIFGAWLRYKKRGEEIISDVLASCRKCCREFGPLDIASEMPVGNFQIFRSCEMGSSSRVSSTVTFQIRDGRVTCDRCKIASLSIPFFSMLNGPFTESQLELVDLSENGISLEGMRAVSEFSSTYSLADLPLEILLEILVFANTFCCDRLKDACDMKLALFVSSRQDAVELMALAFEENAPVLAASCLQMLLQELPDCLTDDLVISLFLGATAQQQLIMVGQASFLLYCLLSEVAMNIDPRAETTVCLSEKLVQLAVTPTQKQIAFHQLGCIRLLRKEYNEAEHPFEIAFSAGHIYSIAGLARIAGMRGQKALAYEKLSSVIASNLPLGWMYLERSLYSEGDRKLADLDKATELDPTLTYPYMYRAASLMRKKDAKLALEEINRLLGFKLALECLELRICLYLALEDYKSAICDIHAILTLSPEYRMLEGRVAASKIGTLLGAHVEQWNTAECWLQLYERWSSVDDIGSLSVIYRMLESDAAKGVLYFRQSLLLLRLNCPEAAMRSLQSARHHAATEHERLVYEGWLLYDTGHCEEALQKAEESISIQRSFEAFFLKAYILADSGVDPSYSATVISLLEDALKCPSDRLRKGQALNNLGGVYVDCGKLDLAADCYTSALKIRHTRAHQGLARVHFLRNNRDAAYEEMTKLIEKANNNASAYEKRSEYCEREQTMTDLQTVTQLDPLRVYPYRYRAAVLMDSHKENDAIAELSRVITFKADLHLLHLRAAFHEHIGDVPSALRDCRAALSLDPNHQEMLELQKRVNSQEP

SEQ ID NO: 20149 - DNA, 2210 bp, Panicum virgatum
  misc_feature: Ceres CLONE 1810289
  misc_feature: Encodes the peptide sequence at SEQ ID NO. 20150
gggctgtaccctcccctcctgcttttccacccgttttccctcggtgcgccgccgcggcctcccagcagacagcgccgccgccatgccgctccacctgctctcgtctcccgccgccgccgccaagctcgtcgcgggcttgcgcgcggtccctctccgccgctgccacagcttcgccccggctccccaccacccggtacacccacgccttccttcctttgggattccttaactctgtagtaaacttgctgcttgatttcttgcaggaccgcgcgtccctggcgacttccttgtcagcggccgcggcggcgcggtctgctgggccggtcgtggcagcggcgcagaccaagcagagcgtgtcaggaaagaaacaagtgttgatatcattgtcagacaaaacggacttgacttaccttggcaacggtcttcagggtctggggtactctattgtctccactggtggaacagcatccagcctggaagcagcaggagtcaatgtaacaaaagttgaagaaatcacacattttcctgaaatgcttgatggaagagtgaaaacattgcacccaagtatacatggtggcattcttgcccggagagaccaggaacatcatttgaaggcactaaaggatcatggcattgggacatttgatgtggttgtggtgaatttgtatcctttctatgacaaagtcacctctggtaccatttcttttgaggatggcattgaaaatattgatattggtgggcctacaatgatcagagctgcagccaagaaccataaggatgtccttattgtagtggatcataacgattacccagctttactggagtatcttaaaggaaatcaagaggaccagcagttccacaggatgttggcatggaaagccttccagcatgttgcctcttatgatgctgctgtctcagaatggttgtggaagcaatccaacaaaggggagatgtttcccccaagttttactgtgccactggagctgaagtctacacttcggtatggcgaaaatcctcaccagaatgctgcattttatgctgacaagagcctttctctagttggtgctggtggtatcgcaactgctattcaacaccatggaaaggaaatgtcttacaacaactacttggacgcggatgctgcatggaactgtgtatctgagtttgatagtcctacttgtgttgtggtgaagcacacaaatccatgtggcgttgcttcacgacaggacattcttgaagcttacaggttagctgtaaagggggatcctgtcagtgcatttggtgggatagttgcattcaacacgataattgacgaggatcttgcgaaggaaattcgtgagttcaggagtcctacagatggccagacacggatgttctatgagatagtggttgcgcctggctacacagagaagggtcttgagattctccaaggcaagtcaaagacgctgaggatactcgaggcaaagagaagtggaaaagggatgctttcactgaggcaggtcaatggtgggtggttggcccaagagtctgatgatctaacccctgaagatatcacctttaccacaggatctgagagggctccacaggagaatgaggtggcggatgccaaatttgcctggctttgcgcgaagcatgtcaagagcaatgccattgtgatagccaagaacaactgcatgctgggaatgggcagtggccagccaaacagacgagagagccttagaatcgccttcaggaaggcaggagaagaggccaagggggctgcattggcaagtgacgccttcttcccctttgcctggaatgacgccgttgaggaggcgtgccagaacggcatcggaatcatcgctcaaccaggaggcagtatcagggatgaggacgccgtcgcgtgctgcaacaagtacggggtgtctctcgtcttcaccggcgttaggcacttcaggcattagcacggtggcatgtctatgactgctcgtcttagcctaagaagaaatgaataagagtgcaagcttcgaattcagaggctgcagcctgcgggttgggtgtaacggtactacgaagtttgcattcaggctgtgacggtatttctgatgagagggcttttgttcggtgagctgaataagctgatgtatcgttggtgccaattctcccaacctaaaactcttgcaagttgcaatagcagcatctaattactgaatagtactcgtgtagaaatttcc

SEQ ID NO: 20150 - protein, 645 aa, Panicum virgatum
  misc_feature: Ceres CLONE 1810289
  misc_feature (253)..(578): Pfam Name: AICARFT_IMPCHas Pfam Description: AICARFT/IMPCHase bienzyme
  misc_feature (133)..(248): Pfam Name: MGS Pfam Description: MGS-like domain
AVPSPPAFPPVFPRCAAAASQQTAPPPCRSTCSRLPPPPPSSSRACARSLSAAATASPRLPTTRYTHAFLPLGFLNSVVNLLLDFLQDRASLATSLSAAAAARSAGPVVAAAQTKQSVSGKKQVLISLSDKTDLTYLGNGLQGLGYSIVSTGGTASSLEAAGVNVTKVEEITHFPEMLDGRVKTLHPSIHGGILARRDQEHHLKALKDHGIGTFDVVVVNLYPFYDKVTSGTISFEDGIENIDIGGPTMIRAAAKNHKDVLIVVDHNDYPALLEYLKGNQEDQQFHRMLAWKAFQHVASYDAAVSEWLWKQSNKGEMFPPSFTVPLELKSTLRYGENPHQNAAFYADKSLSLVGAGGIATAIQHHGKEMSYNNYLDADAAWNCVSEFDSPTCVVVKHTNPCGVASRQDILEAYRLAVKGDPVSAFGGIVAFNTIIDEDLAKEIREFRSPTDGQTRMFYEIVVAPGYTEKGLEILQGKSKTLRILEAKRSGKGMLSLRQVNGGWLAQESDDLTPEDITFTTGSERAPQENEVADAKFAWLCAKHVKSNAIVIAKNNCMLGMGSGQPNRRESLRIAFRKAGEEAKGAALASDAFFPFAWNDAVEEACQNGIGIIAQPGGSIRDEDAVACCNKYGVSLVFTGVRHFRH

SEQ ID NO: 20151 - DNA, 667 bp, Panicum virgatum
  misc_feature: Ceres CLONE 1810301
  misc_feature: Encodes the peptide sequence at SEQ ID NO. 20152
atctattatcagatccgtaattatgacatgtgcattgcaaaaaatgaggaggctcttgccatagatccacactttgctgaatgctatggcaatatggcgaatgcttggaaggagaaaggcgatattgatctcgcaattcgttactatcttactgccattcagctgcgaccaaacttctgtgatgcgtggtcaaatcttgctagtgcgtatacacggaaggggagattgaatgaagcagctcaatgctgtagacaagcacttgccataaaccctagattggttgatgcacacagcaatcttgggaatctgatgaaagctcaaggtttcattcaagatgcatatagttgttacatcgaggcattacgcatagatcctcactttgcaatcgcatggtcaaatcttgctggtctgtttatggaggcaggagacctagacaaagctttaatgtattacaaggaagctgttaaacttaagccatcctttgcagatgcatatcttaaccaagggaatgtttataaggctttgggaatgcctcaagatgccattgtgtgttatcaacgtgcactgcaggcacggcctgactatgctatggcttatggtaatcttgctactatttactatgagcaaggccagcttgatatggcaattcgttgttacaatcaagcta

SEQ ID NO: 20152 - protein, 222 aa, Panicum virgatum
  misc_feature: Ceres CLONE 1810301
  misc_feature (26)..(59): Pfam Name: TPR_1 Pfam Description: Tetratricopeptide repeat
  misc_feature (60)..(93): Pfam Name: TPR_1 Pfam Description: Tetratricopeptide repeat
  misc_feature (94)..(127): Pfam Name: TPR_1 Pfam Description: Tetratricopeptide repeat
  misc_feature (128)..(161): Pfam Name: TPR_1 Pfam Description: Tetratricopeptide repeat
  misc_feature (162)..(195): Pfam Name: TPR_1 Pfam Description: Tetratricopeptide repeat
IYYQIRNYDMCIAKNEEALAIDPHFAECYGNMANAWKEKGDIDLAIRYYLTAIQLRPNFCDAWSNLASAYTRKGRLNEAAQCCRQALAINPRLVDAHSNLGNLMKAQGFIQDAYSCYIEALRIDPHFAIAWSNLAGLFMEAGDLDKALMYYKEAVKLKPSFADAYLNQGNVYKALGMPQDAIVCYQRALQARPDYAMAYGNLATIYYEQGQLDMAIRCYNQA

SEQ ID NO: 20153 - DNA, 1258 bp, Panicum virgatum
  misc_feature: Ceres CLONE 1810309
  misc_feature: Encodes the peptide sequence at SEQ ID NO. 20154
aaaagcggatgtgccccaaagatccccttcccttctctctcccctccactgcctccgcctgccccgagctgacttttgctccgcccacccccctctctctctaccacgcttgtttgccttcgctttgcccccccacagcctcatgttcttcctctccttcgtgtagcttccatcccactcccaccgccgccctcccgctcgagccgaatccccccactagcgctccccaattggggcccaggccccctcccgccggcttaaaaatccggttttggggaggcttgctgccgcagatcggggagacgctcccggttcattcggtcggccggtgtccccgtcccccgtcgttcctcggtgctgtcttcttcccggggcggtgcttggatgagctgcttcgtgtgcttcggatcggcccacgatggggaggccaagaagcccgccgccgccgacgccaaggacccgcgcaaggacgggccgccggatcgcggggtggccagggtcggatcagataaatctagatcacagggtggatcagactctaagaaggacataattatccatagagacgggaacagtcaaaatattgcagcacagactttcacttttcgcgaacttgctgctgccacgaagaacttcaggcaagattgcttattgggggagggaggttttggccgtgtatataaaggacgtttggagaatgggcaggctgttgctgtgaagcaacttgatcgtaatggtctccaaggaaatagggaatttctggttgaggttctcatgctcagtctcttacatcacactaacctggtcaatctaattggctactgtgctgacggtgaccaacgccttcttgtttacgagtttatgccattggggtcactagaagatcatctgcatgatctgccaccagataaagaagctcttgattggaacacacggatgaagatagccgcaggtgctgccaagggcttagagtaccttcacgacaaggcaagccctcctgttatttacagggatttcaagtcgtcaaacattcttcttggagaaggatttcacccaaagctatcggactttggccttgcaaaactaggtccagttggtgacaagacacatgtttcaacacgtgtgatgggtacatatggctactgtgccccagaatatgcaatgactgggcagctcacagttaagtccgatgtttatagctttggtgttgtgttccttgaactcatcacagggcgccaagcaattgaccataccaggc

SEQ ID NO: 20154 - protein, 291 aa, Panicum virgatum
  misc_feature: Ceres CLONE 1810309
  misc_feature (84)..(290): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50776
  misc_feature: Useful for making plants with altered carbohydrate content
MSCFVCFGSAHDGEAKKPAAADAKDPRKDGPPDRGVARVGSDKSRSQGGSDSKKDIIIHRDGNSQNIAAQTFTFRELAAATKNFRQDCLLGEGGFGRVYKGRLENGQAVAVKQLDRNGLQGNREFLVEVLMLSLLHHTNLVNLIGYCADGDQRLLVYEFMPLGSLEDHLHDLPPDKEALDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRQAIDHTR

SEQ ID NO: 20155 - DNA, 407 bp, Panicum virgatum
  misc_feature: Ceres CLONE 1810309-R
agttgagcactcatcagcaccaaaagggatcccatctcggtcccggatacattgtcatcgatcccattgtctgtgaataaggcttttcttgctctttaacgcatcctcctggcgtccattccttgcgaatgtgatcgtgttacatgcttcggtggagctgaggagcctgtaggattcagttggggaaggtagatttgagaagagggggtgcacagagtcgcattggacaagtgcgttttttacggttatatcatatatatgcacgcatgcttaatttcgtctatgttgtgaatgtataactcggtgtcaggtttcgctgcctgagaggccgtgaagcttgtttgtgaaatcctgtttggatatttaggacaggctacggtgtttagtacagctgttgttttttttag

SEQ ID NO: 20156 - DNA, 691 bp, Panicum virgatum
  misc_feature: Ceres CLONE 1810312
  misc_feature: Encodes the peptide sequence at SEQ ID NO. 20157
acttctacctcgacatgttgagataatagaaaaaattgatgaggagttgataaacaacatagtctcgaagtatggaactgcagatactgcgctattaaaaaagaagctgaaagaaatgaggattctggataatgttgaccttccagcttccattgcccaactatttgttaaacctaaagcaaaaaagaaatctcctactaaatcaaagaagaaattacttgttaaatctttggagactattgctgaagttgaggagaaaaccaagttggaagaagaggaggcagaagttatgtctgagatagaggaggaaaagattgaatctgaagaagttgaagcagaagaatctgaagaagttgaagcagaagaagaagattctgaggacgggttagatccatttgtaaaatctgatcctaagttaccaagaattgtccgaatggcaaacctctgtgtcgtcggtggacattcagtaaatggtgtagccgaaattcatagtgaaattgtgaaacaggatgtgttcaacagcttttatgagatgtggccaactaaattccagaataaaacaaatggagtgactcccaggcgttggatccgattctgtaatcctgaattaagtacaataatttcgaagtggattgggtctgatgactgggtgcttaacactgacaaacttgcagaactgaagaagtttgcc

SEQ ID NO: 20157 - protein, 229 aa, Panicum virgatum
  misc_feature: Ceres CLONE 1810312
  misc_feature (30)..(229): Pfam Name: Phosphorylase Pfam Description: Carbohydrate phosphorylase
  misc_feature: SWISSPROT Homolog: EC 2.4.1.1 Phosphorylase
LLPRHVEIIEKIDEELINNIVSKYGTADTALLKKKLKEMRILDNVDLPASIAQLFVKPKAKKKSPTKSKKKLLVKSLETIAEVEEKTKLEEEEAEVMSEIEEEKIESEEVEAEESEEVEAEEEDSEDGLDPFVKSDPKLPRIVRMANLCVVGGHSVNGVAEIHSEIVKQDVFNSFYEMWPTKFQNKTNGVTPRRWIRFCNPELSTIISKWIGSDDWVLNTDKLAELKKF

SEQ ID NO: 20158 - DNA, 2285 bp, Panicum virgatum
  misc_feature: Ceres CLONE 1810315
  misc_feature: Encodes the peptide sequence at SEQ ID NO. 20159
ggccacacgcccacaccccacatggtatggccacccgcttcctcctctacgcgctgctcctcctccttgccaccgccgccgtccaatggcctcacccaagcgattgaaggaggagctgtcagagaggaaccgagagaatgagatactcaagtcatggaatggggacccgtgctccctgtctacctgggaaggattctcttgcgaatccaatgatggcgcccgtgtcgtcgtcaagctgaacttttcttcgaagaatttgcaaggccagattccagcagcgattgggaacttaaccgacctaactgaaattgatctgcaggtcaataatttcactggatctattccggcatctttttctgctctcaaacacctgcgcaatctgtaagcatacattcgctttgttcgcttggctgtggctggtggctgatgctgatttgttatgagagaacaatactgctgactggctggtagctggtggctggtagctggtgatttagtatgagagaacagtactactggctggttggctgacaagccaaacaaacagaacgattatctgtttctctatcttcctccttataacacaaaggcttcaataaaactcatgtgtaattctaaaattttgccatctgatcttgtatgcttctcacataacatggatattttgtgtgaatgacgacctaaaaaatccgatcaaacaaatgtcatctaacctaggtcagtgaagtgcaaccccttcctaaacaaccagctacctgatggtttatcaactagggtggatttcagacatggagcctgtgctgctgaagagtacgaaagcccacctggagttgccagtcatagagtaattgttatcggtggtgttgcatgtggatctttggcatgcacttttgctcttggatttctatttgtttgtttcaacaaacgtgaacggcgttctccagaaaaagactgctcgtctacaaatcccatttttcaagaatgtggcatccataacactgcaaaccctgcagtgcaacagttatccctcaaatctatccagactgcaacaggcaacttcaaaacattgataggagagggtgggtttggagcagtttatcgaggtacattaccgcatggacaagaagttgcagtaaaagtccgatcaagctcatcaatacagggaacacgtgagtttaacagtgagttaggacttctgtctgctgtatggcatgagaatttggtcccacttattggctactgctctgaaaaggatcaacagatattggtatatccattcatgtccaatggctcactacaggatcgcctctatggtgaggcatccaaaaggaaagttcttgattggcctaccaggctatctgtttgtattggtgcagcaagagggctggtatatctgcacaattttgcagggcgttgtatcatacacagagatattaaatcaagcaacatacttctggatcacagcatgtgtggcaaggtagccgatttcgggttttctaagtatgaacctcaggaaggtgacagcaatccatcaatggaagtgagaggaactgctggatatttggatcctgaatactattccactcaggtgttatcgaccagaagtgatgtcttcagttttggagtagtcctgttagaaattgtgacaggaagagaacctcttgatgtcaaaaggcctcgtgatgaatggagcttagcaaaaccttacataagggagtacaagatcgaagagatggtggatcctggcataaaagggcaatactgttcagaggccatgtggagagtgcttgaggtcgcatcggtatgcactgagcccttctcaaccttccggccaagcatggaggatgttctcagggagctggaagatgcactgatcatcgagaacaacgcatccgagtacatgaggtccatcgaaagcaccgggactctggggtccaattgctatctgtccattgacaggaagacttttgcatcaggttcagcgcgaatcgacccgataaagggacatttgcaaacaatgcacagttcctaggtaactggactatggactgtgcttatgatcccacaacgggtgtcatcagggatatacccttgttcaaggcacatctgagcttggacgcagagccttgagcacctgagaagggcatggggggagttgttacccatgtctgtagcctgtagccatgtacagaacccatccagtggacagtggcgagagcacagatgagctataccagcactgggaaatgtttctgaagcccagagactgggctagttttgcctgc

SEQ ID NO: 20159 - protein, 99 aa, Panicum virgatum
  misc_feature: Ceres CLONE 1810315
  misc_feature: SWISSPROT Homolog: EC 2.7.11.1 Non-specific serine/threonine protein kinase
MASPKRLKEELSERNRENEILKSWNGDPCSLSTWEGFSCESNDGARVVVKLNFSSKNLQGQIPAAIGNLTDLTEIDLQVNNFTGSIPASFSALKHLRNL

SEQ ID NO: 20160 - DNA, 1612 bp, Panicum virgatum
  misc_feature: Ceres CLONE 1810321
  misc_feature: Encodes the peptide sequence at SEQ ID NO. 20161
gagagcgcacgcccgaaagaggaggggaggggagaagcgaacgcgtcagccaaaccctagcccagcgcgcgacggccgggagctccagcgtcggtcgccgccaccgccgccgacgccgcttcgcaacatggccgattccccgcgcaggaggtactcgaggtccccttccccttacggcagggggcacccaaaagcaaggtcaaggtcacggtctccagctcggtctcagtctaggtcacctgtgcctgatcctagatctcaggcaaggtcgagatctagaagccatgagagggaggaagaggctgttaaccgtggaaatactttatatgtgactggactctcttctagggtgactgaaagggagattaaagattatttctcgaaagaaggaagggtggttggttgccatgttgttcttgagccccatacacgtgtttcgcgtggatttgcctttgtcaccatggacaccatggaagaagctgaccgttgcatcaagtatcttaacaattctgtgatggaaggtcgaaacattacagttgaaaagaagatactgtgcaagatatgtgcagcaatcaagattctgagttcatcaatttcagctttagcaaattacagctcgatcagtggacagcccaaagagttactatgcaccacaagattcacgccaactaaatgtagcaattattcaactaaacctgagctttcaccttcaactaatcaacgggcaatgccaactcattagtcaagcatgtgcggtgccatgtgcatagcaacgttggatgtctgctagttggaatttgggctcttcgttacttatttcctcccttggtccgttattgcaggtcgtatatccattgattgtgagagaaacttgtaattaagtacatgatccaagaatgatacttttatccttattattgcttgtaatctgacaagaattgtctttctgttgtttcagtcacgccgtggtcgcccaaggacaccaactcccggaagctatcttggtcaccggtatgagcgtagagaccgtgggagataccgccgtggctatggtggtggtcgtgatgagtattacggcaacggcggcggcggctatggctaccgcaggtctccacctcccatgtattcctacagggagagtcgggactaccctccgtatagggatactcgagactaccctccctacagggactactccccccagagggacccccgagactactatgagagcaggggcggccgggggtattccccgccaccatatggcgggggcaggtcaagaagggatcgatcgatatcgccgtatcggatgccggagagaggctatggcggcggccgccgagctggtggtggtggctacgacaggtaaaaactggcttttgcccttccccatccccggggggtggggtaccgtattgccaagatgtatggccccatggcctggtattgttgctgcctgatggtggtggccctcccgtgactccgggtagattgttgtagctgtacttgcgtactgtttgccgtgtctctggattggaagaatttgtatggacagttttgtttgtaggtttgcaatgataacttctaaagaacgactggggacttgttgcag

SEQ ID NO: 20161 - protein, 204 aa, Panicum virgatum
  misc_feature: Ceres CLONE 1810321
  misc_feature (66)..(137): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50899
  misc_feature: Useful for making plants with altered lignin content
MADSPRRRYSRSPSPYGRGHPKARSRSRSPARSQSRSPVPDPRSQARSRSRSHEREEEAVNRGNTLYVTGLSSRVTEREIKDYFSKEGRVVGCHVVLEPHTRVSRGFAFVTMDTMEEADRCIKYLNNSVMEGRNITVEKKILCKICAAIKILSSSISALANYSSISGQPKELLCTTRFTPTKCSNYSTKPELSPSTNQRAMPTH

SEQ ID NO: 20162 - DNA, 1785 bp, Panicum virgatum
  misc_feature: Ceres CLONE 1810333
  misc_feature: Encodes the peptide sequence at SEQ ID NO. 20163
ggaaaatacagaaagtcgtcgtctcggctcaatcagtactaccagccttcctttagctttgcttccttccgccgtccgcccccgcccaccaatggctcaactccatccccttcccctccttctcctcctcttcctcttcgccgccgccggggtgtccgcgggcggcaccaaaggggcgcacgtctccgcggttgtcgcggagaagggcctggccttcgccaaggatgtgctgatcggggaggcggtgcggtcgctgaccccgctgcgcctccccggcgtggagaaggccgtgcgcgtgcccttcctcggcggcgtccgcgtcgccgcctccaacatcacgctcttccacctcgacgtcggggacaactccaccgtctaccccggagactcgggcctcgtcatcgtcgcctccggcatcactgccaacatcagtatgcactggagctattgctacgactcgtggttgttgccgatagagatctccgacagaggcaccgcctcgatcctggttcaaggaatggaagttgggataacaatggtaataaagaacagcaatgggagcttggctctgtctgttttgcattgtggttgctatgtgaaggacctagtgatatccctggatggtggtgcatcttggttttatcaagggtttataaatgcttttgaagatcatattaaagctgcagttgagaaggcaatacctgaaaatattattgaaggggctgggaaactggactcatttctgcaaggtcttcctagaactgttagtctggatgacgttgctgccttgaacatgactttcgttaatgatccgcactatggcaattcttcgattgagtttgatatcaatgggttgattacttcagcagttgctaagacaaccaataatctgcagaagcatccacacctttctttatcttgtggtggtgcatccaaaatgcttttgctttcacttgatgaagatgtatttaattcggcattagatgtttattttaaggcaggttcaatgcattgggttgttgacaaagtccctgaccaatctctgctgaacacagctagttggaaatttatcattcctcgcttatactggaattacccaaatgatgatatgctgctaaatatttcgatggcctcatccccagtgataaagattacatctgaaaaaattggtgctaccattaacgcagacttgataattgatgttgtagatggcaaagagacagttccagctgcatgcatctcagtggttgtaagtgcttcaggcatcgtggagacatcaggaaataaagtttatggtagagttggattagatgatttctcccttgcgttgaagtggagtaaaattggtaacatctatatgtctttgatccagggagtgattcgtgttttcttgaatacggtgtgcatgccctatttgaactcacggctggggaatggatttgtcctgcccgtggtccacggtttcacacttcaagacatctatattctaacttctgctgagcagttgacgctttgttccaatgtcatcttcaccaatgcaagcggcttggcgagtttagcacttttgtgatacggggaagtgcgtgcaccttcttctgtctgggctgcaaagcaagcctcgggcatttcagagttggaagtacaacacttgcacatatgtgtacattattgtacatatgatctctttatccaaattattaacattcatttgtactaattcatgaatggtgtacatatgaactcagaaacactgcagattatcgttcataatctgatccttctcag

SEQ ID NO: 20163 - protein, 492 aa, Panicum virgatum
  misc_feature: Ceres CLONE 1810333
  misc_feature (39)..(221): Pfam Name: LBP_BPI_CETP Pfam Description: LBP / BPI / CETP family, N-terminal domain
  misc_feature (246)..(480): Pfam Name: LBP_BPI_CETP_C Pfam Description: LBP / BPI / CETP family, C-terminal domain
MAQLHPLPLLLLLFLFAAAGVSAGGTKGAHVSAVVAEKGLAFAKDVLIGEAVRSLTPLRLPGVEKAVRVPFLGGVRVAASNITLFHLDVGDNSTVYPGDSGLVIVASGITANISMHWSYCYDSWLLPIEISDRGTASILVQGMEVGITMVIKNSNGSLALSVLHCGCYVKDLVISLDGGASWFYQGFINAFEDHIKAAVEKAIPENIIEGAGKLDSFLQGLPRTVSLDDVAALNMTFVNDPHYGNSSIEFDINGLITSAVAKTTNNLQKHPHLSLSCGGASKMLLLSLDEDVFNSALDVYFKAGSMHWVVDKVPDQSLLNTASWKFIIPRLYWNYPNDDMLLNISMASSPVIKITSEKIGATINADLIIDVVDGKETVPAACISVVVSASGIVETSGNKVYGRVGLDDFSLALKWSKIGNIYMSLIQGVIRVFLNTVCMPYLNSRLGNGFVLPVVHGFTLQDIYILTSAEQLTLCSNVIFTNASGLASLALL

SEQ ID NO: 20164 - DNA, 695 bp, Panicum virgatum
  misc_feature: Ceres CLONE 1810336
  misc_feature: Encodes the peptide sequence at SEQ ID NO. 20165
attcagctgagtgtgctcgatcatcaagcaatcaacaaagcctcccaattatcttttcatcagatcatcttccttcttccaagatgtcttgcagctgcggatcaagctgcaactgcggctccaactgcaagtgcagcaagatgtaccctgaccttgaggagaagagcagcggcggcgctcaggccaccatcgtcctcggcgtggccccggagaagaaggccggccagttcgaggcagcggcggagtccggcgagaccgcccacgcctgcaagtgcggtaacagctgcagctgcgacccctgcaactgctgatttcgatggggaacatcagaacacacctgcatgcatgctagctactacctactactctgcttgtgtgtgacgatgattgaacaagaataaggatgagcctgagccatcatgtctcatggatcggtttggctccggcctcatcgagcatgcatgcgtctgcccctgtgtgtgctttgctaccttcccttaccctgtgctgcttggcgtccgtcctgtgtctgtatgtgttgatcattgcaaataaaccatgcaggcatacatctctgcatgtgtctctgtaatgatcggtccagagtgatgaatatataaaactggtttgctttaaaaaaaaaaaatctctccgcaatcaaaccgcggtcgctcggacccttcgcgaaaccgcgg

SEQ ID NO: 20165 - protein, 75 aa, Panicum virgatum
  misc_feature: Ceres CLONE 1810336
  misc_feature (1)..(75): Pfam Name: Metallothio_2 Pfam Description: Metallothionein
MSCSCGSSCNCGSNCKCSKMYPDLEEKSSGGAQATIVLGVAPEKKAGQFEAAAESGETAHACKCGNSCSCDPCNC

SEQ ID NO: 20166 - DNA, 1603 bp, Panicum virgatum
  misc_feature: Ceres CLONE 1810343
  misc_feature: Encodes the peptide sequence at SEQ ID NO. 20167
ttgcgccgcgccaccaaagggagcctcccccacctccccccatcccgtaccacgcgccggtaaacttccgtctcctcccacgcctcaatctcccattcccccgaaaccctaaccgccacttggtcccttcccggagcggccgagcccctcgccatcctaggcttcgggcgggagtccgctgcgcgtgggctgcggcggagatggcctcgtcgtcggcgtcctcgaggcaccaggtcaccatcaccctcggccgcagcggtcaggttgtcaaaaggagggctatatctgatgttactaatgatgatgaaatgccattgtcggggaaaaaacgatctatgagggagaggttaggaagtaatgtgactgattctgatttttatgaaagccggcatagaaacaaaaggcaacagacagaaagtgatagctcacatggagatgatggttcagatcgccaggttggcaaggatgatctgagactgaaacttatgaggaaaggcttgttacagagaagcaatggtggcgcagaacagaatggagtggatcttcgggaaaagctttcccgaaatcagaagaatttgtcgagatacgatgcaagaggccatgcaccagaatcaagggctaggtatgatatgagagacaatcctccagagttaaggtttagatattcttcgagagaggatgtcctaggatcaaggccctctgctgttgtaagtcgagttccttctgcaagaagtgtggatgatttgttaaagatggagtcttcaagaaaaccttactcctcatgggcaactgatggtttgaggcacagatcacctgaaaggcatacaagcattcggggtgatgcgtctccaccaagaacttatgatcagattaggtctttgccatcccttagatctgttggttcctcaagacctcagagttttattacaagagatgctcatgacacatcaagagctcaaccatatcctggcaaatccaccatttctgccgatgcagtacagagagctaatggaatcacttcatctagtgcagctctgcctacagcccctgttgtgaaagaagtgccgcaaacggttactgaattgctgagttctctgggactggagaagtatcttgttctctttcaggctgaggaggtagatatggctgcattgagacaaatgggagagagcgacctcaaggacatgggggtaccaatgggcccgaggaagaagattctccttgcaataggtgagtcgaagtctcggcaaagatgagcagcatgatctgcgatttgggaactggaaacatttgtttggcaactgcaaattattggtgtaactaaagaatgccttactgcagatttttgtatatctttaatggctgtcttagttgctgatagattaagttcgtgcctttgttgacacgtgtaaagtcttatctgtcagctgttagagcagcagtcttgaaactggtggataattaccagtctagaatttggtgggggtatattagaacggctatgatcagatcacaacgccatctttcatagtacatgatagcattgaggaccgaatgatccatcatccactgcaggttcaaatctaacgttttgttgtgttcg

SEQ ID NO: 20167 - protein, 351 aa, Panicum virgatum
  misc_feature: Ceres CLONE 1810343
  misc_feature (287)..(347): Pfam Name: SAM_1 Pfam Description: SAM domain (Sterile alpha motif)
MASSSASSRHQVTITLGRSGQVVKRRAISDVTNDDEMPLSGKKRSMRERLGSNVTDSDFYESRHRNKRQQTESDSSHGDDGSDRQVGKDDLRLKLMRKGLLQRSNGGAEQNGVDLREKLSRNQKNLSRYDARGHAPESRARYDMRDNPPELRFRYSSREDVLGSRPSAVVSRVPSARSVDDLLKMESSRKPYSSWATDGLRHRSPERHTSIRGDASPPRTYDQIRSLPSLRSVGSSRPQSFITRDAHDTSRAQPYPGKSTISADAVQRANGITSSSAALPTAPVVKEVPQTVTELLSSLGLEKYLVLFQAEEVDMAALRQMGESDLKDMGVPMGPRKKILLAIGESKSRQR

SEQ ID NO: 20168 - DNA, 1593 bp, Panicum virgatum
  misc_feature: Ceres CLONE 1810363
  misc_feature: Encodes the peptide sequence at SEQ ID NO. 20169
ggtatctcttcagtcttctcgccccatctctccctctgccacaggccaccactcctccccggcctcatctcttccctgcagcgtcaccacctccactctcttgtcgcacggggctgcaacgcacggcagcggcgcgggtgaaaggcggcgtgccaggtctacagcgcaccgcggcggcacgaggcaggcctgggcctcggcggcgcgaggcgggccggggcagacacccactgacgccactcgtctcctacatcgcctccgccatccgcacgtgggcgcttgagcaccaccttgccacctcctttcgggacctcgacgccgagctcgccgtcgtcctcaacgttctccccgccttctcgcggggagcagcagcggccggtgcggcgcggcaacggcatggagcgcggatcgcggcacagtgggagcacggtggcggcgcgagcacggcgcgggggagcagcaatgctcagaggcgatgcagttgttaagatatctaaaccagaaaggcagataattaacaagattaagtcaacagaagaggaagaggttctagtgcacatcgatgatgttaatatacagaagaaggtattggaaagcctagcagatcccatgttggaggatggtccaccaaagtacttgcaggacgatatcatagatgcatgcattcacatgttaagagacaaaaacaaaaatgacatcagggctcacggaaaggtcttcattgagactacgatgatatgccaactcctacataaagccgcttgctctttctacccaataagaggaaaagaaataaaagatcacaagaaatatgggatgcagtaccttaaacatgacatgattttcctacctataaaccagaatggtaatcattggtaccttgcggttgtcaacacaaagaaacaagagattcaagtgcttgattccctgggaaagcagcttcgagaacgtgaagaactgaaatatacacttaaacaaattgagcaatgcctcaagcttgcgggcaatgacgttcaaaccagtagctggctggattacaaagttgcatcttggaaggtcagacaagtaaaagagataccagagcaaacagacatgtcgtcatgtggacttttcatgatcaagtacctcgagtactggacaggagaaaagttgaaccaagaatttacgcagtcggacatagaccacttcaggcttaaattggcatatgaactgatgagcagtccactcaacaaggctcgcaggtagaaagcttccagggagatggtttgcaaggaaaaaaaaggctggcaacgaagaggctgtctagaataggttgctcggcagcttgcactgctgaattagaataattgcagccactaaaatatgtttggtaagctccggctggcccctccgttcgcccccctgattgttatcttttgttcctggagattcgtagccaactgtagtcgaagctccatgtttacctgctctgcaccatctcttaggggtgttgttgttttcgcaagattgcaacttgttgtatccgtgtcttcggttattcgatttgtaatgcgcttttccttcaaaaaaaatttgtaatgcactttatcttcg

SEQ ID NO: 20169 - protein, 282 aa, Panicum virgatum
  misc_feature: Ceres CLONE 1810363
  misc_feature (79)..(277): Pfam Name: Peptidase_C48 Pfam Description: Ulp1 protease family, C-terminal catalytic domain
MERGSRHSGSTVAARARRGGAAMLRGDAVVKISKPERQIINKIKSTEEEEVLVHIDDVNIQKKVLESLADPMLEDGPPKYLQDDIIDACIHMLRDKNKNDIRAHGKVFIETTMICQLLHKAACSFYPIRGKEIKDHKKYGMQYLKHDMIFLPINQNGNHWYLAVVNTKKQEIQVLDSLGKQLREREELKYTLKQIEQCLKLAGNDVQTSSWLDYKVASWKVRQVKEIPEQTDMSSCGLFMIKYLEYWTGEKLNQEFTQSDIDHFRLKLAYELMSSPLNKARR

SEQ ID NO: 20170 - DNA, 1480 bp, Panicum virgatum
  misc_feature: Ceres CLONE 1810371
  misc_feature: Encodes the peptide sequence at SEQ ID NO. 20171
aaaaacccaaaaaaaaacaggggagagacgactaaaccgggcccggtaaggaaaggacagcaggtgcggagcgccggccggccggcgggcgcatttcggtgccttggatcggaagcgagcgagcgcagcggagggcggatgggctcctcgtccacccaggcggcggcggcggcgccgagcaggcgcagggtggcgctctacctcacgctcctcaccctgcagtacggcgcccagcccctcatatccaagcgcttcgtccgccaagatactatagtgacctcactagttcttgccactgaagcagcaaaggttatttgcacaatcgttctattgattgcagagggtagtctgaagaaacagttcagaaactggactctctctggatcactgaccgcgtctggactgcctgctgccatatatgcattgcagaatagtctgttgcaaatatcatacaagaatttggattcattgaccttttcaatccttaaccagaccaagcttttatggacggcatttttcacttatcttattttggggcaaaagcaatcatcaaagcaaattttagcattaaccatcttaattagtgctgctgttcttctaagtgttggggagagtagcagcaaaggttcaaagggtggtagctctgattatgtcttgctctatgggatcattccggttacagtcgcatctatgctgtctgggttggcctcttcactctgtcagtgggcatcccagattaaaaagcatacgtcttatatgatgactatagagatgtcatttattggaagcatgtgcatgttagcaagtacctatcgatcaccagatggagaagccatcaggaaatatggttttttccatgaatggactttatggaccatggtaccagtcttaatgaatgccgtgggtggaattcttgttggtcttgtcacaacttacgcgggcggtgttagaaagggttttgttatagtatcagctctccttgtaactgcactactacaatttatatttgatgggaagccaccatcacactactgcctgatggcattaccactggtcatgacaagcatattcatttaccagaagtatccatatgctgataggaagaagaaagattgataagcatacttgttgagaagggaaagtttccatcagtgaaacgtaacgctaacctcatatttcattcacaaaagtctggaatttgcactgtctgagtgtaccaatgtgacgcctgaagagtgaagagttttcttttcatggagctatgtatcattgatctactgatttatatagaattaaactagtagggcagtagcttgaaatcaatttcagcaggcagttgatatttagcttgcatggaacttgatgaattgtttacgtgtacatctatctatattttcacagcttgaggaacctactctatctttcacatacttttatttagattacttgaacatgaagggagaagtgtatcttttgtatt

SEQ ID NO: 20171 - protein, 325 aa, Panicum virgatum
  misc_feature: Ceres CLONE 1810371
  misc_feature (73)..(306): Pfam Name: Nuc_sug_transp Pfam Description: Nucleotide-sugar transporter
MGSSSTQAAAAAPSRRRVALYLTLLTLQYGAQPLISKRFVRQDTIVTSLVLATEAAKVICTIVLLIAEGSLKKQFRNWTLSGSLTASGLPAAIYALQNSLLQISYKNLDSLTFSILNQTKLLWTAFFTYLILGQKQSSKQILALTILISAAVLLSVGESSSKGSKGGSSDYVLLYGIIPVTVASMLSGLASSLCQWASQIKKHTSYMMTIEMSFIGSMCMLASTYRSPDGEAIRKYGFFHEWTLWTMVPVLMNAVGGILVGLVTTYAGGVRKGFVIVSALLVTALLQFIFDGKPPSHYCLMALPLVMTSIFIYQKYPYADRKKKD

SEQ ID NO: 20172 - DNA, 2680 bp, Panicum virgatum
  misc_feature: Ceres CLONE 1810374
  misc_feature: Encodes the peptide sequence at SEQ ID NO. 20173
acagagaagcggagagagagagagagaggcattaagctttgccgacaccacactgcatccctgctcccacagcagggcgccccgggcaagcatggcatcgcgcgcggctgcccagcgcgtgagctggcgctgatggataaagcagggcattggtgccatggcgatcgccgtggtcgtgtgatatcgtagaggagcaagcactgcggtcggaaagggatttttttcccctgccgagggagaagggggcggagaagagggagagcagggcagggggagaggtcgggaatggcggcgccgggcgccgcttcggccggcgtcctcttcgtcctcgcgcttctggcggcggccgcgcgagccgacaccgacgccggcgacgtcgcggccctggggatcctctacagctcctggaacagcccggcgcagctcgccggctggtccgccgccggcggcgacccctgcggcgccgcgtggacgggcgtctcctgctccggcaccgccgtcacctcactcaagctttctggtatggagctgaatggtactcttggttacgaactgtccagtctacaggcattgaaaacaatggatttaagtgacaacttcttgcatgatgcaattccttaccagttgccatcaaaccttacctatctgaatttggcgaaaaataacttgtctggtaatctcccgtactccatatccaccttggtttcacttgaatacctcaatctcagccacaactcgttatttcaggaaattggcgaactatttggaagcctcaattcactttcagaactagacatatctttcaacaacctgacgggcaatcttccaatttcaatgggatctctgtcaaaagtttctagcctttacatgcaaaataatcaactatcaggcacagttgatgtcctccgcaacctaagccttgcgacactaaatattgcaaacaacaatttcagcggcatgataccacaagaattcagctcaattccaaatttgatagttggaggaaactcatttgtcaatatgcctgcctccccgctgccagctctcacaccaccaaagaatccacgggatcagccaaaccatcctcaaggacctgttagtgctccaactgtccttgacactcctattgatcaagatgacaagaagctgcaaacaggtcctcttgtagggatagctgttggctcaatagctgttgcctcctgcgtacttttcacgttggtattctgcctttacaaggcccggaaaagaaatgacgatgggagtagtgaaccaaaagatattgtaggttctcttgcagtaaatatagatagagcatctaatagggaaatcccgatcccgaacaacaaccatgaaaatgttgtggtagcaacttcagatctccaaaaaatgactcctgagagagtttatggtgcaaatggttctactgcaaaaaaggcaaaggttcctgtgacggcaacttcatatacggttgctgctctccaagtcgctacgaatagcttctgtcaagactccctcctaggcgagggctcgcttggtcgtgtttacaaggccgattttcccaacgggaaggtacttgctgtcaagaagatagacagtgcctcactgtctctgtatgaagaagaaaatttcctcgaggccatctccaacatttcacggctcaggcatccaaacgtcgtgcctctcacaggctactgcattgaacacgggcaaaggctccttgtgtacgagtacattggaaatggcacgcttcatgacatactgcacttctctgacggcatgagcaagaaactcacatggaacacccgcgtgaggatagcactgggcgccgcccgcgctctagagtacctgcacgaggtgtgcgtgccccctgtcgtgcacaggagcttcaaatcgtctaacatcctgctcgatgaggagtacagcccgcacctgtctgactgcgggcttgctgctctctcaccaaatcctgagagggaggtttcagctgagatggttggctcgttcgggtacagcgcccccgagttcgccatgtcaggaacgtacaccaccaagagcgacgtgtacagcttcggagtggtgatgctggagctgctgaccggccgcaagccgctggatagctccagggagaggtccgagcagtcccttgtccggtgggcgaccccgcagctccacgacatcgacctgctcgccaggatggtggatccggccatggacgggctctaccctgcgaaatcgctctcccgcttcgccgacatcatcgcgatctgcgtccagtcggagccggagttccggccgcccatgtccgaggtggtacagcaactggtgcggctgatgcagcgggccagcatcatccggcggcaatccgacgatctcgggtactcgtacagggtgcccgatcgcgaggggggcgcaggcgacgccttctgaagactgaaggactgagatgagaacaaagaatcgggacaaagaaaggcatcgagtgctgatccttcaggtttttattttttgtttgtgtcctgtacttgtgctctgttaatgtgtttgtacagtgtttgcgatcaggtcgattgggagtgggacgtgcatgtatagtgtgcgttcttgcaagtggtgattacagtgtgtataaccatacgctattttacacattaggtgccacagtttattctacaccaatatc

SEQ ID NO: 20173 - protein, 713 aa, Panicum virgatum
  misc_feature: Ceres CLONE 1810374
  misc_feature (405)..(679): Pfam Name: Pkinase Pfam Description: Protein kinase domain
  misc_feature (27)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAPGAASAGVLFVLALLAAAARADTDAGDVAALGILYSSWNSPAQLAGWSAAGGDPCGAAWTGVSCSGTAVTSLKLSGMELNGTLGYELSSLQALKTMDLSDNFLHDAIPYQLPSNLTYLNLAKNNLSGNLPYSISTLVSLEYLNLSHNSLFQEIGELFGSLNSLSELDISFNNLTGNLPISMGSLSKVSSLYMQNNQLSGTVDVLRNLSLATLNIANNNFSGMIPQEFSSIPNLIVGGNSFVNMPASPLPALTPPKNPRDQPNHPQGPVSAPTVLDTPIDQDDKKLQTGPLVGIAVGSIAVASCVLFTLVFCLYKARKRNDDGSSEPKDIVGSLAVNIDRASNREIPIPNNNHENVVVATSDLQKMTPERVYGANGSTAKKAKVPVTATSYTVAALQVATNSFCQDSLLGEGSLGRVYKADFPNGKVLAVKKIDSASLSLYEEENFLEAISNISRLRHPNVVPLTGYCIEHGQRLLVYEYIGNGTLHDILHFSDGMSKKLTWNTRVRIALGAARALEYLHEVCVPPVVHRSFKSSNILLDEEYSPHLSDCGLAALSPNPEREVSAEMVGSFGYSAPEFAMSGTYTTKSDVYSFGVVMLELLTGRKPLDSSRERSEQSLVRWATPQLHDIDLLARMVDPAMDGLYPAKSLSRFADIIAICVQSEPEFRPPMSEVVQQLVRLMQRASIIRRQSDDLGYSYRVPDREGGAGDAF

SEQ ID NO: 20174 - DNA, 729 bp, Panicum virgatum
  misc_feature: Ceres CLONE 1810391
  misc_feature: Encodes the peptide sequence at SEQ ID NO. 20175
ttgctcgtcaggcgaagacaaaagttgatgaactcgaaaaagataacttatcaaataggcaaaaacctggatgcggaaaggggtctgccgtggaccggtcaagagaacagactactggagcagttaaaaagaaattgaaggagcggatggatgattttcaggctttacgagaagcaatcaggcaagaataccgtgaggttgttgaaagaagggtttttactgtgaccggtaatcgtcccaatgaagagacaatcgatgacctgatagagactggaaaaagtgaacaaatcttcaaagacgcaatccaacagcagggaagaggccagatactggacaccgttgctgaaatacaggagcgacatgatgctgtgagggatctagagaggaagctacttgagttgcaacagatattcatggacatggcagttcttgttgaggctcaaggagacatgatcaacaacatcgagacacatgtttcgaacgctaccaatcacatacagcaaggcgttagcgctctccagaatgccaagaaactgcagaagaattcgagaaagtggatgtgctatgccatcatcatactgctggtgatagtggtgatcgttgttgtgggaatcatccagccatggaagaaggggtgatcgttgctgtgggagtcatccagccatggaagaagggcgcttagcgtgtcttcaaacagggggaccgcaggatatatatacattgtgtttt

SEQ ID NO: 20175 - protein, 211 aa, Panicum virgatum
  misc_feature: Ceres CLONE 1810391
  misc_feature (118)..(180): Pfam Name: SNARE Pfam Description: SNARE domain
ARQAKTKVDELEKDNLSNRQKPGCGKGSAVDRSREQTTGAVKKKLKERMDDFQALREAIRQEYREVVERRVFTVTGNRPNEETIDDLIETGKSEQIFKDAIQQQGRGQILDTVAEIQERHDAVRDLERKLLELQQIFMDMAVLVEAQGDMINNIETHVSNATNHIQQGVSALQNAKKLQKNSRKWMCYAIIILLVIVVIVVVGIIQPWKKG

SEQ ID NO: 20176 - DNA, 734 bp, Panicum virgatum
  misc_feature: Ceres CLONE 1810394
  misc_feature: Encodes the peptide sequence at SEQ ID NO. 20177
aatccggcggaccaccggctcaacaagggattcgctttcgtccgcttcgccgccgcctggcaggcgcggtgggctgccgatgacctccgcgaggctacgatcaagggaaaagcatgtggaatatgcaagaacagtgaaaatgagacccttcatgttcggaatatatgctttgattggtcaaaagatgatttagctgagaaattgaaaccttttgagttggagaatctggatagaattaacctaatcgagcacccagaaagaaaggggaaaaacagaggctacgcatttcttgacttcagaacacatgtggatgctgtggctgcttttctgaaactacaggaaaaagatctataccttggtactgattttagagcacacatatcattttcaaacactctttcacaagatgatgagatcatggaaaaggtgaaatctgttttcttggatggcttaccacctcactgggatgaagacaaagtgagagaaatgttcggaaaatttggtgaaattgataacatacagcttgctagaaacatgttcactgcaaaaaggaaagattttggtttcatcggcttcacgacaaggaagtcagctttggattgcattaagatggtcaataaagaaggtgttggtgaaggcagtggaaaggttctgataaaagctagtttacaagggccaagacatgcttttcagaagcattcctggcagggctctagttccatgttaggtgtcag

SEQ ID NO: 20177 - protein, 244 aa, Panicum virgatum
  misc_feature: Ceres CLONE 1810394
  misc_feature (146)..(217): Pfam Name: RRM_1 Pfam Description: RNA recognition motif. (a.k.a. RRM, RBD, or RNP domain)
NPADHRLNKGFAFVRFAAAWQARWAADDLREATIKGKACGICKNSENETLHVRNICFDWSKDDLAEKLKPFELENLDRINLIEHPERKGKNRGYAFLDFRTHVDAVAAFLKLQEKDLYLGTDFRAHISFSNTLSQDDEIMEKVKSVFLDGLPPHWDEDKVREMFGKFGEIDNIQLARNMFTAKRKDFGFIGFTTRKSALDCIKMVNKEGVGEGSGKVLIKASLQGPRHAFQKHSWQGSSSMLGV

SEQ ID NO: 20178 - DNA, 1314 bp, Panicum virgatum
  misc_feature: Ceres CLONE 1810404
  misc_feature: Encodes the peptide sequence at SEQ ID NO. 20179
agcacagggcgaccgaaatttcccgtctttctctcgttttttggggatttcatttccgctcgtcgttcccatcgatcagtggccgcctttgctattagcttccccccatttggttccgtgggaagccaaagactccttttttagggtcggattcgtggccgagctcttgatttgctcggcctgttcctgtttctgggagcggaggggggatctttggaccagggatcgagcaagaaagcagccatgagcggcgggagcgggagtttcctcgagatccagccctcggagctcgcattcccctttgaattaatgaagcagagctcatgctccatgcaactcaccaataagactgaccattatgttgcgttcaaggtcaaaacaacgaacccaaagcagtactgtgtacgccctaatattggtgttgtattacctgggtcaacttgtgatgttacagtgacaatgcaaacgcaggaggagtcacctccagacatgcagtgcaaggacaagttcctagttcaaagtgttgcagcggagaatggtgcaacagctcaagacattaatgcggcaatggtaattactctgaaactcttgattggttttatttccaccagtttgctgcatgcatacaatttctggctcgtcctgtcatatgtccatgtgctttcatgacaacagttcaataaggagccagggaaggttgtggatgaattcaaactgcgcgtggtctatgtgccaacaactacacccagtccaatccctgaagattctgaactagggagttctgctcattcgtctgcacaagaaaatggaatcagtcattccgcaatgccacaatctggatctagatcaaacgctgaaacaacaaaggagaagtcctctgaggtagctttttcctgacctttatggttgcctctttatttggcaatcagtgctattgaattaaaaagcttacaacttgcaaaagcatctggttatttgcacgttaacaatgtttgagttatgtgacaccattcttctgtcttgccctgactaaccagttaatacatacaattcatggtttaattagttagaaagattgcagatgaagtcattggcagaattggtctgacatccatgatgaatctctctagttgatgattctttgaaatttggaagcatatattgtcttgcaaattgtaaatgatcatgaattagcctgatgggcagcaatattcctgagtcctgacactatatgaaacctctttgtttcattaggtagccaaagatactagagcttgttctgatgtctgggactataaacattgttatacctgc

SEQ ID NO: 20179 - protein, 141 aa, Panicum virgatum
  misc_feature: Ceres CLONE 1810404
  misc_feature (8)..(115): Pfam Name: Motile_Sperm Pfam Description: MSP (Major sperm protein) domain
MSGGSGSFLEIQPSELAFPFELMKQSSCSMQLTNKTDHYVAFKVKTTNPKQYCVRPNIGVVLPGSTCDVTVTMQTQEESPPDMQCKDKFLVQSVAAENGATAQDINAAMVITLKLLIGFISTSLLHAYNFWLVLSYVHVLS

SEQ ID NO: 20180 - DNA, 656 bp, Panicum virgatum
  misc_feature: Ceres CLONE 1810404-R
atgagtagtaacaagtgaaagatgtagttggttgatctcaacagtctttgctgcttcatgtctggtctgttgagtccagacagcagaaagcactggcttgtgaagtttggttgttagttcgtttctaagttgtaacatactttatgaagttttgtgtttcaaattttcaatgaattcacactggctggtgactgctaggcaacttctgtgatctccaagctaactgaggagaaaatgtctgctattcagcaaaaccagaagttgcggcaagagctggaactgctacggaaagagagcagcaagagcagcggcggtttctccatcaccttcctggtcgttgtgggccttctgggcatcatcgttggctacatcctcaagaggacatagtagaatccagtctccagcagtgctatactcccatgagaggatacccacacgcggcatgcgtatgcataccgccccttgtgttttcgctcctaaacggagcgcctgttctaacgtgtaacaacagccctcctagaagttttggtttgtgtacattatggtggttcataccttttttttctgagattttttggatttggtagacttgttttaagcctaactgccgcgactttgtcacctttaccataacctttattcttttctgatgatcc

SEQ ID NO: 20181 - DNA, 1568 bp, Panicum virgatum
  misc_feature: Ceres CLONE 1810406
  misc_feature: Encodes the peptide sequence at SEQ ID NO. 20182
acctccctccctcccccaccctcctcttctcgaagtcaaaccgctcctccccacttccttgtaaccttcgcaaggcgaccagcaggcccccagcttttccgtcttctacttctttccccgctatcgccttccacgcgccaacaaatcttgaggcaggggagctgggggcggcgttcgtttcgtcgtgcttgcttgggttctcggtgcgggcgggcggcgattttggcgaggttcgttttgggcggcaggtagaggcgtttcttggcggttggtgagatggacacccacgccgccgggtcgagctccggcggatccggggacggcggcgcggcgcccaggaggaactccaggaagcccaagtactccaagtttacgcagcaggagctcccagcttgcaagccaattcttactccaaaatgggttatttcagtattcgttcttgttggtgtgatttttgtaccaattggtgttgcttcgctgcgagcttcaagacaagttgttgagattgttgatcggtatgatgatgcatgtgttcccactaatgtgactgacaagcttgcttacatccgggacaaaactataccaaaagcctgcacaaggaacctgacgattacaaaggagatgaagcaaccgatatttgtttattaccagctggataacttctaccagaatcataggaggtatgtcaagagtcgcaatgatgaacagctaagagataaaggtaaggcaaccaagactgacaattgcgatcctgaggccacaatagatggaaagccaatcgtgccttgtggtcttattgcatggagcctgttcaatgatacatatgaccttgcccgcaacaatgaaaacttgcctgtggacaagaaagacatatcttggaaaagtgacagagaacacaaatttgggagtgatgtcttcccaacaaacttccagaaaggacctcttcaaggtggaaaaatacttaattcaactatgccgttgagtgagcaagaggaccttatcgtttggatgcgaactgcagcacttcctacattcagaaagctgtatggtaggatatatgttgatctcaaggtaaacgacaccattacagtccatttggagaacaattacaacacctatagctttggtggcaagaagaagttggtgctttctaccacaacctggcttggtggaaagaacgattttcttggccttgcatatctgactgttggtggactctgcttcttcttggcatttgcattcaccttgctctacttaataaaaccaaggaaattgggagataacaattacttgtcatggaacaggccccctgtaggccgctgatatactttgaaagttaaatgttacacaggcagcgagaaacaattcagcttatggttcaaatgtatcatgtactacatagaaatattatttgtgagagttggtgtagaatatacacaaggtaggccatgtacgagtgatagctgatcaaatcgtgcacagattgtacattacattgaaacaaaatacctttctgttctccaaattgtatactcggaatcagaagtgagtgtcagttttgattttcg

SEQ ID NO: 20182 - protein, 348 aa, Panicum virgatum
  misc_feature: Ceres CLONE 1810406
  misc_feature (67)..(337): Pfam Name: CDC50 Pfam Description: LEM3 (ligand-effect modulator 3) family / CDC50 family
  misc_feature: Functional homolog of the protein sequence given in SEQ ID NO 50291
  misc_feature: Useful for making plants with modulated nitrogen use efficiency
MDTHAAGSSSGGSGDGGAAPRRNSRKPKYSKFTQQELPACKPILTPKWVISVFVLVGVIFVPIGVASLRASRQVVEIVDRYDDACVPTNVTDKLAYIRDKTIPKACTRNLTITKEMKQPIFVYYQLDNFYQNHRRYVKSRNDEQLRDKGKATKTDNCDPEATIDGKPIVPCGLIAWSLFNDTYDLARNNENLPVDKKDISWKSDREHKFGSDVFPTNFQKGPLQGGKILNSTMPLSEQEDLIVWMRTAALPTFRKLYGRIYVDLKVNDTITVHLENNYNTYSFGGKKKLVLSTTTWLGGKNDFLGLAYLTVGGLCFFLAFAFTLLYLIKPRKLGDNNYLSWNRPPVGR

SEQ ID NO: 20183 - DNA, 1882 bp, Panicum virgatum
  misc_feature: Ceres CLONE 1810410
  misc_feature: Encodes the peptide sequence at SEQ ID NO. 20184
ctcctcgccgctctccccgcccgcccgcccgctcgctcaccatgctgctccacctcgtcacctcctcctcccccctaaccacggcacgcccctcgacgcagaggcgtccgtgcgtttccgcggtggcggcggtgacgattaggtgcgcagcgtcctcctcgagcaccccgtcgtcgtctgcatcggaagcggctgctgctgggcagcaggtggcgaaggtgcacagctacgggacggtggactacgagcgtcgcgctccgctgcggtggggaaccctgtaccggcgcatcgcggtggggcacggcgggcggcccgtggggcgcacgctggggtcctgggacgagggggagcgccgcctcgacaagtgggagctctgccgcatcgccaaggagctccgcaagttcaggaggttcgacctcgcgctccaggtttatgattggatggcagggcgcagagatagatttccactctcatcaagcgatatggcaattcagttggatctgattgctaaagtacatggtatttcacatgctgagaaatactttgaggatcttcctgataccatgaaggacaagcggacttacggttcccttctaaatgtttacgcccaagctacgatgaaagagaaaacggaagacacatttcagcaaatgaggaaaaagggatttgcttctgacacgttaccttgtaatgtgctgatgaatttctatgtggatgttggagagcctgataaagtgtcgtcaattattaatgagatgaaggatagaaatgtttcctttgatgtatgcacttacaacatatggataaagagctgtgcagccaaacaagatgctgacgaaatggagcgagtctttagccagatgatcgctgatgagtctgttattgcaaattggacaacttataccacactggctaccatgtatattaagcttgggaactctgagaaggcagaagaatgtttgaaagaagctgaaaagagaactacaggtcgggagaaaaagtgttttcgctatctcatcacactctatagccatcttggcaagaaggaagaagtttaccgtatttggagctggtataaagcaactttccctacaattcataacctgggttaccaagaggtactatcagcccttgtaaggataggagatattgagggagctgagcttctatatgaggaatgggcatccaaaagctctagttttgatcctaagactatgaacattttattgacatggtatgctagagaaggtttgattaccaagggtgagcaaattctgaaccgatttgttgagaaaggtggaaaccccaagccaaacacctgggaaatccttgccacagcctacctgaaggataataaaatattggaagctctgtcatgcatggagaaagccacagcagttaaaagtgcaagtaaatggaaaccaagacccaccaatgttgagagtcttctggcaagtttcaaggagaagaatgacacagagggtgcagacaggttagtgagtgtacttacaagtagaggatgtgctgaggatgaagaatacaagtcactgattgacacctatgcttttgcgggcacataatggtggaggcaagagtaacgatatgatgagtaccttgcattgaacaattgcattgcttgcctgtaatgtttctaaacatgtgtgctcaattggtacagctatgtcaattccagaggggttgcatgcatttgatcagatgtttcgctagacaaagcaagacaacaaggtacatagatctttctgatccttggctcagctagaaattctaaaatcatgaacaaggggccaattagatggcttctttgtactttcgaaatgtatatttacattattttttaggattaatcaagccttcttgatgc

SEQ ID NO: 20184 - protein, 512 aa, Panicum virgatum
  misc_feature: Ceres CLONE 1810410
  misc_feature (214)..(248): Pfam Name: PPR Pfam Description: PPR repeat
MLLHLVTSSSPLTTARPSTQRRPCVSAVAAVTIRCAASSSSTPSSSASEAAAAGQQVAKVHSYGTVDYERRAPLRWGTLYRRIAVGHGGRPVGRTLGSWDEGERRLDKWELCRIAKELRKFRRFDLALQVYDWMAGRRDRFPLSSSDMAIQLDLIAKVHGISHAEKYFEDLPDTMKDKRTYGSLLNVYAQATMKEKTEDTFQQMRKKGFASDTLPCNVLMNFYVDVGEPDKVSSIINEMKDRNVSFDVCTYNIWIKSCAAKQDADEMERVFSQMIADESVIANWTTYTTLATMYIKLGNSEKAEECLKEAEKRTTGREKKCFRYLITLYSHLGKKEEVYRIWSWYKATFPTIHNLGYQEVLSALVRIGDIEGAELLYEEWASKSSSFDPKTMNILLTWYAREGLITKGEQILNRFVEKGGNPKPNTWEILATAYLKDNKILEALSCMEKATAVKSASKWKPRPTNVESLLASFKEKNDTEGADRLVSVLTSRGCAEDEEYKSLIDTYAFAGT

SEQ ID NO: 20185 - DNA, 2670 bp, Panicum virgatum
  misc_feature: Ceres CLONE 1810413
  misc_feature: Encodes the peptide sequence at SEQ ID NO. 20186
acagcttcacagcatccttcctccatagcatccctgtccaccttctttgtttccaagccaggatggcgtccaagcccagtttcaagaggacggacagcatcgcagaaagcatgccggatgcgctaaggcaaagccggtaccagatgaagagatgcttccagaggtatgtgtccaagggaaagaagctcttgaagaaccagcagctaatacaagagctggagaaatcattggatgacaaagtcgagaaggaaaagcttgttgaaagcttcctcggttacattatttgttcgacacaggaagcagtggtgctaccaccctatgttgcatttgctgtcaggatgaatcctggcatctgggagtttgtcaaagttcattccgacgatctgtccgtcaaaggaattacaccgtctgaatacctcaagttcaaggagacattatatgacgagaactgggcaaaggatgacaactcactggaagtcgatttcggtgctcttgacctctcaacgccgcatatgacactgccatcatccattggaaacgggctccagtttatctccaaatttatgtcttcaaagctaggcgagaagcctgaaatcagcatgaaaccgttgctggactatttgctttcgctaaactaccgtggtgagaaactgatggttaatgatacaatcgatacggtgaacaagcttcagacagcactgctacttgctgaggtatttgtcagcgggctgccaagatacacgccattcgccaagtttgaacaaaggtttcaagagtggggattggagaaagggtggggtgacactgctgaaaggtgcaaggagacactgaattgcctctctgaagtgctacaagcgccagaccctatcaacatggagaattttttcagcagaattccatccatattcaacatcgtcgtcttctccatccacggttactttggccaagagaaagttcttggcttgccagatactggcggtcaggtggtctacatcctggaccaagtcagggcccttgaagaggagttgctgcaaagaatcaagcagcagggtttgaatgtaacaccaaagattcttgtgctaacaagactgataccagatgccaagggcacaaaatgcaacgtggagctcgaaccagtggaaaacacaaaacattccagcatacttcgcgtgccattcaagactgaagacggcaaggatttgcgccagtgggtgtcccggtttgacatctacccttacctagagagatatgcccaggattcttgtgccaaaattcttgacattttggagggcaagccagacctgatcatcggcaattacaccgatggcaacttggtggcgtcccttatgtcaagcaagctcggagtcactcaggggacaattgcacacgctctggagaagacaaagtatgaagattcagatgtcaagtggagagatctagaccagaagtaccacttctcgtgccaattcactgctgatatgattgccatgaacaccagtgactttatcatcaccagcacgtaccaagaaatcgctggaagcaaagagaagccaggccaatatgagcaccactacgcgttcacaatgccggggctttgccgctacgccacgggcatcaacgtctttgatccaaagttcaacattgctgcacccggtgctgaccagtccatctacttccccttcactcagaagcagaagcggctgacagatttacacccacagattgaggagttgctctacagcaagcaggacactgatgaacacatagggtatctagcagacagaaacaagccaatcatcttctcaatggcaaggctggacaagtccaaggaccgggaggagatagaagagatcaacaaaatgcacaacctgatcgacaagtaccagctgaaaggacagatccgctggatcaaggcacagactgaccgtgtccgcaacggtgagctgtaccgttgcattgccgatacaaagggtgcatttgttcagcctgcactttacgaagcatttgggctgacagtgattgaggcgatgaactgcggcttaacaaccttcgcaacaaatctgggaggaccggcagagatcattgtggatggtgtctccggtttccacataaaccccatgaacggcagggaggcaagcaacaagattgcagatttcttccaaaagtgcaaggaagacccaagctactggaacaaggtgtccactgctgggcttcagcgcatctacgaatgctacacatggaagatttatgcaactaaagtcctgaacatgggttcaacttatggcttctggaagaccctgaacaagggagagaggattgctaaacagcgttacctgcagatgttctacaatcttcagttcaggaatctggcaaagacggtaccaagagtatatgaacatccaccgcaagccccagcaagcacagggccaagtacaatgacagtagtaaaaccgaaagaaagaaagccacagactaggattcagaggatcatgaccagcttgatggggaacaaatcttcaacttctgactagaacatattgaagccaaggtcctcgtggctgcacaaattccattaacaccggaccaaagtgtattgtaaagcgattggtgtgtatgcatgtgtggtgtggatgccattgtgttgattgtaattgtaaagatggatgatgt

SEQ ID NO: 20186 - protein, 822 aa, Panicum virgatum
  misc_feature: Ceres CLONE 1810413
  misc_feature (8)..(560): Pfam Name: Sucrose_synth Pfam Description: Sucrose synthase
  misc_feature (563)..(719): Pfam Name: Glycos_transf_1 Pfam Description: Glycosyl transferases group 1
  misc_feature (1)..(622): SWISSPROT Homolog: EC 2.4.1.13 Sucrose synthase
  misc_feature (603)..(749): SWISSPROT Homolog: EC 2.4.1.14 Sucrose-phosphate synthase
  misc_feature: Functional homolog of the protein sequence given in SEQ ID NO 50900
  misc_feature: Useful for making plants with altered carbohydrate content
  misc_feature: Functional homolog of the protein sequence given in SEQ ID NO 50901
  misc_feature: Useful for making plants with altered cell wall content and/or composition
  misc_feature: The sequence is a functional homolog of SEQ ID NO 12 in US patent 7091398
  misc_feature: The sequence is a functional homolog of SEQ ID NO 2 in US patent 7091398
MASKPSFKRTDSIAESMPDALRQSRYQMKRCFQRYVSKGKKLLKNQQLIQELEKSLDDKVEKEKLVESFLGYIICSTQEAVVLPPYVAFAVRMNPGIWEFVKVHSDDLSVKGITPSEYLKFKETLYDENWAKDDNSLEVDFGALDLSTPHMTLPSSIGNGLQFISKFMSSKLGEKPEISMKPLLDYLLSLNYRGEKLMVNDTIDTVNKLQTALLLAEVFVSGLPRYTPFAKFEQRFQEWGLEKGWGDTAERCKETLNCLSEVLQAPDPINMENFFSRIPSIFNIVVFSIHGYFGQEKVLGLPDTGGQVVYILDQVRALEEELLQRIKQQGLNVTPKILVLTRLIPDAKGTKCNVELEPVENTKHSSILRVPFKTEDGKDLRQWVSRFDIYPYLERYAQDSCAKILDILEGKPDLIIGNYTDGNLVASLMSSKLGVTQGTIAHALEKTKYEDSDVKWRDLDQKYHFSCQFTADMIAMNTSDFIITSTYQEIAGSKEKPGQYEHHYAFTMPGLCRYATGINVFDPKFNIAAPGADQSIYFPFTQKQKRLTDLHPQIEELLYSKQDTDEHIGYLADRNKPIIFSMARLDKSKDREEIEEINKMHNLIDKYQLKGQIRWIKAQTDRVRNGELYRCIADTKGAFVQPALYEAFGLTVIEAMNCGLTTFATNLGGPAEIIVDGVSGFHINPMNGREASNKIADFFQKCKEDPSYWNKVSTAGLQRIYECYTWKIYATKVLNMGSTYGFWKTLNKGERIAKQRYLQMFYNLQFRNLAKTVPRVYEHPPQAPASTGPSTMTVVKPKERKPQTRIQRIMTSLMGNKSSTSD

SEQ ID NO: 20187 - DNA, 720 bp, Panicum virgatum
  misc_feature: Ceres CLONE 1810414
  misc_feature: Encodes the peptide sequence at SEQ ID NO. 20188
aagctccagtcactcccagtcacacgcgggctatggtggaggctgcagcaagggagcggaagaggccccgcgagggcgacgcggctccgtccgccgcggcgggggcgggggcgtggaaggcgcagtacgtgtacctgcctatcgccgacgccctcaaggtcctcggcgcccaggtcttcctcttcgccgccgtctccgagatcggcgccgctgtccgcagccgtggcacggatttcactcttacattgaggattgcagatcaatcacgtccagctggtatctctgtaacattttttgctgacaatgtcgccttattgccctgtgttaagtcaagcggagatgtgatcagtcttcataatgtcatgataacaatgcatggagaattttttgtttcatttaacaaaaaattttcttcattcgccctatttgaaggcaaagtatctacagagtgcagcccatatcagacttctacgaaataccatgggacccaacatgataatgaacttttgacccagatgagaacatggcttgtgtataatcctccaggtctgaaagatcttgaattgcagttaaggagtttaaagtccgatactacttttaatttagtatgcaaggttcttcatgtctatgaaaataatggcgaatggatattttatgtttgggatgggactgatacccctgcagctgagtttcagggcattttggatgctgaggcggttg

SEQ ID NO: 20188 - protein, 229 aa, Panicum virgatum
  misc_feature: Ceres CLONE 1810414
  misc_feature (64)..(167): Pfam Name: Telo_bind Pfam Description: Telomere-binding protein alpha subunit, central domain
MVEAAARERKRPREGDAAPSAAAGAGAWKAQYVYLPIADALKVLGAQVFLFAAVSEIGAAVRSRGTDFTLTLRIADQSRPAGISVTFFADNVALLPCVKSSGDVISLHNVMITMHGEFFVSFNKKFSSFALFEGKVSTECSPYQTSTKYHGTQHDNELLTQMRTWLVYNPPGLKDLELQLRSLKSDTTFNLVCKVLHVYENNGEWIFYVWDGTDTPAAEFQGILDAEAV

SEQ ID NO: 20189 - DNA, 1776 bp, Panicum virgatum
  misc_feature: Ceres CLONE 1810425
  misc_feature: Encodes the peptide sequence at SEQ ID NO. 20190
acacgatccgccattccttttcctttcggatgcggaggcttggcacaagagggaagggaggagtcagacagccggaggccggcgctgaggtgaactagttctagtcctcaggcctcggcggcggcggcggcagccatggccgcgcaccttcgcctcctctccgccgcccactccatccccacccccgcacccgcacccgcccgcgcgcccacttccctccaccgcctccgccaacgcctccctgctcctcctcccgcggcccgcctccgcctgctccggccgccgcggctcgaggagagcccgcgcctctccagcgccgcgcgctgccgctgcgccggctcggcggtcgccgaggacggcggcgagcaggcggcggcggggatatgggagcaggtgcgggacatcgtcgtgttcgcgggccccgcgctggggctctggatctgcggcccgctcatgagcctcatcgacaccatggtcatcggccagacctccgccgtccagctcgccgcgctagggcctgggacagtgttctgtgactacctaagctacatattcatgttcctttcggttgcaacctctaacatggtggccaccgccttagctaaaaaggacgaagaacttgcacaacatcaagtgtctatgctgttgcttattgctcttacgtgtggcataggaatgtttttgttcaccaaggtttttggtactcaagcattgactgcttttgctggatcagggaattatgaaattatctcttccgccaatacatatgcacagataagaggctttgcatggcctgcagttcttgtgggcttagttgctcaaagtgccagtctgggcatgaaggattcttggggtcctttaaaggcattagcagctgctactgcggtaaatggtgttggtgacatacttctttgctctgtttgtggctttggaattgctggtgcagcctgggcaactatggtttcacaggttgttgcagctttcatgatgatgcggaatctaaacaataagggatttcgagctttctcatttacgattccatcagcgagagagctgctgcagatatttgaaattgcagctcctgtttttgttacaatgacatccaaggtagcattttatgcattgctcacatattcagcgacttctatgggagcagtaactcttgcagcacaccaggttatgattaatatcttatgcatgtgtactgtttggggtgagcctctgtcgcaaactgcacagtcattcatgccggagctgatatatggtgctaatcgtaatttgaataaggcaaggatgctattgaagtcacttatgatcattgaagggattactggagcggttttgggggcagtagggacacttgttccatggcttttccctagtctctttaccaatgatagaatggttgtccaacagatgcacaaagtactggctccatatttcagtgtgttgctggtgactccttcagtacactcccttgaaggaacattattggccggaagggatctgcgatatttgagtcaatcaatgggtgtatgcttttgcattggaacccttctattgatggttctccgcaacaaatttggtagcttgccaggatgctggtggatactcgtcttgtttcaatggagtcggtttgcaagtggtttacaacggctcatttctccaatgggcatgttgtacaatgaaaattttaaccaggttgcctatatcaaaacgaaggccacgtgaagatcgtacataccgtttgatgaggtgagatcatgatgaagatac

SEQ ID NO: 20190 - protein, 531 aa, Panicum virgatum
  misc_feature: Ceres CLONE 1810425
  misc_feature (96)..(258): Pfam Name: MatE Pfam Description: MatE
MAAHLRLLSAAHSIPTPAPAPARAPTSLHRLRQRLPAPPPAARLRLLRPPRLEESPRLSSAARCRCAGSAVAEDGGEQAAAGIWEQVRDIVVFAGPALGLWICGPLMSLIDTMVIGQTSAVQLAALGPGTVFCDYLSYIFMFLSVATSNMVATALAKKDEELAQHQVSMLLLIALTCGIGMFLFTKVFGTQALTAFAGSGNYEIISSANTYAQIRGFAWPAVLVGLVAQSASLGMKDSWGPLKALAAATAVNGVGDILLCSVCGFGIAGAAWATMVSQVVAAFMMMRNLNNKGFRAFSFTIPSARELLQIFEIAAPVFVTMTSKVAFYALLTYSATSMGAVTLAAHQVMINILCMCTVWGEPLSQTAQSFMPELIYGANRNLNKARMLLKSLMIIEGITGAVLGAVGTLVPWLFPSLFTNDRMVVQQMHKVLAPYFSVLLVTPSVHSLEGTLLAGRDLRYLSQSMGVCFCIGTLLLMVLRNKFGSLPGCWWILVLFQWSRFASGLQRLISPMGMLYNENFNQVAYIKTKAT

SEQ ID NO: 20191 - DNA, 463 bp, Panicum virgatum
  misc_feature: Ceres CLONE 1810425-R
  misc_feature: Encodes the peptide sequence at SEQ ID NO. 20192
tcccaatcaacctggtggtggcagtgatcgccgaggtggtcctcgtagacggcgccgagtgctacgggatcatcaacggcatggactgggaggacaggcggcaccccggcggcccgttggacccgttgggcagggccagggaccctgaccaggctgccatcctcaaggtgaaggagatcaagagcgcccggctggccatgttgtccatgctggctttctttatccaggcgtacgtcaccggtgaaggcccggtcgagaacctcgccaagcacattagcgaccccttcggcaacaacctcgtyaccgtcatctcygkcgccsccgagaggmcrcccrkccggagagcarcgagsttgcgggggscgcstttgattttwcygggaaacagagagwgsktgagggtctgragaaatggtgcyawgaagtgyaaatkatcaagatggagaagaaaccatywtkttcc

SEQ ID NO: 20192 - protein, 153 aa, Panicum virgatum
  misc_feature: Ceres CLONE 1810425-R
  misc_feature (1)..(77): Pfam Name: Chloroa_b-bind Pfam Description: Chlorophyll A-B binding protein
  misc_feature (105)..(105): Xaa is any aa, unknown, or other
  misc_feature (107)..(107): Xaa is any aa, unknown, or other
  misc_feature (110)..(110): Xaa is any aa, unknown, or other
  misc_feature (112)..(112): Xaa is any aa, unknown, or other
  misc_feature (116)..(116): Xaa is any aa, unknown, or other
  misc_feature (117)..(117): Xaa is any aa, unknown, or other
  misc_feature (121)..(121): Xaa is any aa, unknown, or other
  misc_feature (122)..(122): Xaa is any aa, unknown, or other
  misc_feature (125)..(125): Xaa is any aa, unknown, or other
  misc_feature (126)..(126): Xaa is any aa, unknown, or other
  misc_feature (131)..(131): Xaa is any aa, unknown, or other
  misc_feature (132)..(132): Xaa is any aa, unknown, or other
  misc_feature (135)..(135): Xaa is any aa, unknown, or other
  misc_feature (140)..(140): Xaa is any aa, unknown, or other
  misc_feature (144)..(144): Xaa is any aa, unknown, or other
  misc_feature (152)..(152): Xaa is any aa, unknown, or other
  misc_feature (153)..(153): Xaa is any aa, unknown, or other
PINLVVAVIAEVVLVDGAECYGIINGMDWEDRRHPGGPLDPLGRARDPDQAAILKVKEIKSARLAMLSMLAFFIQAYVTGEGPVENLAKHISDPFGNNLVTVISXAXERXPXRRAXXLRGXXLIXXGNREXXRVXRNGAXKCKXSRWRRNHXX

SEQ ID NO: 20193 - DNA, 2288 bp, Panicum virgatum
  misc_feature: Ceres CLONE 1810427
  misc_feature: Encodes the peptide sequence at SEQ ID NO. 20194
gtgccattgactgacttcactgcactgcaccacacgcgcttggcgagcttgctcctttctccgggccgcgagcgctgagagctgcgctgctcaactttattaacctgtggtggtccggcgggaagccatcatcgcgtagcccccgctaaggacatggaagcggaggaggaccaaagcgcccaggttcaggggcagccggggcgaaggccgcgctgggtggcccggcggcggtccggcgtgtacgagcacttcacctgtttcagagacgacgacgggaacgacaaggcgcggtgcaagcgctgccagctggtgctcggcgcgagcaccagcaccctgtggacacacgtcaagatttgctggggagaagaagccgccgccgccgcgcggcgggcaccacggccgccggtacccgccgcttccccgtcacatccaacgagctcgttgatgccacactcatcttgtcgtgagcctgcgggcctggacgaccaagaagcgagcagagacctggctcggatgatcgcacttcatggccatgatccatcggtcgtggaggacgactacttcaggagcttcgtgcgccgcctcaaccctcagttcaagctgccctcgcgcgatgccattgaggacttgtgctgtgatatctttctaagccataggttggatatgtacaactcctgtagaaacgctcctgggaggatcagtgttgccgtgggtatagctaaaaccatggaggcaggggaagtcctgtatgcaacgtgccaattcattgatggcgaatggaatcttcacaaggcggacgtgtatgtttacgtggttttacctcctggtgatcacaaccttggctcatctttttttggtacacctgtcggttctcttgatgatatggttgaacgtttcgtgactcatctttctaaggattatggcgactataccctgttcataatggcaaggggaatgacgggcgacattgactacggtgaactgaaggatagcatagagaaagtattggggactgattcccctccaaccaacagggagctaatctgtaccacctacatggaccgggttcttcactccattgctcgatgccttcttccaaatccagatttccaaaaagaaatcatgtcctacgtggaggatctgggaggcatttttcaagtacgtcgcgaatgtgcacgacatggcctagatgacccgtgggagtacaatgaagattggtattggtgctattgtcctttggaaatatttcaccaagatgaagatttcgaatcaggatcagaagaacaactgcaacttctatggaaagtgatacaccgtgccattaaaagagtttctgactccagccgtcccacgtcaaatctttgtcttgaacagctttttatggtcaggtatgctttaaaatctcaactgtcaaatgctacagcagcggatgcgggcaagtacagtggttttggtgaaaagaatgttgcagatgttcttaataaagcactagaaacggtagacaaggctatacaagattcatacctggtatggtctataccacatgtattggacccccggtacaaactcaggtccctagaagataatttcaaaagagcgtttggtccagatgatgcaaattgttacacctccagtgtaagacgaaagctcaaagagctgtacaccaattacattgaaaatgacaatgacatggaagaagaagatgacgatgaagtttcagatgccagcattgaagagatggccgttgacagcagcactacaccattagagcaatcacgggataatagtcatgcagaagccaagacggaactcgaccattacctgcaagatagccccgcccgtcgaacaaaggattttgacattctcaactggtggaaggtttacggctcgggtcagtacaaaagggtggctcggatggcaagggatgccctcgccatgcccacatgcagtaagctatcttccgatcagatcgcacatgtcaggagcatgcttcgtggttatagctaggtaaatggacaaaatcagtgggaaggcagcgtatacgtgatcctcaagctgcaaaaaaaggtggcattatttaggagcttgtatatatgtgtgccccctcatccgttccagtgttcttcttcggcaggttgttcagcagacaagctccttaactgtgctggctggcgtctcttcattgtatttgtgatgttgtatgttgaaatgcactctacaaataatcacgtcaccatccttgtaataatggctacaattcctgagcacggtaaatgtttgttgccggt

SEQ ID NO: 20194 - protein, 617 aa, Panicum virgatum
  misc_feature: Ceres CLONE 1810427
  misc_feature (27)..(69): Pfam Name: zf-BED Pfam Description: BED zinc finger
MEAEEDQSAQVQGQPGRRPRWVARRRSGVYEHFTCFRDDDGNDKARCKRCQLVLGASTSTLWTHVKICWGEEAAAAARRAPRPPVPAASPSHPTSSLMPHSSCREPAGLDDQEASRDLARMIALHGHDPSVVEDDYFRSFVRRLNPQFKLPSRDAIEDLCCDIFLSHRLDMYNSCRNAPGRISVAVGIAKTMEAGEVLYATCQFIDGEWNLHKADVYVYVVLPPGDHNLGSSFFGTPVGSLDDMVERFVTHLSKDYGDYTLFIMARGMTGDIDYGELKDSIEKVLGTDSPPTNRELICTTYMDRVLHSIARCLLPNPDFQKEIMSYVEDLGGIFQVRRECARHGLDDPWEYNEDWYWCYCPLEIFHQDEDFESGSEEQLQLLWKVIHRAIKRVSDSSRPTSNLCLEQLFMVRYALKSQLSNATAADAGKYSGFGEKNVADVLNKALETVDKAIQDSYLVWSIPHVLDPRYKLRSLEDNFKRAFGPDDANCYTSSVRRKLKELYTNYIENDNDMEEEDDDEVSDASIEEMAVDSSTTPLEQSRDNSHAEAKTELDHYLQDSPARRTKDFDILNWWKVYGSGQYKRVARMARDALAMPTCSKLSSDQIAHVRSMLRGYS

SEQ ID NO: 20195 - DNA, 707 bp, Panicum virgatum
  misc_feature: Ceres CLONE 1810441
  misc_feature: Encodes the peptide sequence at SEQ ID NO. 20196
gaccatcgcaataaataaaaccaacaataatagagagagaagagagagagagagagagagagagaggagacagcaacaccggctgcttaatctcttcttttcctcggcttatctccaagggcgcatctccagaagcggaagggaggaacggagcggcgaattcttgttttcgcgcaagatgtcttccccaagcaagcgccgggagatggacctcatgaagctgatgatgagcgactacaaggtggagatggtgaacgatgggatgcaggagttctttgttgacttccgtgggcctaacgaaagcatttatcaaggaggcgtgtggaaggttagagtagaactgccagatgcatatccatacaaatccccgtcgattggtttcatcaataagatatatcacccaaatgtcgatgaaatgtctggttcagtctgtttggatgtcatcaaccaaacatggagcccaatgtttggtaataattgatctttccgtttcattacctgtggacatccagttggttaatatcccctgttgcgttatcattacaactggaactccaggtgctttgtactttaaatctatcagtgatattttgcagatcttgtcaatgtgtttgaggtcttcctcccacaacttctactatatccaaatccttctgatccattgaatggagatgctgctgcattgatgatgcgtgatcggcctgctt

SEQ ID NO: 20196 - protein, 100 aa, Panicum virgatum
  misc_feature: Ceres CLONE 1810441
  misc_feature (7)..(100): Pfam Name: UQ_con Pfam Description: Ubiquitin-conjugating enzyme
  misc_feature: SWISSPROT Homolog: EC 6.3.2.19 Ubiquitin--protein ligase
MSSPSKRREMDLMKLMMSDYKVEMVNDGMQEFFVDFRGPNESIYQGGVWKVRVELPDAYPYKSPSIGFINKIYHPNVDEMSGSVCLDVINQTWSPMFGNN

SEQ ID NO: 20197 - DNA, 1722 bp, Panicum virgatum
  misc_feature: Ceres CLONE 1810443
  misc_feature: Encodes the peptide sequence at SEQ ID NO. 20198
gatcaccctcacgcagtcaagcaccccgacggcggcggcggcgccctgccctgccccatttccatggagccgagcggcgaggaggccgccgccaagtgcgcgaagccctccctcgccggagaggatcgcctcagcgcgctccccgacgacgtcctcgtcctcatcctcctccgcctccgcactcccgaggtagtccggactagcgtcctctcccgccgctggcgcagcgtctgggggctcctcccggagctccgcttctccgatccggagccccacggcctccgcggcgccctctccgcctccgcggtgcccctccgctacctcctcgtctggtggctgcggggcgccccggccgaatccatagcgaactggctccccgccgccgcgcgccgcctcactggagagctcgccctcgtcgacatgggtcgcgccggaggggagtccgaggagagaggcacccttgacctgccctgcttcgacaaagccacctccatctcgctcgacctagggttcctcggcctctccatgccagccgccggggtcttcgcccggctcaccgacctcaccctgagcggtatccggttccacggaccatgcgagctcggcagcactgtctcttcgctgcggtgcccgtgcctgcagaagctcacagtacacgactcctatgggctggacaatctcaccatcaattccggctctctcaagctggtggagcttgtgcagctgcgtggtttgtggcagctaaccgtcgtggcaccggtgctccaagagttaagcgtggtgaggtgcttcttgtgttatcagacccgacaaccggtcgtaaatatctcggttcctcagctggaatcactcaactgggtgggtgcttatgatccaagctccgtgcggattggcaagatggagagtctcaaatctctcaccactatttttcttgtgtatggagcagagggctttacactaaaccctgcgtgtctaatgctcatgtcgcgtgttaaggtcatcgaatctcttactctcggactgtgccatccacaggagataaataactaccaatatttgatggatgacatgacaatactccctgatgtcacatctttgcacctgattcttagtgtggaaggacattcctttggggcctgctcattccatattctcaggatgtgtcctggtataaaacggctgataatggacttatctaatcgtttcatcttgaaggcacaagctgaatgcccacagggctgcatttgtgatcagccatcaaactggaaaactgaggagctcaagttgaattgtctccgtgaaatggaaatccgagagttcagagggtcagatcatgaacttgtttttttgaagcgactattcacttgggcaacaggcctaaaaagaatagcagtagctttcaatgtttcagttgtttttttgaagcgactattcacttgggcaacaggcctaaaaagaatagcagtagctttcaatgtttcagttgctgaaagcgcgactaaggagttgtgcaagatgttgcgaaccttctccaggccagaaatatgcatggacttttatgtgtaccagaacatggttaaggtgttgtatgcatatgaagactagggcgctacttcaagttacttaaagcactagacttttttttactttcctgcatgtcatgtactcggaatgcttgaggacatcaaaatgttatcgcttataaaattgttaagatccatc

SEQ ID NO: 20198 - protein, 513 aa, Panicum virgatum
  misc_feature: Ceres CLONE 1810443
  misc_feature (21)..(68): Pfam Name: F-box Pfam Description: F-box domain
MEPSGEEAAAKCAKPSLAGEDRLSALPDDVLVLILLRLRTPEVVRTSVLSRRWRSVWGLLPELRFSDPEPHGLRGALSASAVPLRYLLVWWLRGAPAESIANWLPAAARRLTGELALVDMGRAGGESEERGTLDLPCFDKATSISLDLGFLGLSMPAAGVFARLTDLTLSGIRFHGPCELGSTVSSLRCPCLQKLTVHDSYGLDNLTINSGSLKLVELVQLRGLWQLTVVAPVLQELSVVRCFLCYQTRQPVVNISVPQLESLNWVGAYDPSSVRIGKMESLKSLTTIFLVYGAEGFTLNPACLMLMSRVKVIESLTLGLCHPQEINNYQYLMDDMTILPDVTSLHLILSVEGHSFGACSFHILRMCPGIKRLIMDLSNRFILKAQAECPQGCICDQPSNWKTEELKLNCLREMEIREFRGSDHELVFLKRLFTWATGLKRIAVAFNVSVVFLKRLFTWATGLKRIAVAFNVSVAESATKELCKMLRTFSRPEICMDFYVYQNMVKVLYAYED

SEQ ID NO: 20199 - DNA, 713 bp, Panicum virgatum
  misc_feature: Ceres CLONE 1810445
  misc_feature: Encodes the peptide sequence at SEQ ID NO. 20200
aaaatccgccgcggcgggcttcgaattcgatccccttcccccgagtcgtcggctcgatctgatcggcggagcggcgagagcagccaccaagccaaccatgtgggcggcgtcgtgcctggcgtcgtgctgcgcggcgtgcgcgtgcgaggcctgccggacggcggtcggcagcatcggtcgccgctccgcgcgtatcgcctactgcggcctcttcgcgctctccctcgtcgcctcatgggcgctccgcgaggtcgccgcgcccctcctccagtccatcccatggattaaccacttccacaagacgccggaccgcgagtggttcgagaccgacgcggtgctcagggtcagcctcggcaacttcctcttcttcaccatcctcgccgtcatcatggccgggataaaggaccagaaggacccccgcgacaagatccaccacgggggatggatggcaaagatcttctgctgggccgtcatcgtcttcctcatgttcttcgtgcccaatggcgtcgtcagcttctatggtgagcgcccttccgttcatctgttttatttgtcagaccgtttgatatagttccacgcggttgatatttgtgatcatattagaatgataattgttgggagattgctctaatctttttcggcccaacacccttggaagaagttttctcaaatgaatgtctcatgtggagattgctaatattgttctacgcaga

SEQ ID NO: 20200 - protein, 157 aa, Panicum virgatum
  misc_feature: Ceres CLONE 1810445
  misc_feature (8)..(155): Pfam Name: Serinc Pfam Description: Serine incorporator (Serinc)
MWAASCLASCCAACACEACRTAVGSIGRRSARIAYCGLFALSLVASWALREVAAPLLQSIPWINHFHKTPDREWFETDAVLRVSLGNFLFFTILAVIMAGIKDQKDPRDKIHHGGWMAKIFCWAVIVFLMFFVPNGVVSFYGERPSVHLFYLSDRLI

SEQ ID NO: 20201 - DNA, 1978 bp, Panicum virgatum
  misc_feature: Ceres CLONE 1810446
  misc_feature: Encodes the peptide sequence at SEQ ID NO. 20202
agccaatagccacctctcaaactgccaaataaacctccaccccacgtaactgccacgtaaccttccccaatccgtcgccgggaagagcagggtccatggcgaccgccgcggccacggccgccgttcccgccggcggccgcccgtaccgccgctcccgacctcgctgcggcccaccgcgcctgcaccgcctgcgcctccgtgccaccgcagccgcagccgcagccgcttcgtcttccccgctcgcaccgtccacgtcggcgcccccgccggagggcggcgggcggctggtggcggagctggtgggcgcgttcaacgagctgacggagcggatgggggaggaactggcgacttcctcctcgtcgcgccttctcttccgtgcgctgaagctggcgctccctgccctccgtgacggcgacggcggtagggcgctcgcacgcgcgctcgccgttgccgcctcccttgctgacctccagatggatgctgaagtcatatcggctggcatactgagagaagcactagatgcaggagctgtaagaatgagggatgtgaaagctcagattgggatcagtacagctcatttgctgcacgagagcttaagactcaagcatgctccttcgaaacttgacatattggatgatgaaagtgcaagtgctctgagaaagttttgtctcacatactatgacatcagggcggtgatattggagcttgcactgaagcttgatatgatgagatacctggatgacctccctaagtatctgcaacggataaagtcccttgaagtcatgaagatatatgccccacttgcacatgctgttggagcgggcaatctgtcactagaattagaggatctttcgttttgttacttgtttcctcattcatatgaccatgttgatcggtggttgagaagccaagaaagtgagtgcaaggccttgattaatttgtataaggagcagttacttcaagcactgaaagctgatgacgagttgaataggattgtacaggacatttcagttcaggggcgctataaaagccgtttcagtactatgaagaaactagtaaaagatggccggaaaccagaagaagttaacgacatactaggtctgcgggtaatcttggagcctcggtgtgatggcaattcatcaggttggggcccttgggcttgccacaggacgcatgaaattattcaatctctgtggaaggaagtccctggtagaacaaaagattatatcagtcagccaaaagaaaatggctaccagagcttgcatgtggccatcgatgtaagtgaacctgggaggatgcggcccctaatggagatacagatacgcaccaaagagatgcatagatttgctgttggtggagacgcttctcactccctctacaaaggtggtcttacagatcctggagaggctaaacgactcaaggctattatgttagctgctgcagagctagcagctctgcgcctacgtgatctaccagatagtgatcggggagctggcaactgcaacaaccctgctttctgtcaacttgacaaaaatggggatgggagaatcagcatcgaagagctcactgaggtgatggaggatctaggtgccgggggtgaagacacaacggagctcatgcatcttcttgatgcaaacagtgatggctccttgagctctgatgaattcgagtcgttccagagacagattgaactgatgagaagcttggaggatgaggatgatcactacaggaagatactgaaggagaagctgcacactatcgatagcgcgggtctcatccatgtctaccgcaaggagctgggtgacaaactgcttgtgagctgatctggaacttgtgagaatctgcagaacccaaccaaaccaccatttgttgtagctgcacgcgtatactgtatcaagaaacgactccaccacaaattgtaaatacttgaatgtacatgacattgtatgcaattcagaaaagttggagctgtttgttg

SEQ ID NO: 20202 - protein, 497 aa, Panicum virgatum
  misc_feature: Ceres CLONE 1810446
  misc_feature (230)..(354): Pfam Name: RelA_SpoT Pfam Description: Region found in RelA / SpoT proteins
  misc_feature: SWISSPROT Homolog: EC 3.1.7.2 Guanosine-3',5'-bis(diphosphate) 3'-diphosphatase
MGEELATSSSSRLLFRALKLALPALRDGDGGRALARALAVAASLADLQMDAEVISAGILREALDAGAVRMRDVKAQIGISTAHLLHESLRLKHAPSKLDILDDESASALRKFCLTYYDIRAVILELALKLDMMRYLDDLPKYLQRIKSLEVMKIYAPLAHAVGAGNLSLELEDLSFCYLFPHSYDHVDRWLRSQESECKALINLYKEQLLQALKADDELNRIVQDISVQGRYKSRFSTMKKLVKDGRKPEEVNDILGLRVILEPRCDGNSSGWGPWACHRTHEIIQSLWKEVPGRTKDYISQPKENGYQSLHVAIDVSEPGRMRPLMEIQIRTKEMHRFAVGGDASHSLYKGGLTDPGEAKRLKAIMLAAAELAALRLRDLPDSDRGAGNCNNPAFCQLDKNGDGRISIEELTEVMEDLGAGGEDTTELMHLLDANSDGSLSSDEFESFQRQIELMRSLEDEDDHYRKILKEKLHTIDSAGLIHVYRKELGDKLLVS

SEQ ID NO: 20203 - DNA, 690 bp, Panicum virgatum
  misc_feature: Ceres CLONE 1810447
  misc_feature: Encodes the peptide sequence at SEQ ID NO. 20204
caaaccgcacacggccacgcccatggacgcgagtggggcgccgccgccgctcctcctggccgcggctgtgctgctcgccgccgcgttgggatggctcctcgccgcgcggtcgtcgaagcgcgggtcggcgcggctgccgccgggcagcacggggctgccgctcgtcggggagacgctgcgcctcatctccgcctacaagacccccaacccggagcccttcatcgacgaccgcgtggcgcgccacggcagcggcgtcttcaccacccacatcttcggcgagcgcaccgtcttctccgccgacccggccttcaaccgcctcctcctcgccgccgagggccgcgccgtcgactgcagctacccgtcctccatcgccacgctgctcggcccgcactcgctgctcctcaccaagggccccgcgcacaggcgcctccacgcgctcacgctcacccgcctcggccgccccgcgtcgccgccgctcctcgcccacatcgaccgcctcatcctcgccaccatgcgggagtgggagcccgccgccaccgtccgcctcctcgacgaggccaaaaagatcaccttcaacctcaccgtcaagcagctcgtcagcatcgaccccgggccgtggaccgagagcgtccgccgtgagcgaggaagaaggtggccggggctctgcgggaggtgataaggaagaggatg

SEQ ID NO: 20204 - protein, 217 aa, Panicum virgatum
  misc_feature: Ceres CLONE 1810447
  misc_feature: SWISSPROT Homolog: EC 1.14.13.93 (+)-abscisic acid 8'-hydroxylase
MDASGAPPPLLLAAAVLLAAALGWLLAARSSKRGSARLPPGSTGLPLVGETLRLISAYKTPNPEPFIDDRVARHGSGVFTTHIFGERTVFSADPAFNRLLLAAEGRAVDCSYPSSIATLLGPHSLLLTKGPAHRRLHALTLTRLGRPASPPLLAHIDRLILATMREWEPAATVRLLDEAKKITFNLTVKQLVSIDPGPWTESVRRERGRRWPGLCGR

SEQ ID NO: 20205 - DNA, 1475 bp, Panicum virgatum
  misc_feature: Ceres CLONE 1810450
  misc_feature: Encodes the peptide sequence at SEQ ID NO. 20206
aattgtgctttacttcgcgcgaccaaagcaaagcaaacccaaaatcccgaagatccagaagcttctagtccaccgagaaacccacgctgcccttgtgccctctcgacccctgaagcccaagaggccaagaccaacacctcgcctcggcctccggccatgtcactctcgtcagcgcgccagcgccgggccacggcggcgtcgccgctaaccgacgacgggtacgccaaggacgccaaggaccgggggcgtcgccccggcggcggcgacggggacggtgtggacgggggtatcaagtggttcctcccgttcctggcgctcggactcctccgccacatgagcgcgtcctccaacctgatccacgactgcgacgaggtcttcaactactgggagcccctccacttcctcctctaccgctccggtttccagacctgggagtacagttccgactttgctcttagatcatatttataccttttcattcatgcccttgtagctggccctgcttcattgatctttggtgagcataaaatccgtgtgttctactcaatgagaatctttcttggtcttatttcaactataactgaaactgttctggtggttgctctttcaagaagatatggaaaaagactcgcttgttatgttcttgcaatgctatgcttatccagtggttgcttctttgctagtaccagtttcctgccaagttcattctccatgtatgctgtaacactttcatctggactcttccttcttgagaaatatgctgctgctgtctcagttgcagctgctggagtgatccttggttggcctttctcaattttggtattccttcctgttactgtttactcattaattagaggaccttttggaagggtatttttatccggattcctgacttcattgagccttcttgttctttcatttcttgctgattatcattgctatggtcgattgacgttctcggtgttcaatcttctgaaatataatgttcttggtggtggtgaaagtcacttgtatggaactgagggcccttcattctacttcagaaatggattcaataatttcaattttgccttcatccttgctcttctgttcttgggggttgtaccatttgcaagaaagaaatatgctccagatctactgatagttgtctctcctgtttatatctggttggctttcatgtctttgcaggcacacaaagaagaaaggtttctctatccaatatatacattgatatgtgttgcagctgcagctgttattgacagctttcctgattttttccatgacaaatattcatctgatcagtctatctttgaaaagatagccaagggtctgcggcctttgatccttggttttattttgtgtgcctcacacagccaaacattttccatgttgaatggatacggtgctcccctgcagatctatcagcatttagaatatcacgaagattctggacctgggtctattctgtgcgttgg

SEQ ID NO: 20206 - protein, 439 aa, Panicum virgatum
  misc_feature: Ceres CLONE 1810450
  misc_feature (49)..(439): Pfam Name: Glyco_transf_22 Pfam Description: Alg9-like mannosyltransferase family
  misc_feature: Functional homolog of the protein sequence given in SEQ ID NO 50902
  misc_feature: Useful for making plants with altered carbohydrate content
MSLSSARQRRATAASPLTDDGYAKDAKDRGRRPGGGDGDGVDGGIKWFLPFLALGLLRHMSASSNLIHDCDEVFNYWEPLHFLLYRSGFQTWEYSSDFALRSYLYLFIHALVAGPASLIFGEHKIRVFYSMRIFLGLISTITETVLVVALSRRYGKRLACYVLAMLCLSSGCFFASTSFLPSSFSMYAVTLSSGLFLLEKYAAAVSVAAAGVILGWPFSILVFLPVTVYSLIRGPFGRVFLSGFLTSLSLLVLSFLADYHCYGRLTFSVFNLLKYNVLGGGESHLYGTEGPSFYFRNGFNNFNFAFILALLFLGVVPFARKKYAPDLLIVVSPVYIWLAFMSLQAHKEERFLYPIYTLICVAAAAVIDSFPDFFHDKYSSDQSIFEKIAKGLRPLILGFILCASHSQTFSMLNGYGAPLQIYQHLEYHEDSGPGSILCV

SEQ ID NO: 20207 - DNA, 710 bp, Panicum virgatum
  misc_feature: Ceres CLONE 1810450-R
ccatcatcattcttcgtaccttcctatatcagtgaagttaggtggatagatgatgctttccgtgggctgcttccatttcccttcaatgagaccctgggtggcaccaccgctgctccggcatacttcaacaacaagaataaggcctctgaggagcaatatcttaaggacatcggagcatgtactttactggtggagcttgatctaaggaggccttatccctcacgtggaaatgacttgacaacatgggaggcattggcagcactaccattcctcgatagagagctttcccccgcattataccggtcattctttgtaccataccgatggcaacagaacaatgttttcggactatacaagttgctgaggaggttgcgttctgaccagcactagtcaagagatgtctaatcttgaggaatcaagttctatggagagctaaaccatgcgatttccttgatcaaacttttgattagcaaattttggctactattgttattttttatccaaatggttttgccagtggtgttgctggacagggcttgtgtaactgaattagtccctaatctgtgtgaggatgtatgttttagtgctccaggagagcctatccctgcattattacgcctgtggagtgtggaatgctctgtagccatctcgtttgtactgtgtctgtagaatcttacccaatgagagattaatgaactagtgattgactc

SEQ ID NO: 20208 - DNA, 661 bp, Panicum virgatum
  misc_feature: Ceres CLONE 1810457
  misc_feature: Encodes the peptide sequence at SEQ ID NO. 20209
aaccagctgccacctgcttgcctgcctgcccacagaaattgtaaattccccattcaaaaaggaggcttctccgcttcacacgcaggctttgctctgcccgaaatctctcgctcccatcaatggcgtcgtcgaccgcctgagcagctcggtccccagctccgtcggcggcggcgcgacactccgcaccgggctcgcgactcttcgccgcacggaggaggaagggaggccgcggagatggtggggggaggcggcggcggggcgctgcggcgggtgggcaagtacgaggtcggccggaccatcggggagggcaccttcgccaaggtcaagttcgcgcagaacaccgagaccggggagagcgtcgccatgaaggtgctcgaccgctcctccatcctcaagcacaggatggccgaacagattaagagggagatatctataatgaagcttgtcaggcatcccaatgttgttaggctacacgaggttctggcaagccggaagaagatatttataatcctggagttcatcactggcggcgaactatttgataaaattattcgtcatgggagacttaatgaagcagatgcacgcagacacttccagcagcttattgatggtgtcgatttttgtcacaacaaaggagtctaccatcgagatctgaagcccg

SEQ ID NO: 20209 - protein, 142 aa, Panicum virgatum
  misc_feature: Ceres CLONE 1810457
  misc_feature (16)..(142): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MVGGGGGGALRRVGKYEVGRTIGEGTFAKVKFAQNTETGESVAMKVLDRSSILKHRMAEQIKREISIMKLVRHPNVVRLHEVLASRKKIFIILEFITGGELFDKIIRHGRLNEADARRHFQQLIDGVDFCHNKGVYHRDLKP

SEQ ID NO: 20210 - DNA, 216 bp, Panicum virgatum
  misc_feature: Ceres CLONE 1810480
  misc_feature: Encodes the peptide sequence at SEQ ID NO. 20211
acctccgcacaaccgcgtccgcttcccccccgccacaggagatcccctgcgcccgccgcatccctgtagccgcccctgctgccgccggcgagcccgatccgcagccgccatgtcgccgtcggagccgacgcgtgaggagagcgtgtacatggcgaagctggcggagcaggcggagcggtacgaggagatggtggagttcatggagcgcgtggcgcg

SEQ ID NO: 20211 - protein, 35 aa, Panicum virgatum
  misc_feature: Ceres CLONE 1810480
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 786 in the 11/479,226 US patent application
  misc_feature: The sequence is a functional homolog of SEQ ID NO 789 in the 11/479,226 US patent application
  misc_feature: The sequence is a functional homolog of SEQ ID NO 801 in the 11/479,226 US patent application
  misc_feature: Functional homolog of the protein sequence given in SEQ ID NO 50649
  misc_feature: Useful for making plants with modulated water use efficiency
  misc_feature: The sequence is a functional homolog of SEQ ID NO 809 in the 11/479,226 US patent application
  misc_feature: Functional homolog of the protein sequence given in SEQ ID NO 50648
  misc_feature: Useful for making plants with modulated drought sensitivity
  misc_feature: The sequence is a functional homolog of SEQ ID NO 797 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 793 in the 11/479,226 US patent application
MSPSEPTREESVYMAKLAEQAERYEEMVEFMERVA

SEQ ID NO: 20212 - DNA, 699 bp, Panicum virgatum
  misc_feature: Ceres CLONE 1810493
  misc_feature: Encodes the peptide sequence at SEQ ID NO. 20213
atcttaagctccaatccactgctgctgtgcaagctagcagctctctctctgtctctctctctactcggccggcttgcttcgaacccacttgatcgctgcgtcgcctccctccccttccaactccctcctcccgtacgtgcgcagttctcggcacgcttccccatatatacccctccggccgctctcggcggatagagatgcacaggcagtgacgcgcacgcataccgacggacgaggtagctgctcaccacctatccttgtttccctcggccgcccgtgtcgggcggaggcggactcgtgcggggaatgggacgccacgcccacgcgggctccgccgccgccgccgccggcgtgcagcagaagctgcgcaagggcctctggtcgcccgaggaggacgacaagctctacaaccacatcatccgctacggcgtcggatgctggagctccgtgcccaagctcgcgggcctccagaggtgcggcaagagctgccggctgcgctggatcaactacctgcgcccggacctgaagcggggcagcttctcgcagcaggaggaggacgccatcgtcggcctgcacgagatcctgggcaacaggtggtcgcagatcgcgtcgcacttgccgggccagacggacaacgagatcaagaacttctggaacagctgcctcaagaggaagctgcgccagcgcggcaccgacccc

SEQ ID NO: 20213 - protein, 130 aa, Panicum virgatum
  misc_feature: Ceres CLONE 1810493
  misc_feature (22)..(69): Pfam Name: Myb_DNA-binding Pfam Description: Myb-like DNA-binding domain
  misc_feature (75)..(120): Pfam Name: Myb_DNA-binding Pfam Description: Myb-like DNA-binding domain
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50235
  misc_feature: Useful for biocontainment applications
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: Functional homolog of the protein sequence given in SEQ ID NO 50609
  misc_feature: Useful for making plants with altered lignin content
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Functional homolog of the protein sequence given in SEQ ID NO 50236
  misc_feature: Useful for making plants with modulated biomass
  misc_feature: Functional homolog of the protein sequence given in SEQ ID NO 50610
  misc_feature: Useful for making plants with altered cell wall content and/or composition
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 1917 in the 10/374,780 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1073 in the 10/374,780 US patent application
  misc_feature: The sequence is a functional homolog of SEQ ID NO 1004 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Functional homolog of the protein sequence given in SEQ ID NO 50232
  misc_feature: Useful for making plants with altered alkaloid content
  misc_feature: Useful for making plants with modulated nitrogen use efficiency
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 442 in the 10/412,699 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1002 in the 11/435,388 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 836 in the 10/412,699 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1010 in the 11/435,388 US patent application
  misc_feature: The sequence is a functional homolog of SEQ ID NO 296 in the 11/479,226 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 58 in the 10/666,642 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 824 in the 10/412,699 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 569 in the 10/374,780 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 271 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 822 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 446 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1681 in the 10/374,780 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 794 in the 11/435,388 US patent application
  misc_feature: The sequence is a functional homolog of SEQ ID NO 1565 in the 10/374,780 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 790 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 186 in the 10/412,699 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 796 in the 11/435,388 US patent application
  misc_feature: The sequence is a functional homolog of SEQ ID NO 743 in the 10/666,642 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1566 in the 10/374,780 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 36 in US patent 7193132
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1572 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 2178 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 126 in the 10/412,699 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1692 in the 11/479,226 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
MGRHAHAGSAAAAAGVQQKLRKGLWSPEEDDKLYNHIIRYGVGCWSSVPKLAGLQRCGKSCRLRWINYLRPDLKRGSFSQQEEDAIVGLHEILGNRWSQIASHLPGQTDNEIKNFWNSCLKRKLRQRGTD

SEQ ID NO: 20214 - DNA, 1585 bp, Panicum virgatum
  misc_feature: Ceres CLONE 1810521
  misc_feature: Encodes the peptide sequence at SEQ ID NO. 20215
ggggcaagatttgtccgcgctccgctgtgtctatgcttccgatcggcgttataagatccgtcggtgcgtatattttggtgaatgaataaggcgatgcactgaattaggttttcctgccatttcgatcttacatgtggtgattgggaaatgcctgcccttttggctttggcctttgagatcgaggcttgccgagtttacagcatctgatcactcagaagtcagtaagtataacagttaacaatgcagtgatatcaaattatcaactctgcggatccttttgtatcattccaatttacccgagaggagagtgaaggagcagtacgcatgtgcccttgtgttttatttttcttcttgtgtgcttaccgtgcctcttaccgaagtttgttcattcgtgtgttttaaaggaggtagtgccaatttgttggaggtctttgggtccaattccactttgttgtcgtggacctgacaggtctttgagggtttacaacttagaaataatggtccgaaacttgatggttaaatagggtgctggttattcttttgctgtgctatgttattatttatccttcgaagcaaaggaggtttatgcttttttagaaggtgtgatctcacaccttctatctggaaccctgctggttgtaatcagtgcgctggtcccatggtttcatcaattggattatgcgaactattttattcagaaagaaaccaatcatagcttcgtttatgcatttcattcgtatcaatgccaagagttcaaaatcctatgttccttgactgcatgttttagaggtgaaaatggaaaagcggcttgaatattggactggtgggaaactggaggtgatcgtagttgtgaatgaacattagtccactttagttttttggcttgatcattgtatttctgatattgaaccattactattagtgccttttagttggttggcttgatcattgtatttttaaggtctaacacatttgcgaactttctattgttaagatcactttgaattgctgatcagtagatatttgtggatgcatgggcctattcattatactttgggttgttccttacctttactgtgaaatgaagttgtgatctcatttattttctctctcccttagtaaccctgattgctgattttcttggattcgccagcttctcgtggattccatgccactggtgtgaagagaatgggagggcacggccacgatgagccgtactatctccatgccaagcacatgtacaacttgcacaggatgaagcatcaggggttgaaggtgactctttccgtgctgggagcagttagcatcggcgttggagtccccgtgtacgcagtcattttccagcagaagaagaccgcctcaggttgagcgatcatgctctcaaagcctacatattggagacttattttcaacaacattttgtgaagttttaagcttgattctaccttggtggttgcttattattaccatgttttcttacgagaagttgtaacctcgtttcttgccatgttttcaagtaggacacaactttctgttaataatatcgtggcttgaactttccaggctgtggagaaacctcagcagt

SEQ ID NO: 20215 - protein, 59 aa, Panicum virgatum
  misc_feature: Ceres CLONE 1810521
  misc_feature: Functional homolog of the protein sequence given in SEQ ID NO 50154
  misc_feature: Useful for making plants with modulated nitrogen use efficiency
MGGHGHDEPYYLHAKHMYNLHRMKHQGLKVTLSVLGAVSIGVGVPVYAVIFQQKKTASG

SEQ ID NO: 20216 - DNA, 1568 bp, Panicum virgatum
  misc_feature: Ceres CLONE 1810527
  misc_feature: Encodes the peptide sequence at SEQ ID NO. 20217
tcaggtctctcgccatttccaccttcccctatagcttgagctgcccatgccaaggggcagcgtaattaattagatcgatccgtactgctcgatctagctgctagtggattagtaatcatcagttgttgatgacaattgatcttggtctagctccggcgccggcgccgtcgtcgtccggcgggcgcggcggcggcatggcgagcccgtgcgcggcgctcccgccggggttccggttccacccgacggacgaggagctcatcctccactacctccgcaagcgcgccgccgccgcgccgtgcccggccccagtcatcgccgaggtcgacatctacaagttcgacccatgggacctgccagccaaggcgatttttggggaggccgagtggtacttcttcagcccgagggaccgcaagtaccccaacggcgtgcgccccaaccgcgccgccggatccggctactggaaggccaccggcaccgacaagcccatcacgctctcctcctcctcctccggcgccggcgcggcggcggcgcccgacccgtcgtccgacagccgcgccatgatcggcgtcaagaaggcgctcgtcttctacaagggccgcccgcccaagggcttgaagacgagctggatcatgcacgagtaccgcctcgccgaggcgctcgccgccgccaacacctacaggcccatgaggttcaagaactcctcgtccatgaggctggatgactgggtgctgtgccggatctacaagaagaccacgccgcagctgtactgctcgccgccgcacgacgacgagacctccatggacggcggcctcgacctcggccggcagcacgacggctcgtcggcctccgtcggcgacatcgtcgccgcgtacgcgcccgccgggggccttccgcgcccggcctccatctcggactacctcgtggacttcaactactcgcccgtgtccgagctgctcgagagcatgccggcgccggagacggcggcgcagctcggcaccatggacgcagcaggcaggttgttctacgccgcaaatcacggcgaggcagcagctagcagcagctccacggcgcagcagcagagctcgcacaagaggcgattcatggaggattactccaacagcgacttgaacctgctacacgcgtcgtccagcaagagggtgatgagcgatcagctggcatcatccatggccagcaacctcgccttctcctccgtgtttgagccgggccagacttctctgccggacagaatatgacgcatgcgtgtgctccctcactgctaattagggctaggaaacaatattcattatttgattagtattgatgcagagggatttatcatgtactgtatcaattagaaataatataaacaaaagtattgtattgtaaagatagatgaattaggggtggaaagaattagagtgaccatgtcactagcaatatagctaggtctgatttagatgtagtgttaatgtgtgcagctagcagataggtagcttgaaacatgtaagaacacacactttgttgaatactgtaatagaactctgtgatatatacaaatctctttcagc

SEQ ID NO: 20217 - protein, 374 aa, Panicum virgatum
  misc_feature: Ceres CLONE 1810527
  misc_feature (30)..(174): Pfam Name: NAM Pfam Description: No apical meristem (NAM) protein
  misc_feature: The sequence is a functional homolog of SEQ ID NO 851 in the 10/374,780 US patent application
  misc_feature: The sequence is a functional homolog of SEQ ID NO 1012 in the 11/435,388 US patent application
  misc_feature: The sequence is a functional homolog of SEQ ID NO 854 in the 10/374,780 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Functional homolog of the protein sequence given in SEQ ID NO 50845
  misc_feature: Useful for making plants with altered alkaloid content
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Functional homolog of the protein sequence given in SEQ ID NO 50322
  misc_feature: Useful for making plants with modulated oxidative stress sensitivity
  misc_feature: Functional homolog of the protein sequence given in SEQ ID NO 50641
  misc_feature: Useful for making plants with altered carbohydrate content
MTIDLGLAPAPAPSSSGGRGGGMASPCAALPPGFRFHPTDEELILHYLRKRAAAAPCPAPVIAEVDIYKFDPWDLPAKAIFGEAEWYFFSPRDRKYPNGVRPNRAAGSGYWKATGTDKPITLSSSSSGAGAAAAPDPSSDSRAMIGVKKALVFYKGRPPKGLKTSWIMHEYRLAEALAAANTYRPMRFKNSSSMRLDDWVLCRIYKKTTPQLYCSPPHDDETSMDGGLDLGRQHDGSSASVGDIVAAYAPAGGLPRPASISDYLVDFNYSPVSELLESMPAPETAAQLGTMDAAGRLFYAANHGEAAASSSSTAQQQSSHKRRFMEDYSNSDLNLLHASSSKRVMSDQLASSMASNLAFSSVFEPGQTSLPDRI

SEQ ID NO: 20218 - DNA, 216 bp, Panicum virgatum
  misc_feature: Ceres CLONE 1810535
  misc_feature: Encodes the peptide sequence at SEQ ID NO. 20219
tcttcgaatgtccacaccatgttccggacgttttatgcctctacttcctccgcgcccccggcgctggcatgcaggtgatcgaccgcttctccaaggcgatcctcgaccgcggcatcccagagatgattcgcgacgcgcccgggtcctccgtgaagtctctacactcgggagggcgaacgggatctgctgggcaacaacttgtccgtcttcttcatg

SEQ ID NO: 20219 - protein, 71 aa, Panicum virgatum
  misc_feature: Ceres CLONE 1810535
  misc_feature: SWISSPROT Homolog: EC 1.11.1.6 Catalase
FECPHHVPDVLCLYFLRAPGAGMQVIDRFSKAILDRGIPEMIRDAPGSSVKSLHSGGRTGSAGQQLVRLLH

SEQ ID NO: 20220 - DNA, 2060 bp, Panicum virgatum
  misc_feature: Ceres CLONE 1810537
  misc_feature: Encodes the peptide sequence at SEQ ID NO. 20221
aacatctgttggagatgctctgacatgccaaccctatctcccccaatctgagtgcatcggaggacaggagccaccggcgacgactggcgagagaccactcatcatggacgccgcggtggaggcccttctgccgcagccggcagctgccctggaccaccttgcccggccggcctcccacctcaccaccggccggtggcccgccgccttcttcatcatcggggtggagatctcggagcggttcgcgttctccggcatctcggggaacctgatcacctacctcaccggcccgctcgggcagtccacggcgtcggccgccgcggccatcaacgcctggagcggcgccgcgctcatgctgccgctgctcggcgccaccgtcgccgactcatggctcggccggtaccgcgctatcatcagcgcctccctcgtctacattctgggactggggatgctcaccctatcatcattttttgtgccacaacaaccgtcagaatttgaagacaatgtggattcttcagtatcctggatgggtattcatttagctttcttctatgtgtcactttacgtggtggcttgtgctcaaggtggccacaaaccatgtgtccaagcatttggggctgaccaatttgatgagaatgatcctgaagaatgtgcctcaaggagctccttcttcaattggtggtactttgggacttatggatccaatattgccacactttcaatcttgaattacattcaagataacataagctggcagtttgggttcggaatcccatgcattgccatggctgtttctcttacaattttctggcttggtacaaagaagtatcgcttctatcctccaacgaatagcagagggctatttggatatattggtaaatcacttcttgcatggatccgatgctggtgtgcatcatggtctccaaaatcatcagctgattctcactgtgcaacaacatcatcatccaagggagacaagtacaaagcagaaaccagttttttttctgacaatgctgtggcagtgcttagattgctcccagtaggggcaacctgcctgatctatgcagttgtctttgcccaatggatgacactcttcactaagcaagcaagtacactagataggtggataggtaccatacaggtaccagctgctacccttcaaagctttatcagtgtgtcaatcatcgtctttgttcctatatatgaccgcatcctcattccgctagctaagaaatactcgaataacacttgtggtatcacgacattgcaacgaataggaattgggttggttatttctgtgatcctgatgattgttgcagctcttgtggagatgagaaggctccggatagcaagagactatggcctagtggacaaacctgaggccacaatccctatgagcgtctggtgggttgtccctcaattcattctgtctggcttagcagacgtgttcacaatggtgggcttgcaagaattcttctatgatcaagtaccagatggtttgcgcagtttgggccttgctttatacctgagcatatttggaattgggagcttcatcagtagctttcttgtgtacgcaatcgacaagatgaccagtagggaaggagacggttggttctctaacaatctaaaccgagggcatcttgactacttctattggcttttggctgtgctcgatgtttttgggttggctgcgtacctgtacttttcacgagtgtatgcccataagaaaaaggagctggggctttagtacagtgattgtctacaaatacccatttggaataaaatatgcctgagcaacgcttgtggatgcatctcggtcgtcatggcaggtttctgtggaagttcttcaaaggcgcaggctggaagatggtttgcaacttatcattggtgaatacagatgtcgtacagtgtcaacaatacaaatgttttacagtgctatcggcatagatgttgtacaacttactcttttccctgtgcaatctctgttttgagctgaattcggtatgctcaagcagtgaagctacatgatgcaatgactggttgcgaaatgccagctttctccg

SEQ ID NO: 20221 - protein, 546 aa, Panicum virgatum
  misc_feature: Ceres CLONE 1810537
  misc_feature (99)..(477): Pfam Name: PTR2 Pfam Description: POT family
MDAAVEALLPQPAAALDHLARPASHLTTGRWPAAFFIIGVEISERFAFSGISGNLITYLTGPLGQSTASAAAAINAWSGAALMLPLLGATVADSWLGRYRAIISASLVYILGLGMLTLSSFFVPQQPSEFEDNVDSSVSWMGIHLAFFYVSLYVVACAQGGHKPCVQAFGADQFDENDPEECASRSSFFNWWYFGTYGSNIATLSILNYIQDNISWQFGFGIPCIAMAVSLTIFWLGTKKYRFYPPTNSRGLFGYIGKSLLAWIRCWCASWSPKSSADSHCATTSSSKGDKYKAETSFFSDNAVAVLRLLPVGATCLIYAVVFAQWMTLFTKQASTLDRWIGTIQVPAATLQSFISVSIIVFVPIYDRILIPLAKKYSNNTCGITTLQRIGIGLVISVILMIVAALVEMRRLRIARDYGLVDKPEATIPMSVWWVVPQFILSGLADVFTMVGLQEFFYDQVPDGLRSLGLALYLSIFGIGSFISSFLVYAIDKMTSREGDGWFSNNLNRGHLDYFYWLLAVLDVFGLAAYLYFSRVYAHKKKELGL

SEQ ID NO: 20222 - DNA, 713 bp, Panicum virgatum
  misc_feature: Ceres CLONE 1810551
  misc_feature: Encodes the peptide sequence at SEQ ID NO. 20223
agatagcctcgcaagttaaggccaagggaaaaaaaatcgccagccgtgtgcccgtgtaccaggatcgagccagcaccatggtgcatcaggctcaggggcagatggtgcaggaggtggccgccggcagcctccccgcgccgccgagccggtacgtgctgagggaggaggaccggcctaccggcggcgtcgcggcgcccgtgctggccttccccaccgtggacctgcagcgcctggccgagcccggcgacgtcgaggaggccaccaagctccggtcagcgctcgagtcctggggcctcttcgcggtacgcatgtttgccactgtcacgttccttcagactaggctttctactatgtggcagttcgccatggatagtattggacaacctttcattaactgctaggtgaccggccacggcatgccggagtcgctcctcgccggcgtccgcgacgccggtttggagttcttccacctgccgccggaggagaagctgcggcacgccaaccggacggacgacggcgagttccagccggaggggtacggcatcgaccgcgtggacaccgacgagcaggtcctcgactggtgcgatcggctgtacctcgccgtgcagccggaggagcggcggcaggcgcggttctggcccgcgcgcccgccgtcgctcgcggggctcctgaacgagtatgcccagggcagcgagcgggtggcccggcgcgtg

SEQ ID NO: 20223 - protein, 98 aa, Panicum virgatum
  misc_feature: Ceres CLONE 1810551
  misc_feature: SWISSPROT Homolog: EC 1.14.11.19 Leucocyanidin oxygenase
MPESLLAGVRDAGLEFFHLPPEEKLRHANRTDDGEFQPEGYGIDRVDTDEQVLDWCDRLYLAVQPEERRQARFWPARPPSLAGLLNEYAQGSERVARR

SEQ ID NO: 20224 - DNA, 1665 bp, Panicum virgatum
  misc_feature: Ceres CLONE 1810564
  misc_feature: Encodes the peptide sequence at SEQ ID NO. 20225
aaaacaaaacaaaacaaaacaaagggaaacgcttcgctgcctcgctcctgctctcctccgccgcctccgccgccgccgcccatcactgtcgcagtgccagatcctgatgaatcgctagaagacgccgccgccgccgccgcggacatcgtcgtctcccgatggctctgcgcggtctccggcgccagcgcgggtgctgcgaagccgggagggccctgctccccctccccctccgctggtcgtcgtcatccacgcgcccgaacgaggattccggtgccgccgccctcacggcggaggaggaggccgcgttcgagcggatcaggaggtcgctcctcagggcgcgcaaggggagcgtcgaggacctcgtccggtccctcggggcggagtgctcgggagtccggctcacgagcggcgtcgcggaccgcctgctgcgcgggttcggggacgactggaagtccgcgctgggtttcttccggtgggcgcagtcgcggggcgacggctacgcgcccacgccctacgcctgcagccggatggtcgacctgctcgggaagatgaggcagatcgaccggatgtgggatctgctgtccgaactgcactgcagggggctggtcacggtggacacgatcgccaagagcaccaggaggcttgcggctgcgaggaggtggaaggatgccgtcgagttgtttgatcggttggaggacatggggctggagaggaacacggagacgatgaatgtcctgcttgatgcactctgcaaggagaagaaggtcgaattggcgcgcgaggtgtttgtcgtgctcagcccgcatatcgcgccggatgcgtacactttcaacatctttgtccatgggtggtgcagcgtgcgcaggatcgacgaggctatgtggacgatcgaggagatgaaaagcaaggggttcccacctacggtcatcacgtacactgctgttcttgaggcttactgtaagcagcacaagtttgggagggtctatgaactccttgattcgatggtttcggagggttgccgtcccaatgtgatcacttacactatgatcatgacctcattggcgaaatgtgaaaggtttgaagaaactttgagtgtttcggatagaatgagatcatctggatgtgagcctgataccctgttctacaactccctgatcaaccttctcggtaaagcgggccatttgtttgaagcttctcaagtgttccgtgtggagatgccgaggaatggtgtgccacgcaacctggccacatataacaccatgatatcaattctctgccagtatgggcgagatgatgatgctattgatgtgttgaaagaaatggaggcgcaatcttgtaagcctgatcttcagacataccaaccacttcttaggctatttttaagtagaagagggcaaggcgatgctgttgaccacctgttgagtgagcttgtgaaaaagagtggtctaggtttagatcttgatacatacacccttctgatccatggtctttgtagggtcggtgaaactgactgggcttatcgactgtatgatgagatggtaagtagtgaaatagtacctaggcgtaaaacgtgtgagttgcttttgagtgaaacacaaagacaaaacatggaggcgtatgtggaaagaatctggaatgatataatttcctttggcctttgtccat

SEQ ID NO: 20225 - protein, 502 aa, Panicum virgatum
  misc_feature: Ceres CLONE 1810564
  misc_feature (363)..(397): Pfam Name: PPR Pfam Description: PPR repeat
  misc_feature (257)..(291): Pfam Name: PPR Pfam Description: PPR repeat
  misc_feature (222)..(256): Pfam Name: PPR Pfam Description: PPR repeat
  misc_feature (435)..(469): Pfam Name: PPR Pfam Description: PPR repeat
  misc_feature (292)..(326): Pfam Name: PPR Pfam Description: PPR repeat
MALRGLRRQRGCCEAGRALLPLPLRWSSSSTRPNEDSGAAALTAEEEAAFERIRRSLLRARKGSVEDLVRSLGAECSGVRLTSGVADRLLRGFGDDWKSALGFFRWAQSRGDGYAPTPYACSRMVDLLGKMRQIDRMWDLLSELHCRGLVTVDTIAKSTRRLAAARRWKDAVELFDRLEDMGLERNTETMNVLLDALCKEKKVELAREVFVVLSPHIAPDAYTFNIFVHGWCSVRRIDEAMWTIEEMKSKGFPPTVITYTAVLEAYCKQHKFGRVYELLDSMVSEGCRPNVITYTMIMTSLAKCERFEETLSVSDRMRSSGCEPDTLFYNSLINLLGKAGHLFEASQVFRVEMPRNGVPRNLATYNTMISILCQYGRDDDAIDVLKEMEAQSCKPDLQTYQPLLRLFLSRRGQGDAVDHLLSELVKKSGLGLDLDTYTLLIHGLCRVGETDWAYRLYDEMVSSEIVPRRKTCELLLSETQRQNMEAYVERIWNDIISFGLCP

SEQ ID NO: 20226 - DNA, 719 bp, Panicum virgatum
  misc_feature: Ceres CLONE 1810565
  misc_feature: Encodes the peptide sequence at SEQ ID NO. 20227
ctttgcacccctagtactgatcctcctccccgcgctcttcgcgcagcaagacatagaagaatcccctactactactactactactactactactactactactactcatgcatgggcaccgcctcctcgcgccgcatatgaatcagacatgaataggggccacagcagcagctcctcgaagctcatcaacgagaagcttgaggaacaccggatctccaccgccaagcactgcccccactgcggcgagaaaatcgacagcaagccggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgaccagggatggcctgagcaagcacttcttccaccggccatcaaaggcctatacgacgggcacgaggaagaggaggaagatacagacggagtgcgacgtccacaagggcgagacgaggtggcacaagaccggaaagacgcggccggtaatggtgaacggccggcagaaggggtgcaagaagattctggtgctgtacaccaacttcggcaagcaccgcaagccggagaagacgaactgggtgatgcaccagtaccacctcggcgacctcgaag

SEQ ID NO: 20227 - protein, 190 aa, Panicum virgatum
  misc_feature: Ceres CLONE 1810565
  misc_feature (44)..(187): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 1713 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Functional homolog of the protein sequence given in SEQ ID NO 50710
  misc_feature: Useful for making plants with altered carbohydrate content
  misc_feature: The sequence is a functional homolog of SEQ ID NO 562 in the 11/435,388 US patent application
MNRGHSSSSSKLINEKLEEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLE

SEQ ID NO: 20228 - DNA, 3020 bp, Panicum virgatum
  misc_feature: Ceres CLONE 1810568
  misc_feature: Encodes the peptide sequence at SEQ ID NO. 20229
actacaccccgtcctctctctcgttgccagattcagatccatgccgcccgcctctccactcctgtaagcccccgcgcctccccatccccctccccctccccctcctcactcctccgaatccagcgaggccgccgctcgcgggaacccctcgcgccgccacccgccgctcccccgccccggcgccgccggctcgggcgcccctcccctgcgcgcgcgccgccccgacagcagccgcggccatggcgcagccgctcgtcgtgaagaaggacgacgacctcgacgaggaagagtactactcgccgttcctcggcatcgagaagggcgccgtgctgcaggaggcccgcgtcttccacgacccgcagctcgacgcgcggcgatgctgccaggttatcaccaagcttctatacctgctcaaccagggcgacacctttaccaaggtggaggccacagaagtcttctttgcaacgaccaagctgttccaatccaaggatgcagggcttaggaggatggtgtacctcatgatcaaggaactgtcgccttcagctgatgaggttatcatagtcactagctctttgatgaaggacatgaatagcaaaactgatatgtaccgtgcaaacgctattcgagttctttgtcgtattatcgactcaacccttctcacccaaattgagaggtatttgaagcaagccattgttgataagaatcctgtcgttgccagcgcggctcttgttagtggcatctacttgcttcagacaagtccggaagttgtgaaaagatggagcaatgaagttcaggaggctgtgcagtcaagagctgctcttgtgcagtttcatgcccttgctcttcttcaccaaattagacaaaatgaccgattggctgtcagcaagctcgttactagtttgaccaggggatcagttcgctcacctttggcgcagtgcctgcttattcggtacaccagccaggtgattagagagtctggcgtaaaccaaggtggagatcgtcctttctttgatttccttgagtcctgtctcaggaacaaagcagagatggtcatacttgagactgcaagagcaataactgaactgaatggtgtcacaagccgtgagctgactcctgcaataactgtcctgcagttattcttaagttcatctaaacctgttctcagattcgcagctgttcgcacacttaataaggttgcatcaactcatcctttggctgtcacaaattgtaacatagacatggagagcttaatctctgatcagaacggaagcattgcaacccttgcgattacaacactgttgaagactggcaacgagtcaagtgttgatcgtttaatgaaacagatgaccaactttatgtcagacatagctgatgaattcaagatcgttgttgtcgaagcaataagatccctgtgcttgaaattccctctgaaatatcgctcactcatgaacttcttgagtaatattctacgagaagagggtggcttcgagtacaagaaagccatagttgattcaatcattatactcattagagatattcctgatgcaaaagaaagtggtttatttcacttatgtgaattcatagaagactgtgaattcacctatttatccacccagatactccactttttgggaaatgaaggcccaaaaacatcagatcccagtaaatacatacgatatatatacaatagggtgatacttgaaaatgctacagttcgagctagtgcagtaagcacattggcaaagtttggcgcattggttgactcactcaagcctcgcatattcgtgctgctgagacgttgcatgtttgatggtgatgatgaggtgcgtgacagagcaaccctttacctcaaattgttaggtggggaagctacagttggtgagactaaggatgtgaacgagtttctctttggttcacttgatgttccgctagtaaacttggagacaagcctgcggaattatgaaccttcggatgcaccatttgatatttcgtctgttccaaaggagacaaaatcacaaccacttgctgagaaaaagtctacaggcaagaaaccaaccggtccagcatctgctgttagtggccctgtttcaactgttgatgcatcgtatgaaaagcttctttcatccattcctgaattcgctgatttcggaaagctatttaagtcgtcaacacctgtagaattgactgaagctgagaccgaatattcggttaatgttgtgaagcatatttatgatgggcatgttgtgctccaatacaactgtaccaatacaattcctgaacagttgcttgaacaggtggttgtttttgttgatgcttcagaggctgatgaatttttagaagttgcctcaaagcctttagaatcattaccttatgattcccctgggcagacctttgtggcttttgagaagccagaaggtgtcattgccactggcaagttctcgaatatactgaaattcattgttaaggaggttgatccatccacaggtgaagctgaggatgatggtgttgaagatgagtaccagcttgaagatcttgaaattgtttctgctgattatatgttgaaggtgggagtatcgaacttccgaaatgcctgggaaagcatggatccagagagcgagcgggttgatgagtatggacttggagtaagggagggcttggctgaagctgtaagtgctgttataggcatcctcggcatgcaaccttgtgagggtactgacgctgtcccaagcaattcaaggtcacacacttgtctgctctctggcgtatttatcggtaacgtaaaagtcttggtgaggctgtcatttggaatcacctcttcgaaggaggtggccatgaagctagcagtcagatcagatgatcctgagatcagcgacaagatccacgagattgttgctaatggctaaaacatgagcattagagtttttcttttgactcttcttgtttcggctttcatactaccgaaggctcttgagagaattcaattaattctagtatatgtaagcttggtttcctgttggatc

SEQ ID NO: 20229 - protein, 887 aa, Panicum virgatum
  misc_feature: Ceres CLONE 1810568
  misc_feature (26)..(544): Pfam Name: Adaptin_N Pfam Description: Adaptin N terminal region
  misc_feature (619)..(885): Pfam Name: Gamma-COP Pfam Description: Coatomer gamma subunit appendage domain
MAQPLVVKKDDDLDEEEYYSPFLGIEKGAVLQEARVFHDPQLDARRCCQVITKLLYLLNQGDTFTKVEATEVFFATTKLFQSKDAGLRRMVYLMIKELSPSADEVIIVTSSLMKDMNSKTDMYRANAIRVLCRIIDSTLLTQIERYLKQAIVDKNPVVASAALVSGIYLLQTSPEVVKRWSNEVQEAVQSRAALVQFHALALLHQIRQNDRLAVSKLVTSLTRGSVRSPLAQCLLIRYTSQVIRESGVNQGGDRPFFDFLESCLRNKAEMVILETARAITELNGVTSRELTPAITVLQLFLSSSKPVLRFAAVRTLNKVASTHPLAVTNCNIDMESLISDQNGSIATLAITTLLKTGNESSVDRLMKQMTNFMSDIADEFKIVVVEAIRSLCLKFPLKYRSLMNFLSNILREEGGFEYKKAIVDSIIILIRDIPDAKESGLFHLCEFIEDCEFTYLSTQILHFLGNEGPKTSDPSKYIRYIYNRVILENATVRASAVSTLAKFGALVDSLKPRIFVLLRRCMFDGDDEVRDRATLYLKLLGGEATVGETKDVNEFLFGSLDVPLVNLETSLRNYEPSDAPFDISSVPKETKSQPLAEKKSTGKKPTGPASAVSGPVSTVDASYEKLLSSIPEFADFGKLFKSSTPVELTEAETEYSVNVVKHIYDGHVVLQYNCTNTIPEQLLEQVVVFVDASEADEFLEVASKPLESLPYDSPGQTFVAFEKPEGVIATGKFSNILKFIVKEVDPSTGEAEDDGVEDEYQLEDLEIVSADYMLKVGVSNFRNAWESMDPESERVDEYGLGVREGLAEAVSAVIGILGMQPCEGTDAVPSNSRSHTCLLSGVFIGNVKVLVRLSFGITSSKEVAMKLAVRSDDPEISDKIHEIVANG

SEQ ID NO: 20230 - DNA, 679 bp, Panicum virgatum
  misc_feature: Ceres CLONE 1810572
  misc_feature: Encodes the peptide sequence at SEQ ID NO. 20231
agaagcaagctcgatcgccgggccccttcgtccacctccaccaccacacatctcaccacagtcagagcgaccgcttcggccatggcccggcgggtgtcgtccctactgctgctgctgctgctgggcgcgctggcggcggcggccagcttcgaccaggagttcgacatcacctggggcgacggccgcggcaagatccaggacggcggccgcctcctcacgctcacgctcgaccgcacctccggctccggcttccagtccaggcgagagtacctcttcggcaagatcgacatgcagatcaagctcgtccccggcaactccgccggcaccgtcaccgcctactacctctcgtcgcaggggagcacccacgacgagatcgacttcgagttcctgggcaacgtcaccggcgagccctacacgctgcacaccaacgtgttcacgcaggggcagggccagcgcgagcagcagttccgcctctggttcgaccccaccaccgacttccacacctactccatcctctggaaccccaagcacatcatcttcatggtggacgacctgcccatcagggacttccggaacctggagagcaaggggatcgcgttccccaagagccagcccatgcgcctctactccagcctctggaacgctgacgactgggccacgcagggcgggcgcgtcaaga

SEQ ID NO: 20231 - protein, 199 aa, Panicum virgatum
  misc_feature: Ceres CLONE 1810572
  misc_feature (23)..(199): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50903
  misc_feature: Useful for making plants with altered carbohydrate content
  misc_feature: Functional homolog of the protein sequence given in SEQ ID NO 50904
  misc_feature: Useful for making plants with altered cell wall content and/or composition
  misc_feature: Functional homolog of the protein sequence given in SEQ ID NO 50905
  misc_feature: Useful for making plants with altered lignin content
MARRVSSLLLLLLLGALAAAASFDQEFDITWGDGRGKIQDGGRLLTLTLDRTSGSGFQSRREYLFGKIDMQIKLVPGNSAGTVTAYYLSSQGSTHDEIDFEFLGNVTGEPYTLHTNVFTQGQGQREQQFRLWFDPTTDFHTYSILWNPKHIIFMVDDLPIRDFRNLESKGIAFPKSQPMRLYSSLWNADDWATQGGRVK

SEQ ID NO: 20232 - DNA, 672 bp, Panicum virgatum
  misc_feature: Ceres CLONE 1810582
  misc_feature: Encodes the peptide sequence at SEQ ID NO. 20233
acccgttgggctcgcgcggcgccgacttccccacccctcccctgcgaccaaatctgcggccgcgagggagggactgagggcggccctcgggtacccgtctgcgagcgctcggtggtctccccggcgatcccgcagccatgaacatcttcaagaagaaggtcgaccccaaagaggctctcaggaccagcaaacgtgaaatggcggtcgccacaaggggagttgagcgagagattggctccctgcaaatggaggagaagaagctggttgcagagataaaaaagactgccaagaccggaaatgaggcggcaaccaaaatattagctcggcaacttgtcaggctgaggcaacaaatcctcaatttgcaaggcacacgggcacagattcgtggagtagctactcacacacaggcaatgtatgcaggtacctcaatctctgctggaatgaaaggtgcaagcaaagcgatggcagcaatgaataagcaaatggagccggtgaaacagataaaggtcatgaaagaattccagaagcaatcaactcagttggacatgacgcttgaaatgatgtccgatgccattgatgaaacactcgacaaagatgaggcggaagaggaaacaaaagagcttacaaaccaggtccttgacgagatcggtgtcgatgtggcttctcagcttt

SEQ ID NO: 20233 - protein, 178 aa, Panicum virgatum
  misc_feature: Ceres CLONE 1810582
  misc_feature (16)..(178): Pfam Name: Snf7 Pfam Description: Snf7
MNIFKKKVDPKEALRTSKREMAVATRGVEREIGSLQMEEKKLVAEIKKTAKTGNEAATKILARQLVRLRQQILNLQGTRAQIRGVATHTQAMYAGTSISAGMKGASKAMAAMNKQMEPVKQIKVMKEFQKQSTQLDMTLEMMSDAIDETLDKDEAEEETKELTNQVLDEIGVDVASQL

SEQ ID NO: 20234 - DNA, 1158 bp, Panicum virgatum
  misc_feature: Ceres CLONE 1810583
  misc_feature: Encodes the peptide sequence at SEQ ID NO. 20235
aaaaaccctcgctgtgcaacggcctgcggcggcggccgcccctcctccttcctcacgctggttgtcctcctccccgaccagggcttgccgtcgcccaccctcactcggggacggtcgccctccgcccactcctgctggtaacgggggcggagccagcactagcaatcagcaggatcaaaaatgagcgacgacgtgatatggcactgcatccgccacaaccactgcagcttcatggccaagattacgacagggatattctgccggaatccctacaacgcgacgggcatatgcaacaggagctcctgccctcttgccaacagtcgttatgccaccatccgggatcatgacggtgtcttctatctgtacatgaaaactgctgaaagagctcatctgccaaacaaattatgggagagagtcaaactgccaaggaattatgagaaagcaatggatgtcattaacaagcatcttgaattttggcctaagttacttgtgcacaagatcaaacagcggctgacaaaaatgactcaatatcgtataagaatgaggaaacttcaacttaaagtgagggagaaggttatgacaatgcccaggaagcaaactcagcgcgatctcaggagactggagaaagctgaaaaggctgctcaactagaaaagaacattgaaattgaattgaaggaccgcctgaagaaaggtgtttatggtagtgatgtttgtaacattcccttcaaaaagtttgatgaagttcttgatatggaaagagatgaagtggttcttgaagaagaggatgaagaagaaggcgaggtagaatatgtcgaaggtgatgacatggaagatatggatcacatggaagatatggaagattttgaaggcctcagtgatggaggcacagacgaagatgatcatttggatgaccaagtgccaaagaaacccaagcgatcgggttctgatttgaagcaaaatgctgggaaaaggtctaggaaggttatgactgaggtggaacaagacgaagagacaaatacccggcaaaggacgcgaatgtgaattctgcaagggtaacttcagtatgtgctgataggtgccagtgggtcacttttgttgtatgttagatcattttatttgccttctttattttaatgcgtcacctgggttcctgagcag

SEQ ID NO: 20235 - protein, 286 aa, Panicum virgatum
  misc_feature: Ceres CLONE 1810583
  misc_feature (1)..(227): Pfam Name: Mak16 Pfam Description: Mak16 protein
MSDDVIWHCIRHNHCSFMAKITTGIFCRNPYNATGICNRSSCPLANSRYATIRDHDGVFYLYMKTAERAHLPNKLWERVKLPRNYEKAMDVINKHLEFWPKLLVHKIKQRLTKMTQYRIRMRKLQLKVREKVMTMPRKQTQRDLRRLEKAEKAAQLEKNIEIELKDRLKKGVYGSDVCNIPFKKFDEVLDMERDEVVLEEEDEEEGEVEYVEGDDMEDMDHMEDMEDFEGLSDGGTDEDDHLDDQVPKKPKRSGSDLKQNAGKRSRKVMTEVEQDEETNTRQRTRM

SEQ ID NO: 20236 - DNA, 493 bp, Panicum virgatum
  misc_feature: Ceres CLONE 1810605
  misc_feature: Encodes the peptide sequence at SEQ ID NO. 20237
acggctcgtctagactctagaggagacagtcgcaggagaccaggagaagcagccggcgagcagcaagccatggcgtccaccacctgcttcctccaccagtccaccgcccgcttcggcgccgccgccgcctcggcgcgcccccaggcgccgcgggcccagcagctcgtgtgcagggcgcagaagccgcaggacgccgccgccgagggcgacgccgcggtcacccgccgcgccgcgctcacgctgctcgcgggcgccgccgccgtcggcgcccaggtgaaccccgccgccgccgcctacggaaaagcagccaacgtgttcgggaagcccaagacgaacaccgactacgtcgcgtacagcggcaactgcttccagctgctgatcccggccaagtggaaccccaccaaggagcgcgagttccccggccaggtgctcccctacgaggacaacttcgacgccaacaacaacgtctccggcatcctccagcccaccacca

SEQ ID NO: 20237 - protein, 141 aa, Panicum virgatum
  misc_feature: Ceres CLONE 1810605
  misc_feature: Functional homolog of the protein sequence given in SEQ ID NO 50254
  misc_feature: Useful for making plants with altered lignin content
  misc_feature: Useful for making plants with modulated nitrogen use efficiency
MASTTCFLHQSTARFGAAAASARPQAPRAQQLVCRAQKPQDAAAEGDAAVTRRAALTLLAGAAAVGAQVNPAAAAYGKAANVFGKPKTNTDYVAYSGNCFQLLIPAKWNPTKEREFPGQVLPYEDNFDANNNVSGILQPTT

SEQ ID NO: 20238 - DNA, 1329 bp, Panicum virgatum
  misc_feature: Ceres CLONE 1810609
  misc_feature: Encodes the peptide sequence at SEQ ID NO. 20239
aaaagaatgtagctgttctccaccatccacgccatcatcatgtgcacctccgactcgccgtccacgggatcgaccggcagtctgcggcacaccactacactcgcctgcgccctcgccgccagccatgccgagttcacggcctgccgccgcctccatccccgtgtcctcgccggcttctcccccgcgccatcacatgatcactcgggctcgagctggtgttttcaagcccaacccgcgatacgcttctcttcatgcgccaactccgatctcgccgatcccgtcttccattcggcagctcaaccccgacggcagcctggagcggtacaaggcacggtgggtcgtgcctgggttttcccagcgtccaggcatcgacgtcccgggggcggcggcgcggctgccggcctcgatcgcattggcgtggggcacggcgccggcgctgtacctgtcgtacggcatggtctcgctcaagggccggcgcccggcgctgacggacgccgtggcggccgcgcggtcgttcacggcgctgacgccgcccctgggcctcgactacttcgcggtgttcgacggcggccacctcggcgcagccgccgctcggcgcctgcgcgcgcggctggccaccgccatcgccgagcggatcgacggcgagctgcgcagcgaggtgccgctgttcggcgtggcgtcatcgcgtgacgtggcggggtggtggaggacggtcatccgggaggcgttccgggccgtcagtggcgaggtgacggccagcggcggcggcagaggcgcgacggccctcgtcgcgctggtcctggagaagtacatcgtggtcgccaactgcggcgtaggcggctccaaggccgtgctatctcgctgcggcgagcacgtggagctcagtactgaccacatgggagctcagtccaggcctccggcgatcgcggaggccgacgtggtggcggtggagcggggggcgcgggacgatttcctggtcctggccagcgacgggctctgggacgccgtgacgccggcgtcggcgtgcgccctcgtccggcggaggctggtgacgacgccgagggtcgccaggccgcgggagccgccgctggacgccaggggctcgccggccgtgctcgccaaggagctggcggagcacgcggtgcgcgcgggcagccaggataacgtcagcgtcgtcctcgtcctgttcagggacttctggggcgcgcacgccgtacgtggtaagtagtgaccagtgattggttgggtcctatggcctcaaactttgaactgctagccctgttactggtactaatttctgcgagctgaaatttatgaggatgttttact

SEQ ID NO: 20239 - protein, 344 aa, Panicum virgatum
  misc_feature: Ceres CLONE 1810609
  misc_feature (84)..(325): Pfam Name: PP2C Pfam Description: Protein phosphatase 2C
  misc_feature: SWISSPROT Homolog: EC 3.1.3.16 Phosphoprotein phosphatase
MITRARAGVFKPNPRYASLHAPTPISPIPSSIRQLNPDGSLERYKARWVVPGFSQRPGIDVPGAAARLPASIALAWGTAPALYLSYGMVSLKGRRPALTDAVAAARSFTALTPPLGLDYFAVFDGGHLGAAAARRLRARLATAIAERIDGELRSEVPLFGVASSRDVAGWWRTVIREAFRAVSGEVTASGGGRGATALVALVLEKYIVVANCGVGGSKAVLSRCGEHVELSTDHMGAQSRPPAIAEADVVAVERGARDDFLVLASDGLWDAVTPASACALVRRRLVTTPRVARPREPPLDARGSPAVLAKELAEHAVRAGSQDNVSVVLVLFRDFWGAHAVRGK

SEQ ID NO: 20240 - DNA, 668 bp, Panicum virgatum
  misc_feature: Ceres CLONE 1810610
  misc_feature: Encodes the peptide sequence at SEQ ID NO. 20241
cgcggacagaaaggcaagcttaaaaagattaaagagaagtatgcagagcaggatgaagaagaaagagaaattcgtatggcattgcttgcgtcatctgggaaacctttgcgaaaggacaagcctgcacacgatgaagaaacctctgctaaagaatcaaagccatcagctggtgaagatgactcatcaaaaatctgctataaatgcaaaaaagctggacatctttctcgcgattgcccagaaagtacatctgaggcggaccgaaatgacgtcagcattagtagaagcagggatggtatgggtgcaagtactgctcctgctggtggaaacagtgccatggacgaagacgatgttcaagagattggcgacgaagagaaagaaaagctcattgatttggactacttgaccggaaacccattaccaagtgatattttgctctatgctgtacctgtgtgcgccccttacaatgcattgcagacatacaaatatcgtgtaaagattactcccggcacagcaaaaaaaggaaaagctgccaaaaccgctatgagcttattcctgcacattcctgatgcaaccaaccgtgagaaggagctgatgaaggcatgcacagaccctgaattggttgctgctattgttgggaatgccaagattacagcaccgggcctcactca

SEQ ID NO: 20241 - protein, 222 aa, Panicum virgatum
  misc_feature: Ceres CLONE 1810610
  misc_feature (63)..(80): Pfam Name: zf-CCHC Pfam Description: Zinc knuckle
RGQKGKLKKIKEKYAEQDEEEREIRMALLASSGKPLRKDKPAHDEETSAKESKPSAGEDDSSKICYKCKKAGHLSRDCPESTSEADRNDVSISRSRDGMGASTAPAGGNSAMDEDDVQEIGDEEKEKLIDLDYLTGNPLPSDILLYAVPVCAPYNALQTYKYRVKITPGTAKKGKAAKTAMSLFLHIPDATNREKELMKACTDPELVAAIVGNAKITAPGLT

SEQ ID NO: 20242 - DNA, 717 bp, Panicum virgatum
  misc_feature: Ceres CLONE 1810620
  misc_feature: Encodes the peptide sequence at SEQ ID NO. 20243
aagcgccagcggagggagcgcgagagctggagacggagatcatggtgcgggcatgggggcggacggcgctgcctccgctcctcatactctgcctcctccacctgcagtactccccgctggtcttcgctcaagaaggtcaagaaaaagaccctgctactctgttcgcacgagcatcggagatgatgaacctgaggaagtatgatggggcacttggcctgctaaatgctgtgttggaagttgacccaagtcattctgaagcttacaggcagcgtgcatcagtgctccgccataagtgcagatacaaggaagctgagagtgactataacaaatacctggagctcaatcctaggactgctacagtggaaaaggaattgtctcagcttctgcaggctcaaaattcattacagtctgcttatggccagtttgatttcggagacttttcaaaagtcctggaatacatcaacaaaattgtgcttgtcttttctccaggttgcttgaaggcaaagcttctcaaggctaaagcgttgctagcactgaaagactactcaagtgttatttcagagactggatttgttctaaaggaagatgaagacaacttggatgcactgctactacgtggccgggcctattattacctcgctgaccatgatgtggcttccaggcactaccagaaagggcttcgtcttgacccagagcattcagatttgaagaaagcat

SEQ ID NO: 20243 - protein, 225 aa, Panicum virgatum
  misc_feature: Ceres CLONE 1810620
  misc_feature (71)..(104): Pfam Name: TPR_2 Pfam Description: Tetratricopeptide repeat
  misc_feature (186)..(219): Pfam Name: TPR_2 Pfam Description: Tetratricopeptide repeat
MVRAWGRTALPPLLILCLLHLQYSPLVFAQEGQEKDPATLFARASEMMNLRKYDGALGLLNAVLEVDPSHSEAYRQRASVLRHKCRYKEAESDYNKYLELNPRTATVEKELSQLLQAQNSLQSAYGQFDFGDFSKVLEYINKIVLVFSPGCLKAKLLKAKALLALKDYSSVISETGFVLKEDEDNLDALLLRGRAYYYLADHDVASRHYQKGLRLDPEHSDLKKA

SEQ ID NO: 20244 - DNA, 1587 bp, Panicum virgatum
  misc_feature: Ceres CLONE 1810622
  misc_feature: Encodes the peptide sequence at SEQ ID NO. 20245
tactcaccgcgccggcggggctccagctcagcctccgcctactaatggccgccggatctcgccgcccgcggcgacggagatgaagcgccgccaccacctcctcccggtcctcgtcctcctcgcgctctcgctcctcgccctcccctaccgccgccacctgttcctcccccgcggcccgtcccagtaccccgccggcggcgctgacgagctcctccgccggctcgctgcctccgacgccggcggggatcaggtcctgtccgaggcggccgcgctgctcgccaacgcctcggtgatatccttccccagcatcggcaaccgctaccgcctcctctacctccgcctcccgcaccgcggcaacggcagtacctcggccccgcggcagcgggccgtctcccgcctccgcgttcccttcgtgacggtccccgacgacggccccctcctcgccgccttccgcgcctccctccgctcgttcgtcctcgcgcaccgtctccgcaggggcagcaatgtcgccgccgtcatgggcgacctcgccggcctcctcggccgcccgcggcgcttccccacctgcaccgtcgtcggcaacagcggcgtcctcctcggctccggccggggcgcgcagatcgacgcgcacgacctcgtcgtccgcctcaacaacgcccgcgtcgcgggctacgccgccgacgtcggcgccaaggcctcgctctccttcgtcaactccaacatcctccactactgcgccgtccgctccgccgtcgccaccggcggctgcgcctgccacccctacggccgcgccgtccccatggccatgtacgtctgccagccggcacacctcctcgacgcgctcatctgcaacgccaccgccacgccggcctccccgttcccgctgctcgtcaccgacgcgcgcctcgacgccctcacagcgcgcatcgccaagtactactcgctgcggcggttcgtggcgacgaccggcgagccggcgagcaactggacccggaggcacgacgagaggtatttccactactcttcggggctgcaggcggtggtgatggcgctgggggtctgcgacgaggtgagcctattcgggttcgggaaggcggcgggggccaagcaccattaccacaccaaccagaagaaggagctcgacctgcacgactacgaggccgagtaccagttctaccgtgacctccaggcgcggccggagacggtgccgttcctcgacgaggcgccgggcttcaaggtgccgccggtgaagctgtactggtgagtggtggccggtgaagtcagcaacgtgcaattcctacttgttgtaaaatttttctttttaacgatttgacaggtgattatacattgagaaatgtgtacattgtgaaaactgaaacatgaaagggtatgagaggttgcggagcttgtagaggagaaaatgcagctcaattttgtgttgatcagatgggccaaaatagttatgcattattgtatttgttgtacaattcttacacttgactgatagagatgtttaagctgagaaacaagggtgaactatgggcaattcaaagggaatgagaatctgacatagaggtttctgattgg

SEQ ID NO: 20245 - protein, 394 aa, Panicum virgatum
  misc_feature: Ceres CLONE 1810622
  misc_feature (101)..(381): Pfam Name: Glyco_transf_29 Pfam Description: Glycosyltransferase family 29 (sialyltransferase)
  misc_feature (302)..(378): SWISSPROT Homolog: EC 2.4.99.4 Beta-galactoside alpha-2,3-sialyltransferase
  misc_feature (179)..(208): SWISSPROT Homolog: EC 2.4.99.6 N-acetyllactosaminide alpha-2,3-sialyltransferase
MKRRHHLLPVLVLLALSLLALPYRRHLFLPRGPSQYPAGGADELLRRLAASDAGGDQVLSEAAALLANASVISFPSIGNRYRLLYLRLPHRGNGSTSAPRQRAVSRLRVPFVTVPDDGPLLAAFRASLRSFVLAHRLRRGSNVAAVMGDLAGLLGRPRRFPTCTVVGNSGVLLGSGRGAQIDAHDLVVRLNNARVAGYAADVGAKASLSFVNSNILHYCAVRSAVATGGCACHPYGRAVPMAMYVCQPAHLLDALICNATATPASPFPLLVTDARLDALTARIAKYYSLRRFVATTGEPASNWTRRHDERYFHYSSGLQAVVMALGVCDEVSLFGFGKAAGAKHHYHTNQKKELDLHDYEAEYQFYRDLQARPETVPFLDEAPGFKVPPVKLYW

SEQ ID NO: 20246 - DNA, 679 bp, Panicum virgatum
  misc_feature: Ceres CLONE 1810627
  misc_feature: Encodes the peptide sequence at SEQ ID NO. 20247
aatcctttgtcagacgcaggaaaaggtgttggtcgtcggaatcacggaggcggtctccgttcctcttcttcctctggtccggcagccatggcgtcgaacgggagcagcacggtggtgggagagatgcagagcagcttggagcgggtgaggcggcagctctcctcaacctccaccctgcagctcctccagggccctctcctgaagcgatccgacacgctaagaaaatggaacgagcggtgggtcatacttgatcctacaactggaaagatagaatacaaggttcgtagaagtgacaaagatgttaggggagtaattgtgtttgatacaacaagcacggtgacattatcacctatgaactttcatgggctggcgaaatatgatggatgctgtttctatattggaactccacagaaaaaggaatactttctttgtgcagaaactcccagcgctgcaagagcatgggtatccactttacatgcggctcagttggtactacaggctcataaggaggcggtgaattcattgggtgagaatggtcctgcaaaattggggacagttgctactgtcgtggctgtagccaatgccactgctattgaggcaacaaaggaggtggaagctgcaatgaaaatttccttgcgggcagctttgggctcaactacaaataaacttaccaaagggc
